United States Patent 9,487,797 (GENOMIC PLANT SEQUENCES AND USES THEREOF) - sequence listing, part 63

SEQ ID NO: 71515 - DNA, 14737 bp, Oryza sativa
atacatagatccacaaaaacacaggagtagggtattacgcttctcagcggcccgaacctgtatatatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcgggaggagacgctcgagagggtcgaaggatccgcgacttcgacatccacgggtgatggggaagggcggcgagatggggagcgtcgcctcctcgtctacggcgacggcagcacgccccagggcgcgctccaagctacgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggcttcgtgtcgtcaaggcggagggcgcggcgagcggcggctgttgctcgccattcagccgccactccttcgtcagcgcctccgacccaggaagaactgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcaagccttcgaaacgtccgttggcccccaggttccggcccaccatcgccgaaaaatatgataggagtgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgcttgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgcttcgcgggccacccgaaaggggaggcctgcgagcaacaaaaagaaggaggccggcgctcccagtagggagcgcccaaccggcaagtggttcatcgtccacaacacctcccttcacgacctcgcggactgccgcgcagtcaaaagtttggctgagcggacgaggaagtgggaggaggagaggaggcaggagcgccgagagggcaagtcctcggcggttccttccggcaatcggcgaagtgaggccaagcagaaggcccccgccgaggacatcgatgacggcgatgatgacctaggtttccaagagcctggggccaccatttccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccagggaggacagatcgcaatggtggtttcccccactgtttgcaacgtgaagctggggcgtgtcctcattgatgggggagcagccctcaacatcctttcccccgcagcctttgacgctatcaaggccccgggaatggtgctccggccgttccagccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgatgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcttgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcagggtgcgatcttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgttactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggcactctgcccgcttgtcagacggtgccaggtgcccccgacccccagtatggcccgagggccactgcgggaaggccgcacctatcgccctctgaccccgaggctaactctgtgacgactcgacccgggagagagcagggagaagaggcccccgagccgaacggtggcctaaggcccctgacgaccggagttggccctttgcccgcttgtccaacgacgccaggagcccccgacccccaggacggccccgaggccactgtgggaaggccgcccctgtcgtctccgaccccgaggtcgtcggcacagaagacgagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgtgccattatttccaggcgcatcgggtcacggtgattacgtcttaccccctcggccaaatcttgcataatcgagagggtactggacgggtggtgaaatgggcaatcgaactttctgagtttgatttgcactttgaaccacgccacgctatcaagagccaggccctcgtcgattttgtggcagagtggaccccagctcccgagcccgtctcagtccccgaggccagctcgggcccctcacagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctagtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacaggataacacggttgccgacgaactctcacggctcgcttcctcgcgagcccagaccccaccgggcgcctttgaagaaaggcttgcccagccgtcggcgtgacccaaccccttaggggagacggacgcgcctgacaggccctcgatgcccgtcggagtccaggcctcgggacccgaggggagcgctcccagctcccttagattgattgcttggatcgctgagatccaagcatacctcacagataagactctacccgaggaccgcgaagggagtgaacgcgtccaacgcatctccaaatgctacgtgctggtagaagggaccctctatcggcgcgcggctaacggaattctcctgaagtgcattcctcgggaacaaggcgtcgaacttcttgccgatatccatgaaggcgaatgcggatcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgactactgcgaagacatgggcatcaagctctgctttgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgagctcccctcgggccaccatgtactgcgaggctgatgaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctctgttcggctggccacgggcgacggcacagagttgcctaacccgtggaacatcgaacaccttcgtcgcttctacccctaaagggggatcgggtgtcaggtttcgggctcgggccaaccccgcacccccctcgggcgtgcagggttggccgggagctaccacatatgcatattcttatttctcttatatctgtatttcaataaaagtattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcatcacgctcccggcctggccagtctcgacatgtggatctccccaggcactagccccgacccgagccatttgaggactaggacctgggcacgagcccttgttcaagccaagacacaaaaggaccgcggcacagaccatcctcgtctcatacacacaacaaatagaattgacacaaaaaattttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccattgtcgcccactccgccgtcatcgtcctcctcgtcggagttgagggcgaacgcgagccgaggggccgaaccctcgaagttgtggacgatatggtcggcggcgtcccggacctgcgcgcgcgcgccgtcctcggtccagggagggaactcgtccagcgccgtccatggggagaagtcgggatccctggcttggtaactcgccagtacgagctccaccgctcctcgggcgaggtccctcgaggatgacttaatcgtcctctcgagctcctcgggaagccgttggagagtcccggctatctccgagaggcgctgggcgaggcccccctggttggcggcgtacttcgcagtccgcccgccccagagcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcagtagctgcgaggcgggcggttaagtcgctttcacccgcggccgccccgccactgcgcgccctcgcgtccatctccctctcccgcgcctcgagctcagcggcccgctgattcagcgcggccctctcggcgcgggcaccttctagattacggcgcgcctgctcctcccgcactgcctcgcggagggataggctgtccgccagccgttgcgccgcggcctcggcctccttgagagctcgctcccgctcggtgagcgcgtcctcgcggaggcggagcgcggactcctcttcggcgcaggcggcctcgtgcgcagtcagcgttgcctcccggatggcaacggcagcctcgcgatccgctaggtccctctccacggcacaggcacgctcttccagcgccatggcacgggcctcaagggcttcttcgcgccgccgggatgccacctcggtctccgccgcccgccgttctcgggcagcggcagcgtcaaggaccccctgggcggcgtcgagcttcttccctagctccacctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgtgcccatgcggcgtcgagctccgcccgctctgcttgcagggcctccacctgggcatttaacccgtccaacaccgtggtgtttgcgacggccaaggcctgcagaaggggttctgcgctcagtggagcaacggaaggtgtggggaagagccgcctcgaagaggatgccgcgcggcttggcccgccgatggacgtgccggactcggggatgttccccggacctggtttgtcctgagcgtcgcacgagggagtgggcccaagcgatgcacccgcggcctcgccgcgagttgcctcggaagtcgttgtcgcctcggcctggcgaagtctagcctcctcccgagcggcttcttcagcttggcgagctcggacggccacctgggcagcttcctcggcttctcgaaggcgatccacggcctcttgccggtcagtttcacgggtcgcctcggaggatgtcgtcgcctcggcctggcagagtccggcctcctcccgagcggcttcctcggtctggcgagcccgggcggcctcccgagcggcctcctcggcttcccgaaggcgatccgcggcttctcgccggtcagatttccgcctccgggcctctgtggtcgccgggtcctcggcctcagactggccggacttggaatggcgggagggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtcccccccatcttgcggagccgtttcttcttccgctccctctcgagctgcggcgtcggcgcggccccctccgggcgcctgctgctgacacgcgccgccccgccccctcggggaggagatggggaggaagtaccctcttgctttctcttccctcgggcgtcggcagggcggctgccccccgagcccccatcacggggcccagaagcacgaccccctcccggggtagattgttcccccctgcggctcccgcccgagccatcgtggcctcgaggagcccgctcctccgacgccccgaccgcctgcatgatggtcaggatgttggcgcgatatggatcgctgcagagggggaggactccttgggggatgagggatgcctccgcggagctgagattcagcatccgttggatcattaccttgaagtcttcggggacccagtcccatttgaccccccggtgggtcctcatacagtcctcggacccggtgtactcccaggcaccccgggcgcgccgctggagtggcgcgatccggcgacgaaggtagtcgccatacaccatggcccctgtgagccccagggatcgcaggcccgccaggcggtcgaggacggcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcagggaatatagcggttcaacaccggcccccgcggctggaagtagcagccaccaaccaccgacggcggcgacaccgactgtacggtgaagaaccaccgaaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcatggcaccgggcgtccctcgcccagcgtaactatctcccggccggtggcagattccggcatgaagcggcgcggcagcccggcctgcctctcgctcacgatgcgggaaggcggcagcacgctaccatcaagcaaagcggagccccgtgccatgacgccggaggaagagatgtttaagagcgagcgcgtgtggcgaaggtagggcacaggaaacaaggagttagggcgcaagcggcgaagacaagggaaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccaaagcgccatcaccatatctccaggaaaaacgaaccggcttgtcccgatttttagaccggccccaccatgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatatataccaggcttcatcctaaccattacaagcaagacattgtatgaagaggggcgaacatgcagattgataaactgacgcgtggtggacaagaatgaccgatttgtgaccggtctgacactgatcatgtcgtcaacagacagccatgttcccacgtcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggatggattttcggatccagaacgatcagagagggagagagtaagggctctctggttctccagctcttttgtagcttcttcatacatagatccacaaaaacacaggagtagggtatttacgcttttcaccggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcagtggtggtggacaaagaagccgatggaggatggtagtatagagggttcgtcggcgagcctcgctggtgttggaggtgacgttagcgatgtgaataggcagcagtgagagggttgggggggaggatggcagcgccggcaactaggccattaagggcaatatatatatatgagaccatggatgtaatctaggtttttaggttgtgatccaatggtttaatatttgcaatatttgtctgcaaatttttctgtcaaattatatacttttttgcaagattcatttttctttagaaaattcagttgaatatttgtttttcttccgattcatgtaggatctgtttataggtggcagcgagacggcggcgacgacgctgcaatgggcaatgtcagagctgttgaacaatccaaaggtgatgcagaaggcacaagacgagatacgacaagtgctttatggacaagaaagaataaccgaggagaccataagtagtctgcattacttacacttagtcatcaaggagacgcttcggctacaccctccaacgccactacttctaccaagggaatgtcgtgaaccatgccaaatattaggattcgacgtgtctaaaggggctatggtactcatcaatgcatggtctattggtagggacccaagcaactggcatgcacccgaaaaattcatgccagagaggttcgagcaaaacaacattgactttaaggaaacaagctttgagtacataccttttggagcaggacgaagaatctgcccaggcatgacgtttaggctagcaaacatcgagcttttactcgcaagccttctgtatcactttgactgggagcttccatatgggatgcaggcaggcgacctcgatatgactgaaactctggcggttaccgcacggcgaaaagccgacctgttggtagttccagttgtgcgtgtccccatcgtgggttaattagccatccacatttcagttgaccgttattcatatcgatcagtgtctcgctgtcctttgtccaaatgtcaaattaatcagccccaataatgatcatatatatgttttgtttgacttttagtttgttcgagcagcagtaagtagataggctaagctttgaacaaacattcaatgtcgttcatgaaatgtatctgcgagtgatctccaatggtatcttgacagtgatgttttccaacctgttcagacaatatttttcaacatgttcagacaatttttgtccctgcttagaaacttatcaagatcagaattcagattattagaaccaacttacaacaatgaacaaactgcaaatgatctgaagtccaaaaaaacaactatgcctatgctgaattagcaacgactgaatgagaacatgcaaagcgagagctcatctgctcaccttcctggatactcacacgtcgtatgcatccattctcctcccgtttcatccccccctcaaaaacttcttgtcaacatttggcagagcagcggtgatttcaccgtgccatgttttggaatttcgacatcctgtctcagtgtctccacacaaaatgtttttatttttgtttttgttttgttttgcagaggccaaatgagtatcagctccacaacctcagggcagtaggacactctgtttggctgggctataacttttcagataaacagataattagttaagataatatagatgcttagatttgatttggtcaccacatgactaacactagtacatgccgataaaaatgctgctttgcaatatgagaacgataagtatcttgatatgaaattaaatactcctactaaaataacaagtaatatgaagaataaaaaagaaaagtattttttatgataacgaaaagaaatccggtctctatgttcacacacggccctttcagtgtagtatgctaaaaccttgtcacggcccagaattaacgtcgtctgaatgtcaacatgaaagaactcatttgctcatgggcttcaccttcctgcacactcacgggtcagatatatccattctcctcccatttctttccaccctcgaaaattttgtcaacatttggcacagctgcagtgatttcactgtgccatgttctggaatgttggcatcctatctcactgttgtgtctggctgcttggctggccaatgaattgtcagatataatagactagtattagacaaaataatatagatagttagatttaatccattatctaaaagagcttagatttgatcaggtcatcacatggctaccactagtagatgtcagtatcactttggacatttggacaaacactttcttatcggcacagcttctgagctccttcagttcaatccacccattcgatagtccaaaggagcaaaagccatagccatggcggcggcggcgtcgtctgttctggcctacctgctcgtcgttgctctccttgccatcgtgcctctcgtctacttcggctgggtggcgcgccggcgcggcgagggcgggcggctgccgccgtcgccgtgggggctgccggtgatcgggcacctgcaccacctggcgggcgcgctcccgcaccacgccatgcgcgacctggcgcggcgccacggcccgctcatgctgctccgcctcggcgagctccccgtcgtggtggcgtcctccgcggaggcggcgcgcgaggtgatgaggacgcgcgacatcgagttcgccacgcgacccatgagccggatgacgcggctcgtcttccccgcgggcaccgaggggatcatcttcgcgccctacggcgacgagtggcgggagctccgcaaggtctgcaccgtcgagctgctcagcgcgcgacgcgtccagtccttccg

SEQ ID NO: 71516 - DNA, 999 bp, Oryza sativa
  unsure (1)..(999): unsure at all n locations
ggaaatttattaaaaaaatagtcataccagagaagtttttattaaatttcaaagttttaaaatgtttactttgcatactattgatgagaaaaaaaaataatggagcaagcatcaattggtgttacaaccctaataaacnntggctggacattgnnaagaacatgctnngaaccatctnncttccgttnnggtgganntgattgannnttttcaccaannntttcattttttantttgtactnaagttgagagtanaggaacttttgaaggttcacttttctnngttaaggannnacttgaaggttattttgtatgtttagaattttcctggatactgaactacagaaatatcctaggctgtacagttgagaccaggaattgaaatttcttttttgtgctgtagctgtatatttcgtgtaattcaatcagctcttttattattttgctacaaacaatcatcaatcaggctggataacactttttgtttttacaaatcagggtactatttgtagaatactaaaggaacagtttcatcatcttctgtatgagcaaataaaatgcaatattttgaagattgggcaaaagtattacttacaacaagtagggattgctcaaggaagcaagttatctcccaacctgtgttccctgtactatggccacctggaaaattcagtgctatcaaaatttctgcatgatagcaagcttaatgcaggagaggctttttcggaacctgaatatttgttaatgaggttcattgatgatttcatatttatctctttctcactggagcatgctcaaaaattcctcaataggatgagaagaggttttgtgttctacaattgctacatgaacgacagcaaatatggctttaatttctgtgctggaaatagtgagccttcctctaatagactctacaggggtgatgatggagtctcattcatgccatggagtggtttgctaataaattgtgaaactttggaaattcaagctgattatacg

SEQ ID NO: 71517 - DNA, 2756 bp, Oryza sativa
attttcatagcaaacagtaatgtagtttgatttgctcaggctctaaaaaaaaatttggtaaacggccactggaagcgcccaaataatattccttccatttttaaataatggacagcaggcactattcactttctcactaggaccaatccaattcacaagatatctacaaacactaaaaatgatgtcatgttcttaaaatgtattatatccaaaatataagcatgaaattttcattcactttagtctaaccatttatgagtaattagtggtcaaagtttaaatagtaaagtcaaagatgtcaattaattaaaatgagaggaagtaactatcaagtgagggaagcacccatacaccataggccccaggcccgatacgcatccaagcaattaaaccaagcgtttcacgagggaagcacccatacgccataggccccaggcccgatacacatccaagcaattaaaccaagcgtttcacgagtgaaaaggctaattggcggttggctgcgcgcgccctctcccgcgcggcacaaccacgtggcttgccgcagagatggggcagctgaaccgcgcggtgggaaggggccacgtgcccttttttggttttttcccggttttctcagtttctttccggttttccattttttttatttttctctcgttttttagtatgtacgtatacaaacttgtatacatgttttttcgtttctctcgtgtttttttttcagttttttaatatgtaggtatacaaactttatatgtattgtatacatatgtatacaaagtttgtatatgtgtatatttttttaaacataaaaaatgtaatatgtatacataaattatatatatacatattttatatatacgtatgcatatactttatacgtaaaaagagggaaaaggaaagaggaagagactaaagggtcgaaagccacgcgtgcgggcgcatccccacgcagccacatgcgcattaaagctccccttacacgagcacaaaaaatagtgtttggtgtgcccattggcgtcaaatgcgcaatggaatttcgacgttgtcatagagattaataatacttcctccgtttcacaatgtaagactttctagcattgcccatattcatatagaagttaatgaatctagacacatatatgcctagattcattaacatctatatgaatatgagcaatgctagaaagtcttacaatatgaaacagagggagtagtgttttttcatagcaaacacacttaatatgtagttcgatttgtccgggctctaaaatttcttttgggtcaatggccactgaatgtgtccaaataataactgccaagtgatggaatcacccatacgtcacaggtaccaaccccaaacacgtcagctaagcaacagaactatggtggaccttgcaaaaagcgaagcattcgtccatgtgtaaagtcaaattcgaaatcgagcccaaataaggccttgtttagttcccaaaatttttttcccaaaaacatcccatcgaatctttggacacatgtatagagcattaaatatagataaaaaaactaattgcacagtttgcatagaaatcacgagacggatcttttgagcctaattagtccatgattatccataagtgctgcagtaacccacatgtgctaataacggattaattaggcttaataaattcgtctcacggttttcaggtgagttatgaaattagttttttcattaatgtcgatatccggtcaaacgtctgacgtaacacccaaaaattttcttttcacgaactaaacacaccctaagttacaagaccaatttcttctctcttttttttcgatgacagacttttttttcccaatgaagaggacctaatttagagagaaataaattaggggaggtgcatggcgagaaaagcgttgcttgctcttaccctcagccagcagatgatctgctggtaagttttcgttgatccaagtcttcacgcgtcacagattaattaacctggaattcatatgacatcagaacatcaaaatgatcaaacccccatggattattcgagtaggagaaatccagacaagataattattaaagagaaaagggaaaatggacagcaatgacacgatgatgcacaacctttagaaataaatgaggaagggaaatctcgaaataataaagaaaaatagaatgcgaaaaaaaaaataaaaaaactaggcttaaaaggaaacaagaaatcaatttgaaattgggggcgggggggacagaagaaagaatgtcaataaccaaaatcaaataccttattaatgaaagaataaacagaagaagttagcaataaaataaccggaacgatcggatgccaagaaacggtcaaaagaggccctacgagtacgagggcgtcctggctacgtgcggctgcgaataaaccctcaaaaccctagccgccaccggccaaaatcagtcaagactacgagagagagcccaagaagcgacatgatcgatcggaggagattactagattagggcgcgttaccgggcgggcaccgtcgacccaatgcgagaggaaagtcccgaacgagcgagcggcggcggagcggggagacggagacacggccgatcgagggcggagcgaggaggaggagaggagagcagcgagcggcgtagtagtaggctagaggagaaggagacggcggaaggaaggaggacgagaaaagaagaacacgggggtttttccgcggaaactgcggtagaaatcggagagagaatccgcggcggagat

SEQ ID NO: 71518 - DNA, 2256 bp, Oryza sativa
atcggccgccgggcagccccgtgacggggaagggtgaatccgctagggtttcaggttttgggtttcaagttttagttttttttttcatgatttttcttttagcagtgcagtgacataatttaccgcttgtgaaaagtggaatttcatggacgggtgtgccatctgcttgtaaaaatagctacttttactgacacctccgagcaggcagacggcccaattgcatgcgaaaatttgttttgacggtatgggaacatgcatttttgtagttttgaattaccttatatttaatcaatatacatattcaagttggcatgaatacattttcatattctgaattgtccgggctgatcaatttgtgatagcgaacagaatatgtatttagttcacatgtacatagtatcttcctctacatgggcatattccatgtactatctgatctaaatatttaatgcatatacagccattattgatgggtggaaataaaaccaaattagcacatcgatgtccagatatgcaattcaattggtttgccagatccaagtcctcgtgaaacaaattatatacttaaagaacaaaagtttgcgtatggccaatcatctcctgccatttaatcttgcattctgcaagtatatatgctatttgtacgtactcatgctcccaaacaatctttcttcaagtttgagcttgaatagttgttaagggaaaggctttcatgagttagtagcggaagtttggagaaaagagaacaagggttctatgatgatggaaagatagcaaaataagatccatagattaagacagttcttgagaggttgggcaaaaagcacaagtgaaacatatagaaaagagaaggctgaactaagtgcaaaagcaaatcagttagattaaaaagccgaggtgcaaatattgactaggcaggagttagatctcaagaactacttgaaaaatagactagctcatctgttaagggaggaggaaattagatggcaccaaagataaaaaacaaaacatttaattgaaggggaccggaatacaaaatactatcatatgattgcaaatggcaagcataggaagactaaaatttttcagttagaacaagaggagggtttaattaaaggtgatgaagatttaaaaaagtacattactaaatactacgagaatctttttggaccaccggaggaaaataatttttccatggtggaatcacagaaagaggacattgcacaggtatcagatttagagaatgaaatgctaattaaaatatttaccgaagaggaagtaaaacaagctattatccaaatggaacaaaataaagccccgggacctaatggtttccctgtagagttttatcaagtgttctgggaggtaattaaagaagatctcatggctatttttacagaatttcatgaaggaatattgccgctccacagcttgaattttgttatcatcactttgttaccaaaacagaaggaacctcgacaaattaagcaatacatacctatatgtctgttgaatgttagcttcaaaatctttccaaaggtaatgactaatcgaatagctctagtagctcagaaagtcattagatcttcacagacggccttccttccagggaggaatataatgtaaggggtggtaattttacatgaaacaatccatgagatgcatagaaaaaagaggagtggagttattctaaaattggactttgagaaagcatatgataaagtagattggacttttttacaacaaaccttgaggatgaaaggattttcgcaaacttggtgtaactggatttaacaaattgttagaggaggaagtgttgctgttaaggtcaatgatcacattgggaactttttccaaacaaaaaaaggcttgagacaaggagatctcctatcactaattctatttaatttagtggcagatatgctatctatcttaatacaaagggctaaggatcagaggagatttcagggagtcatacctcatctagttgacaacggcttctcaattttgcaatatggtgatgacacaattctcttgatggaacatgatcttgatgaagcaaaaaatctcaaacttgtacttagtacatttgagaaacttgcgggtttaaagatcaattttcataaaagtgaattgtttttttatggcaaggcaaaagatgtagagaatgagtatgtcatgctttttgggtgtagatctgggacttacccatttagatacctaggaattcctatgcaccacaagggctgcaggaat

SEQ ID NO: 71519 - DNA, 32608 bp, Oryza sativa
ccacgtagcaaggcctgtacagttcgcgaaaaagatttagaagctacatgggatatttgacgggatgatagaaggatttttcagacacgaatgaaaaaaactaatttcatgacacgcttggacacggcaagacaaatcttttgagcctaattaatccatcattagtacatgtaggttactgtagtacttatggctaatcatagactaattaaactcaaaagatttatctcgcgttttacctctaactgtgcaattggtttttttaatatatatttaagagtaaagtgcaccagcggtccctaaacttgtgcgggtgtgtcatctaggtccttaaactctcaaaatgcatttttggtccccgaacttgtcttcggtatcatatacgtccaaacgggctccgatccgctccatccgctgacgtggcatccacggtagcgcctacgggtcagtggggacccacatgtcagctctctagtagccatatttccaccgccctgggagctgagagagagagagagagcaggaaagagggacgccggcggtgctcgacgcgtcacgcgtggccgggacgtggcaacgctaagctcctcccttttcttcctcagacgtgtcgccttctcttctacattcttctggagccaaactactcggacgagagagagccctatgcctctccgtcgcccacattctcgtcgtcgatcgcgaagaagatgacgcttgctgttgccgacgagtcgtctccatcgtcaaatctttcccgttccaaacttcccacatcatgccgagcaaatctcattttgaccccatctcgttttatccactgcagcaacggaaatgcgaccttgcccacgagagctccggaactcgcaccaggcgccgccgccatgatgtcgtcgctgttccgaccgacatggtccatctcaagccaagccatcgcgccaaagtcatcgcctcaccatcatggccaaaagccctcaagaaattttaagaatcgtgcacagacgagggatatcgctgtcatcttctccaactccggtcgccgagtgccatcgccaatccctctctccccggtgagccacggactaattaatcgtgcatgcaactctttagggacctcactaaccacccatgcaccttctctaagcattccaccgctcaagcgagccgtcgccgtgaagccgacgttatccaccaccgcagggctgtcttttccattgccgctgttacccagacctcgccatgccgcaatcaagttccagtgagcacccagggacctgctagactcgcatgcatgcatctttttgcactaaatcgggctgggactctacatgcacaggcgtactgaagaccaccaccgctcgcgacaccactggcatcgattccggccacctccggcgacgagaccaccttcaacaggatcgcaaggaagtcctcagcatttcttcttgtggttgtgtcggccgaagaatcgccgttcgccaacggcatcgtcgtgaaggaacgccggccggcgaactctgcggctgctgctgctttctccctgtgcctatgacaggtgggctccgctccattagcacgtacaggatttgattagagtaagtttaaaacatgtaaggttctttctgtaaatattgttatcatatcatatatttatttttataaatatgactgacatgtgagtccccactgacacgtagacgctaccatggcatgccacgtcagcggatggagcaggtcggtgcccgtttagacctatatgacacctaagacaagtttagggataaaaaaatgcattttgagagtttagggacctagatgacacatccgcacaagtttagggaccgctgatgcacttcactctatatttaatgctctatacatgtgtccaaagatttgatgtgatgtttttgggaactaaaccaggcctaatattggtaaccatctttactagatttagctcttagaaaaaattttagagagttataagggcctttttagatcacctggcaaaattttttaccctgtcacatcgaatgtttgaacacatgtataaagtattaaatataaatgaaaaaataactaattacacagattgcgtgtaaattgcaagacgaatcttttaagcctaattgctccatgatctgacaatgtagtgctacaataaacatttgctaatgatagattaattaggcttaataaagtcttctcgcagtttacaggcggattctgtaatttattttgttattagtctacgtttaatacttcaaatgtgtgtccgtatattcgatgtgtgttgacgaaaaacacgaggcctaggagatctacttaactccagtgcaggtccaaactcgcctttgggtatgttagcgtgccaattgatttgattctacaatcaacaagaaataaagacaaagaaaccgcgattaaacctataaacgatagccgatcggctaagtgccgatggcatatcatttatctttgagccgatgtcatatatgtatcgatcggcagtcatgaataagtaagaaagaactaaatctactcgatcggctgtagatgttaacgatatataccccttatatcgatatatacttaaatcaagtgattgggatagatcggtcgccatgccgagacagtataaatcacttagatcgaaatatatgttaataacaggactatatatattcatatcatagccgatcagataggtctagcatatatcggctaatactccgaaaccactctatactaagatattaaagcaagtaaaatatatcaaacaaaagcctaatatacttaaattcaacaagatcttaacgtagagggcagatttaacatatcaatgaagcatatagagtaaatatagttaaatcagataagatcggctgaaaccctgatactaccctaatcggcaaccagaaggcaggctagagattgatattccaagcacgacttaatagatcaaactcaactgatgcagcattaagtatgaaaagaagaacaatatctagacaatcaagccggtagtagtttcatagagtggtagatatcttatatagtctaaatcaacatcgatatttaacctaattggctgccttctaccgacagatgttagccgattgtaggttaaatagcgatattgctaaagattatgtaagatatatgataactcgatgaattacataaacaagattagagtatcataaagatggaagcactaatcccgagaacacaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtgttaattgattacatggggtttggggtctatttatacccgaaaattacaaactatgtccatatcggacacaactcttatctctaacaaactctaatataccataagtctttacagcagacttttgcccaaacatatctctagggaaattatataaaatatcctaattaatagatacaattgccttctcaggactctatccatacgcggcaatcatcttgaagcatatcaacccaacccgatgttgtacaccaagtcgtattgtcggaatcggctgcaccacttaaccaagtctgactcgaacttagccgatccaatcatagccgatccggactccagccgattcttactctgtttccgcgataatccttatctttgattccgcttcgatctaatcttcctttccgatgctgatattaccaaatttggtcattaacacatgccccccaagtccggaacatttgataatgtttcggatttgccatatatcaactccgagcaagattcgcactctaccgtttcccgaccgttattccagtgctttaaatactaaccgttacccccgagaaatctcacaccgtcttcttccgttttcaccgctgaagcaaattttgccctctgtctctccggcgattccttcgacgcaaaaggcgatcccaaggcaatttcatctccggccagagtatgctgaggtgagttctcatcggctagatctccttttttttcgcatcggattgatttcccctttcctcatcttgttttcttcttctcggttcttttggattcgcagcatctttccaatcagatcgcaattccaagcctatctcacgagaatcattattttctcggtccaattggcaaccttgatcccaccgagttcattattggtgaaacaaataggatttctttcagattagtcaacccagatctaggtcactggaagaacacctttaaatcttggccatcacttgagaaaaccccacccgagaagagctggattacatggtacaagcgcgtatcggctagtaagaaagttcactaggacgagatcggaatcggccaaacgcttgccctcaccatagccaattcggctaaggatgaacctctgatggccgccgccacctatttctggtccaacaccatcaatgcctttctgttcaaccaaaggccgatgactccaactttaatcgacatcaccatgatcaccggattagatgtgacctcatcggctaaccctatgagtatgaacaccaagaaccaatttgactttaggaccaaaagcatagggggttggtctggatatgtagcagcatatatgggtaaagtgtctgtcactcctcgagaacatgtagctttcttgctaatgtggctagaaaagttcctcttctgtggatccagctgtggtcccacaactaattggcaatttgtagccgaagccctagaatcgaagaaacagtttcctttaggcaaaatcctcctcggctatctataccaaatgctgaataatacatcggccaagatagctgtcggctcagtagttggagcaggtggaccgtggtggctgctgcagacttggctaaatctgatggtcatgaaagttgtcaatcggccatctatgacagaagctgaatttccaaggttggagccgattgtggacgacgatggagaagaacgcactcattgtagatgcatgtcatatggagaatatgcatctacgccagccaatgctggggcaaaactatcggctgaactgctcaaggattggttctgcagcttttatgaaggcttccaaaaagacgcccgggtttggtttccttatgaagactcagaagaccttgagctcccatcggactttagatttgaagatatcaatcatgagagatatcaaaagtctagggaagttttctcagctgcaatcagcccatgcattcttcctgtcggcattcatcagggaagaaacattcaagtctcttatgaactttatcacccgatgagctcagctagacaacttggagtgggccaactcccaatcggcctattcttcgccgataaaatccaatgccgaggggaaatttcatcgaccttaatgatggattggctgctcaatctccaaggacctcctctgggtagtattgaaaatatcgagttggcgggttttaagagcaaaaactttgacagatggtggggcgagtggaaactgcatctattccaccaatcggcttctatgtatatgacagatctctttcccgatgttatacctcaggtaaactctgatctcattaattctgtttgaacaattattagccgattcataattcaactaacctgttcttctattttgcagacaacagaatcttcccctccacatcagagcaacagtggtaaagatatccaatatgccctaggtttaattccaaatggaggtggaccatctcctcctgtcatcggctacaatgcccccaagacctcaacccttcttcaagggctcatcagagaaccagccgatgcaggcaagaagagaagaaccaggtcatcagctgcagacacattagctctagccccaaagaagaaggctaaactcaagaagcctaaaccaactgatgatctacctgtcctggacccatctattgagcaagctctggacgaagaagacatcgaagacgatgttgatcaagctgcagccgaagtgagtgatacagaaaaaacaccatcggctttacccaagcagatccctccaactccttctgctccaactcatttttcaagggtaagcggctctctctgatcctttttgcaatcactttatttttcggtcgattaatcacagattttatagttgcagaagaagaaaactgttgtaaagaagaaatcgacagcaacaattctcaaaccagctccaccagtaagatattcttaatttttaccagttgatttcagccaattttgtctaacacttatctcttttacagcctcatcatcctccttctcctcctgtacaacaatcatcaagtgaccgaactccatcggctatgggaagtcaccatattaaggaagaaatacaaccaactgctcctgctatcctagtaaatttccttttgatgcaagaaattaaatcggctatatctactttgctctcaatattcctaaaattgtttctgcaggttttagccgatctcttctcttttgacattagagattatgttgatgaggcagaggaagatacttcgagcaaagccctagcccccttatccgatgatgtgaagaaaacgcttgaagatatttctcatcggctagaggcctcctctttagatagcttggtggtcgactgtggatcgattaggacacggttgcatgaagttcaagctctgcttcccgaagaattggccaacgtccttactccagctgcttatctcgaacaacatcaattcaagttagagaaagccaagcaaagactagccgaatgtcgggagcgcaaggagattgaagccataatccaagttaattgacagcttgtgcatgaagagaagtccaagcttgatcagctatctgagggcccgatcaaatctaacattgaccggctcgaggctcgcaagattgaactcttggcacaacttgaagaatgcaacgccgagctagacatagaacataaaaagctgaccgatctcccaaaatctgttgaagaacaaaaggctagattgagatcggccatcaagaatgtcgttgacatgaccaagtccctaaaggttatttttggaaccgatgctcaagacgctcaagccattgaagaagtagaacaaattaggcaaagagctattttggctatccagcgatatttgtctccgtgacatcctatgtaataggtcttagaaattttttgtaatcggctaaagataccctggtactttcttatcttgacaatcctttgtgccgacgcaatataactccatattttgctcaaaaatttgtaatttttcatatatgtgcccccctaatttttcaatgtcaaaagcattgataaaattataaaaacgactaagggcgatataacaatatcggccattgtacatcggcaaaccacaaccgattacaatagaaaagcaactaagggcgatataaccatatcggccattgtacatcggcaaaccacaaccgattacaatagaaaagcaactaagggcgatataaccatattggccattgtacatcggcaaaccataaccgattacaatagaaaagcaactaagggcgatataaccatatcagccattgtacatcggcaagccacaaccgattacaatacgaaaacaactaagggcgatataaccatatcggccatctcaaggcgatgtaatcatgcattaacccaaacacttggataatatttcttcaaatacttgccatttagtgctcttccataaactcctccatcaagtccttgcaacatgtaagcacccttagatacaactttgtggatttggaacggtcctttccaattcggcgatcacttgccgaatttgctatcccgagtcccaattagcaaaatcaacttccatacaagttcaccttccgaaaaatctttaagtactaccttcttgttgtaatgccgagcaactcgttctttatccttggtaacctttgcaagggctcttaatctagactgaaccaagtcttccctttcatcagccataaggttataatactcatcgattgttaaattatcttgtaactcagttctccttgagccgattctaacctcccatggcaaaacagcttcatgcccataaacaagcttataaggtgggacttggatcgatccatgacaagccatcctataagaccacaacgcttcggctaaccgagtatgccattgccgaggataataagaaatcttccttttaatcaatttgatcaagctcttgttagatgcctcggcttgcccattaacttgtgcataatatggcgaagaattcaacaatttgatacccatgttgtcagcaaactgaacaaactcatcggacacaaaaattgaaccttgatcggttgtaatggtttgagggataccaaatcggtagattaaatgttcttgaacaaactgtttcgcatccccagaatcaaccttcttcaagggaatcgcctctacccatttggtgaaataatcggtcgccaccaatataaacttatgtcctttactcgatggtggattaatcatgctgatcatatcaattccccaacctctaaatggccatggtttaatgataggattcattgccgacgccgggtgctcgctgaattgctccaaatttctggcaatcttgacaccctttgtaatatttgaaacaatcctccagcattgtcagccaaaaataccctgcacgccgaagtaaccatttcatcttatgagccgattgatgagtaccacaaatcccttcatgaacttcgccgattgcaacctaagcctgatcggcactcaaacacttaagcaacaccccatcaatcgtccgataatagagctcatcatccaataaagtatacttcaatgccttatatcttaatttctgagaagccgattgggatggattctgtaaatattgatgcacatcatacctccaatcatcggctgttattgctgcgacctcgaccttaacatctttgatcatcggcctataccccgatgccccttgggccaaatcattagcttcaatattttgctctcgagatacatgcttcaaagtaaccagccgaaattcctttattagttcttggcacttctcgttataaatcatcagtgtatcattcttgcactcatattctcctgccaattgactgattactagcaaagaatctcccataatttcaacagcatcggcttcaacctccttgagtaactgcaatcctttaagcactgcttcatactcagcttgattattggttgcatatgatttgatagtataagcaaactcaaaacttgcccccctaggggaaataataaccaagccgatgccacaaccatgagtgcacactgacccatcaaagaataaagtccacggtaagatctcaactgagccaattgaatcatcacgatgttctacaataaaatcggctatagcttgtcctttaatcgccttcggcgactcatacggaagatcaaactcagttaaggaaaaaatccactttccaaccattcctttcaaaattggggctgataacatgtatttgacaatatcggccttgcatatgacagtgcattcattggacaatagataatgccttaaccttgtacatgaaaaatataagcacaagcataacttctccacaggggaatacctagtttctgcatccaagagccgacgacttagataaaacacaactctcattttcccttcaaactcctaaatcaaaaccgagccgattgatttctcactggctgacaaatataaccgaaaaggtaccctcttctgtggaggaatcaaaactggaggagagctaagatattccttaatatcgtccaacgctttatgttgctctgccctccaagtaaactgttgatcggctttcaatctcaacaatggtgtaaaaggctccaatcttccagataaattagaaataaatcttctaacaaattttatcttgccgatcatctcttgcagttctgtcttgttctccggaggctgaatcttcttgattgcattaacactcctttgagttacctcgattcccctctcgtgaacaagaaatcccaaaaactggccagtcgatacaccgaaagcacactttgtcgggttcatcttcaagccatatttcctggttctctcaaaaaccttcctcaaatcggctatatgatcctctatctctttagatttaacaaccacatcatcaatatagacttcaaccaaccaaccgatcagatcatggtatatataattcatggctctttgatatgtagctccagcactcttcaagccgaaagtcatcacaacccactcaaacaagccgattgcaccaggacacctaaaagctgttttatggatgtcttcttcagccataaagatctgattgtatcccgcattatcatccataaaactcaaaatcttgtgtcccgaggcagcatcaactagctgatcggctactggcattggatattcgtctttcggggtagccttattcaagtttcggaaatcaatacataccctgaccttgccgtttgcttgataacaggaactatactagaaacccactcagcatatcggcaaggacgaataaaaccagcatcatctaatcgcttaatctcagcctttacgggttcaagcatatcggctttgcatcttctcggaggttgttgatgtggtcttacccctggtttgataggtagctgatgttcaacaatcgattgactgagtccaggcatctcataatactcccaagcgaagcaatctctgaattctttcaatagctctatcaacttggttctaaactccgaagataaattcttactaataaatgtcggccgtggtcgatcacctggacctatgtcaatttcttccaaatcatcagccgacataaaaccctgtccttgcttgtcatcgagatcatctactgtgtccttggtgtagacattcgaaccctccatgacgccctcaaaataatagcttgggttctccatcttcaattggctgtatatcagaatcggacacttttagaaaatctccatcccaaacttttcccgataaacaatcaagaccatccatctcccaaagagctaaatcggcactggcaacattgactgacctgtcggctggcacaatttcaatcttgtcgccttgccactgaattaagcactgatgcatagttgaaggaatacaacaattggtatgaatccaatcccttccgagcaacaagctgtaagaacccttcccatcgatgacaaataacgttgtagggatggttttgttgccgactgtcagctccacattcaaaactcctttggtttctgatggattgccgccaaagtctttaagcaccaagtttgtcttgatgagatcttcggcgtttctacccagctttctgaacgtagtgtaaggcatcaagtttactgcagccccaccatcgaccatcatcttggacatcggcttcccattaacataaccatttatatacaatggcttaagatgccgatgctctgtaccctctggcttctcgaaaactgtctgatctggtgacaaagttaatttagccgattcttcttcaacttcatcaacatcggcttgcttgaccccaaactcggcaggcaacgtgaaaaccatgttaaccgatgcagtcacaacactttttcccttagccaatcttcttgcttcatcggctgtggcttcatcggctacaggaacttgattcttaacacgccactcctgccttggctttgttttctttagtcaatgattgatttcctgctcgacttcctgaaagccctccctattccttaatctttgaacccttctcttctgattctttgtaaagataccagaaggacaccattgagttttcatgttttcattgtcctcctggccatgatcttggtttactggacccaatctttgatgaacaggaacccttgtctgccttagccgattgcccctactatacgatcggcttgagttttccgcaatgtcacagcacccaggacagtcctcaatagatggcagcttcatagcttcattccaacaaaatctaaagaactcgcaaccccaatgaggatcaaagccatcatcatcttcctcataatgcttctcctgctgtttgtcatacttcctctgatacttgttgataatcttagccgaatttacctgaaatcctcttgcacgaccttcatcggctgttcggccagctgtatgtaccatattgacaggaaaaggattgccatcaaccttcatcggcctcttagaattatcaaacttgattttgcctccttcaatagccgcttggatctgctacctgaagactttgcaatcattagtagtatgggacccagaattatgccacttgcaataccttttcttgcccaattctttagccgatggaatcgtgtgaccagcaggaagttgaatatgcttttctcggagtagcaagtcaaaaatcttgttaggcttggtgatatcaaaatcatacctctcatcttttctagaattcttcacccattggcatggtataacctttttgctccttacccattcggccgcagctatctcggaatcatcatcctcatcatccgatccatatatataaggacagacatgattaacctttctagaattcttcctagcctctgcaaacctctgttcatgcaaggttaccttctgtgtaagatgcgacaagctttcgaagtcttcagatgagaatttctccctgattggagcaatcataccctgaaaagccaaatcggctaactaggcatcagtcagatttaagctgtagcacttattcctcatttctctgaacctctgaatatattcatgcacaggctcatcatgtctctgcttgattgctgtcaaatcagacaatttcatctgatgtaccccactatagaaatagctgtgaaaatgcttctccaaatcggcccaacttttaatcgacccatatggcaaagaagaaaaccaagtgaaagccgatccagacaaagacaaccggaacaacctaaccctcaaggcatccacagccgatgcttcaccacactgagctaaaaatcggctaacatgttcataagttgatgtgctatcctgccctaagaattttgaaaaatctggaactttgaacagattaggtagaggaactctctcaaaccattcggggtaaggttgtcggtacaaatttgcagcatctttcggcctaagcccaaactgctccttcatgacatccgtaatcatatcggcccatggtcattgctgaggtgttccttgaggttgctgtggcatgggctcgaattgattgtattgaggaacaaactggggttgagtcgatcctgcctgctggtattgaacttgcggtgatagcggctgatactgataattcaaattgcccctggtaattctgaagattcggctgaatattgcgcaccaaatgttcgggaatagcttgaggtatcatcgtgccatctggttgcacgtgatgaaccaagtgctctaggacaactttatttgcagcatgctgcacaggctgaccaccaggtgtcgcaaacctagccgatgcattcattaagctttgctgctgaatcggctgaacaacctgttgccttaatggcgtctgctgaattggctgcaaaacctgccgtctctgaggcgtctgctggactggttgtacaccctgttggattgggggtgtttgttgggtcggctgcacaacctgctgccttggcggcgtttgttgaatcggctgctgctgggttggatcaccggtgtgttggggagataagaacatagacgccatctggtcttgcgttagccgattcacattttgtccgatgtgctgtggttgttctctcaccagcaaccggggattaactaattggcttggcgccgatgacggtgcagcaggtgtaggagccggtactggtgccatcggctgagccgatgtattggttaatattccagatttattgatcaaagcatggtgtacagcatagtcaacctgatcttggaagttgttgaactgcaactgtgctgtattgctgtcttgatcaacacctccaccttgaactccctgagtaccatcaccttgaactccctgtactccttgagagttgtcaccttgatttccttgagaaccatctgtagcacctttgtcactcggttcagccgagccatctggagcttgttttgcctctccatccttagaagaaccagtcccaggaacgtcagcaactacctttacatatacttctgcaccactgttcccttgcgtgtttgcataaatgaacttaagaactagttctgtgcttgctgcatcattgcttcaaaatccttcttttgatcaggtgtcagcttgtctggagtgatattcacgatgttgccttcattaacctcagataggcctagctgctagatcttctctttaacagaactggggctagccgaggacggtgatgctggtggcttctcctccgtagagaaaaactgttcttgcggttctgacttcttatcgggtcccaccgggcgtgccaaaagcgtgttgacgaaaaacacgaggcctgggagatctgcttaactccagtgcaggtccaaacttgcctttgggtatgttagcgtgccagttgatttgatcctgcaatcaacaagaaataaagacaaagaaattgcgattaaacctataaacgatagccgatcggctaagtgccgatgacataccatttatttttgagccgatgtcatatatgtatcgatcggcagtcatgaataagtaagaaagaactaaatctactcgatcggctgtagatgttaacgatatataccccttatatcgatatatacttaaatcaagtgattgggatagatcggtcgccatgccgagacagtataaatcacttagatcgaaatatatgttaataacaggactatatatattcatatcatggccgattagatagatctagcatatatcggctaatactctgataccactctatactaagatatggaagcactaatcccgagaacgcaagacgtcataacaagttttacctcttgttgaagatcgaaaccgatgcagctcaacccgaaagcaagaactcgtcgaaataaaactaaagcaaaaagggtggcgatgcgccgagattgtattgaacgtatgtgttaattgattacatggggttcggggtctatttatacccaaaaattacaaactatgtccatatcggacacgactcttatctctaacaaactctaagaaaccataagtctttacggccgacttttgcccaaacatatctctagggaaattacataaaatatcctaattaatagatacaattgccttctcaggactctatccatgcgcggcaatcatcttgaagcatatcaacccaacccgatgttgtacaccaagtcgtattgtcggaatcggctgcaccacttaaccaagtctgactcgaacttagccaatccggactatagctgattcttactctgtttccgcgataatcctcatctttgattccgcttcgatctaatcttcctttccgatgctgatattaccaagtttggttgttaacaatgtggcacgtcaaaacttgacatcgctgaatctaaacacggcctaaattatctttggcttcaagagtatagaaccaatacatcattctccctctctttcttcatctccttctctgcccaactagtttgaaagctgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtctttttcgcccccttcccctcttgggccggctcggcccacctccctccctctctctcctctcccccgcggcccaatcggcctcctccccgcgcgcgtgccgctgacgggtaggcccgcccgccaccctcgctgacgggtggggcccacctgtcatccctgtcctcgcgccgcacccgccgcctcgtccgtgccctagcgccgccgccgccgcggattccgccgcatcccgccgtccccgcgcgcaataaagagggggaaatcactccccgtgattccctctccctttccccccacttttccctctctctctccctcggatttgttcggaaacgtttccccctaaacctcgccggcgcatcaatggcggccggatcttccgcggccgattccccgtcatccggccgttctctccccctcccaacgctatataaacgctccccgtgcctccctcctccgtttccgccgctcgccgctctctctccccgtcggaatcgagctcgcgccgtcgtgctctctctccgccgtcgccgccgagcttcggtccgccgccgtcgtcgccccggacctcctcccgcttcggcatcgtctccttcggcttcgacgcgtcctcgccgacctcgtccaccccttcgtttcgcccgccgaccgccggaacgccgccgtcctcgtcgacccgagccgcgccgccgcctctctccgcttcggtcgccgtttccgtcgtcgccgtcgacccggggtgagccgtggaccgcccatttcgcttcccccttccctcccctctctcgggcgccgctccgtcgcgccggtggtcgccggcggcgaccatcggggcgcgggcgcgtcgcctcccgtcggctgtgccggcgaggccgccttcgggcgcaccccgcggctgccatgtggggcccggccgtcagccgcccgcgccctcgagtgcggctgacgcgtgggacccacggcgtcggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttttgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttacaaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcctggtatcactagtatgattttaggtagatgctacgctgtttaattaggtaacattaggtggttttacaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagcactatcgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgcgggtaaagatgtacacctctgatcagagtataacctattcgaatagctgcgccctcggttatgggcaagccgagcaatgtacccaagttagtgttttaattcttaaaatttgctcaacaactaaaatgtggaatggttggcctgggttggcttgggacgagctgggacccagggtcaggttgccagttcggtctgaatcatcgtaggccttgggttaaggcaggttcgtgagggttcacggccttgattaataatattgtatagctctaggatcatgtttacaaaatagctttgggcaactaagtgacttttaaatgctgtttactgcaaaacttaacccctatattattatccccttgtacccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctatgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaaaagcgtgccacgaaaatcttaatcttcatccaactcttgttggagaaaagaacgagatcttaggtccattggataataatatagtaccaggttgcgttcttttcacttcctcgtttcctcggttttcgcgtacacacttttcgaactgctaattggtatgcttttgtttaaaaaattattagaaagttcctttaaaaatcatatcaatttattcttcagttatttatacgcttcttgaactgctatgtggtatgtttttgtggtatgtttttgtttaaaaaattataagaaagttgctttaaaaatcatatcaatttattcttcattttttttatactactaccatccaggatgtaacaacttttagctatatatatacataacaaagccaaaagctgttatatttggagacgaaggtagtagctaatcccttctttttataaagctaatatccactaaacatctaaaactcaacgtgcaagcatagtatttattagcactcctaaaacctacatgtaagcatgccacatcaactcattaagcactcaaagctcaacatgcaagcatatagtaattatatctagtacaatttatttcattctaaaaccaaacatatacatgctaaatcattattctcaaattattttaataatatttcaatccaaatcatttcatcatttcttcaatatctaacatatatctcgtaggaaagtgcggtgcatcatctaatagttactaatgagccacctcattttgcatgcgttggagccaaccttctccgttggaccaagtgagtaagatatttcaaagtaaatttttccggtgataaattatgtgccaaaagaatatagagctggagtatacaaaaggtgtgtttaagaggagagtaaagaaaaagatcgagaacataaaaaaaatgaggttaaccattattgcatgagcattattagtacgttagtttaaacttgaaaacagattaatatattttttttaaaaaaaaactcgtttaatagtttaaaaagcatgtagcgtttaaaaactcgtttaatagtttaaaaagcatgtagcatttaaaaactcatttaatagtttaaaaagcggaaaatgaggaactttctctgatttgttgtctaaacaaccacaaggttagtacacttttattagcttaatggggtccctctcacccaaacaccctctaaaactatttcttatcgtgagcacacttcccaaataactacggtgtgttgtgtaaaatagtttaaaattaattaaaagtatttaaaaaattaaaatatttaatacataattaatcatccactaatgaacatttgcatcagtgaagtaactgtgtggaatgcagccaaagtatagttgtggttgtgttaagtggtaaatttgctactaccctcatcactaaggtggtgtttcaatcttctaaatatgaaaataaagttaaagatacagataaagataaaaattaagatttcgtgtttcatgtaaaacgagatggtaataacgtgtgattaattgagttttagttattacaaacttgaaaaatggattaatctgatattttagaacaactttcatatataaagttttcatacgaaaacaccgtttaaccgtttgaaaagcgtgtcatgagtattatctaaaagtttatccaacttttgttggagaaaagaacatggcctaactccctattttcaaaacaaatactgagactgtgggactagagagctcaaatatcaaccacccttcttaccagctccatactttttgcgcaaaggaaaaaaaaaggtagaatcatatactctctccatcctataaaagctaagatgaaatgtgatgtttatagtataataatgaatctaaacaaatgcatgtccagatttattatggtaggaaatatcatatactatcataggttgatttttttataggatagaaggaatatgttagtaacaaatacgtgcatgaattaagagatggtactaatgggtcaatgataatttttttctaaaagtaaattttactttgtatcatcatatttcaatttagacctttttaaccaatgtttttaatcttgcttctggccgagtttagttctaaacttttttttcaatcttctaatttttctatcacatcaaaacttttctacatacataaacttttaactttttcgtcacattgtttcaattttaaccaaacttctaattttaacgtaaactaaatacacccgctgttgcagtttaaaaagtaaaaaagttggttaaaaatggttaccggctcaggatatgaacgttgtatttagtaagattagaaaacattggttaaaaatggtcatgatatcgactagtccttggagtcgcggattcccgacgaaaagggtcatttatctactccgtactactgtgctccctagtagcctactcgtacagtactagtacctgtgagtacctgtaccagcagactgtactagcaggctagcagcttactccctccgtccaaaaaaaaagataaactctggtttccgtgtacaacgtttgactgtccgtcttatttgaaaaaattataaaaaaaattaaaaaaacaagccacgcataaaatattaatcatgttttatcatctaacaacaatgaaaatacgaattataaaaaaatttcatataagacggacagttaaagttggacacgcaaattcagggtttgctttttttttaacggagggaatagctgagggccatttctctaccgagcactcttgacaagtttgggtgtaatcatcaactatgcttgactaccattaatgcaacgcgtccattcgacgattttacatctcctctagggcaagtcttaggcgatgtttaaatctagttacttagctttagtctttagtctttggattagtctatgtatttagacactaatctagagtattaaatatagactacttacaaaactaattatataaatgaaagctaattcatgagataaattttttaagcctaattaatctataattagagaatatttactttatcatcacataagctaatcatggattaattaagctcaatagattcgtctcgcgaattagtctaagattatagatgggttttattaatagcctacgtttaatatttataactagtgtccaaacatccgatgtgatagggacttaaatgttttagtcatatctaaaaaggtcttaagggcaagtaatataaggggcctgtttagatgaggcttaaactttttactcccccgttatatcggatgtttggacgctaatttggagtattaaatatagactaataaaaaactaatttcataaatgagagctaatccgtgagacgaattttttaagtctaattaattcataattatcgaaagtttactgtagcatcacattgttaaatcatggcgtaattagactcaaaagattcgtctcgcgaattagtctaaggttatggaatgggttttataattagtctatatttaatactccaaattagtgtccaaacatccgatgtgacggggacttggaataagtccctgtttcctaaatagcccctaacggcccatttggttggagggagtttttaggagggaatgggagtttacagggataaggctattaagtgttttatttgattaggagacatgggaattttggtggaatggggatgaggaattgaggaaggaactccctccttttcaatacctcaataggggcaggtaattgggagggaattcctcctttactttgtctaagcaaatctcagccattcgtttttattaatgatctaatctctaactaaactccctaataatttccatcacctctaccaaacaagatattgggattaaaaatcaaattcccatcttaatctcatcatcaattcccttgtgtaaacttccaatccccttacctcgagttaccaaacaagccgtaagggcttttacagtgtgtttatgtggcatttagtctcaagcttacacataggagattctcagtcatgtctgtgtttcccatgaccaaaccaagaacgtgtgaccaaactgaggccctgtttagttcgcgaaaaagaaaatttttgggtgtcacatcggatgtttgaccggatatcagaagggcttttcggacacgaatgaaaaaaaaaatttcataactcaccgtcattagcatatgtgggttactgtagcacttatggctaatcatgtactaattaggctcaaaagattcgtctcgcgattttccccctaactgtgcaattagttttttcatttatctatatttaatgcttcatgcatgtgtccaaagattcgatgtgatgtttttgggaaaaatttttggggaactaaacggggcctgagacacacgacgttcttcatcaactttttgtcagcgtcgttaggcactcaagcaagcccacattcgaggctaacgctgaccatggccatggatgatatagatgagtcggcgccgatgccgcttcggtggagaagcgccattgatctcgtcgtccatcgtccctcgctcccacgccgccgacctcgccgtccccgctctcacgccaccggcctcaccgcggggaatcgggggacgagaggaggggtggatcaggccgcttttcaactgctcccactctgccgacctcatcgtcccccaccgccactccgcccggcaccgacgccgacgccgcttgggccaccccaccactgctccgctacgagttcgtcgccgctcagtgagtcgaggtggggttggtggaggaaggagagagggggagggagccgcctccgccggttggggatgagataggtgtggggagggagaggaggaggcgagagagtcgccgccttgtgtcgccggagacgagctcgcaaacctgcaccatcgttggggtgggggagggagaggagggaacatgggggagtcgagttgccgccgtgcgcgtgggagccgagggagaggaagagagaggggggaaggagaagaaaaggtggtggggccagcctgaaaagaaaaggtggtgagcccacctaaagctacaagtacgctgtggaaaggggagcttcaactgcttttcttccaatgtggacatttgggctcctctataaggcgggacgcattgctactgtcctaattctccatatgctgcccctaagagtaccacattggattgagtgatgaggtggaggagagaagtaaggagagagatgatgatccactcctccacacaaactttaaaaaagatgtgagagtattagatgtattggtatttgtgtactagaggtgacatattgtaagggttgcctcttagtttataagtgaatgatatgaataagggcaagttttatagtagggctattgtcatatctaattttatctatgtaagataagaggtgatacatacaatacaccatatctacactacctctaacatagtaacccaaatgatattttatattatttgtttgtccaatcccctctttctttcatcccctttttcttggggtttgtgtggaggttaccccttgcattaggggtggctcatcttctctttcctcacttgtttcttccacctcatcatccaatcctatgtggtattttaggggcagtagattttccctattacacttgcacttagagcatcctcaatgtatttggcatactagtctatagaagtgggacccaagctcgaagtctatagttttagaaaccaccacaatgtgagttattaaggtgggtcccacagtggtaaaaaaatcatattgagttacaggagttaatggaaaatatgtgtttcaaatggatgtttgttgctttcaaaccatgtgtagatgacttttcaatggttgtagatgcataggtgtagaagcatctagtttaattggtaaatacactcgtcaactggtctcagacacatctattgatggacacaactggcaagaggcagacacaatgcataatgctctcccttttcatagcatgcaaccatttcctcaacacatcggttaaggaaatcctcttgtatccataaggagcaagaggggtgatgcaaatgtaacacagctcaactcaactcaaccaaaaccaagatgaataaggtatctcttgtggtataggatgtgagcaccgccgcgagtttacggcaagcaaatcttaacttcggaatagaagttgggtgttgggagccatgaaggctagagccactcaaagctggtgtatggttcgagcttacacagtcgtgctatttgccaccttgggttagggatgtagaggaaagtggatgcgtcgggctgggtctgtcccctccttcaaccgaaggccgttgaggggggggggaggggtagaattctagtatacacaaaaatatgaagatgcacttaaacccccaagtgggttttggtgattaatgacaaggtggttaaaggggactaacgtgtttatcaagtttattcacaggagtttagtcccaaagcgagttgtgatggctaagaatgcaaggagaccccccaattcaaatgttcctaagtgcaaaaatcatcgaaggtgattagactaggtttttcctttcgaaattgagtttaggaaaagccgtactattaagaggggtttcaagtgtggttctagggtatacaaagtgctcttagtcttatccatgagtcaaaagatttttggaatcatttttgaaaaatgattttctccccgggacagagagggctacccggaggttatggccagaacttccgggcaccgtttatttgcaaaaatttcctaagtgctgcccagaagttcctggcacttttgcccggaacctcctggcaggtttccagttcaaacttgtgagtaacggctagatgacgtcacctagccgttatatatatggatttcatccccaggtcactttttggccattccacttctgttcattcatgttctagggttttctagccactcccaagcttcctttgcttcctccactcaaatctagagcctatcttgtgagattgtgagattagatgagagtgtatgagtgttttggagatggcttaaagattaggtttgattgagcactttggatatcttgtgggctgtcacttaggcttattactcttggagatcttctcctagacgattaggtgtcgcctgtgagcttccaaagatcttgtagatgtcttggaaaagtttgtgaaggttttcctcacctccgcaaggaaacgaggtaagtgagtaaagattcttgtgctgagtttttagaggttgtcctaggtagagcaacttgcacttgtggtcttttctagaagaaattttgagttggatcttggtggtcactcaattctagaaaatgacctagaagtgttgagttgaaggctgtggacctcttctgggatctttgcataagtgaggcaaggggttaatcgagacccggctctttggagcacctcaacggagagtaggattcgtctgatccgaacttcgggaaaaaatcgtctttgtctctcttgtgcatgatctttgtgtgaatctgctgatattctgcgatcttcatcttattcctctgtgtgcctaaacttctcttgctaggacctatttttcatctcagttttaatttatctcagctgcccggaagttcctggctcaagaactccggaagttcctggctactcatcatgcccggaagttctggtgttcatcaccaggaggttccgggccctgttaatttaaccgctgcaattgttgagaaaatttcaggaaagccaattcacccccctctaggctacatctctgcacgttcaattggtatcggagcgaggtactcttgattcaagcttcaccgctttgagtgatccacgatgtcggacttagggggaaagaacggggaaaatggaaatgaagatgaagcaagcagcaagggaactccaccacccaagggagctactataccttttgattatagcaaacttaccattccttctcacaacttcgtctccgtgccttccgggcgtgctcctcaatttgatgggacatattatgccgcttggaagcacaagatgaagttgcatctaatctctttgcatccaaatatttggaaagttgtttgtacaggtattgatataccccatgatgacatggagctcacttcggagcaagaacaacttatccaccgcaatgctcaagcttctaatgcaattctcttcgccttgagtccggaggagttcaacaagattgatggactagtggaggccaaggagatatgggataccttgcaattggctcatgagggatcacccgccgttcgtgaggccaagattgaattattggaagaaaggcttggaagatttgtgatggatgacaaggagacaccacaagagatatatgataggatgatgattcttgtcaacaagattaaaggacttgggagtgaggacatgacaaatcactttgtggtcaagaaacttctccgtgcatttggtccaagaaatcccactcttgtatcaatgatacgggaaaggaaagacttcaagagactcaccccaagtgacattcttggaagaattgtgtctcatgagatgcaagaagaggaagctcgtgaagtgagacaaatggtgaagaatgccgccatgattaaaaatcaagaagttgctttgaaggcaaaacaagaagaaatggcttttattgtcaagatattcaagcactttcttcgcaagagtggctatggcaaagggaggaaggatgatgacaagggaaagaggcaatcaaggagagcgtgcttcaattgtggcgaatatggccacttcattgccgattgtcccaagtcaaatgaagctaaggctaagggaggcaagaagaagccggagcatgctcatgtggcggaggcacacatggcggaagtgtggtactctggagatgaagaagatcccgaggtcaagcccaagcccaggtcaaaagacaaggttgaaggagaaggtggtgttgctaccgttgccttcaagtcatcctcttcaagcaaggagcgtctcttcaacaacttgagtgatgacgacgacgactcctaccactactcttgcttcatggcccaaggctgtaaggtgatgacacaaaagccctctcaaacttctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgcttattcttgagaagaaaagaaaccttaccttagaggagagcttagctaaaaaatgtgctaaaaatgaacaacttgctaatgagcttaatttggctaatggttcttcagctagccttagggatgtcaatgaaactcttcaagaaaaatttgctaatttagacaaaagtcataaagatcttgaagttcgatttgacactcgttggaatagcacctctcaaccaaatgtggtttctaattcttctaacccttctactagcaatggttgtgctaggtgtttcaatattgatttgaactcttatgctactaatattgatgctatgcaagctcttaagaaagagaatgaaaggttgggcacattggtgaaatatggatgtatgaagacataccattcaaaagatgccctttacaaaaccatcaccgctcatcctaacaaggatggacacgggctcgggttttcgggtggaagtcctgtgtctaagcgtgtgatggtaaatgggaaagaatgcttgatgtttgtgagagaaggtaaagcaccacaagcaagtgaggtgactagtcttgtgagctgccagggacccggaacatccggacaaaccgggagaaacttccgggtgggagtctctgtctctcaaaaattcccaccaggaagttccggccagtttgccaagaagttccgggccaatggccgtgcacaagacatgaccggaagttccgggcacaatgccaggaggttccggccagagggtctttactatgattcatatgtaatttccaaaaaattcaaagggcaaagtggttgcctattttaatgggaattacaatgatgagtaccgcacttgtgtgtaggtgccaaaggctttggtaactaacatcaagggacccaaacttagacaagtttgggttcctaaatcccaagcttgattttcttgtgtaggcatactcctccggtggttcaagttgggttgtggacagtggttgcaccaatcatatgactggagagatgagtatatttaccagtcttgatgaggaaaacggaactcgtgagaatattgtgtttggagatgatggtaaaggaaagataattggtctaggtaaaattgccatctccaataatcaatctctctctaatgttcttcttgtcaattcattaagctacaatttatttatccgtttctcaattgtgtaagttgggttacaattgcttgtttaccgatgaggatgtgaccgtctttagaagggatgactcctccgttgcattgaaaggcaagttgaagggtgatctctatcttgtcgatttcgatgtggatagagtgaatccggaagcttgtttaattgctaaatcctccatgggttgactatggcatcgtagactagcccatattggaatgcagaatttggcaactcttctaaagggggaacacatcctcgggctcactagtgtcacatttgagaaaggtcgtgtgtgtagtgcttgccaagccgggaaataagttgggaatccgcatcctatcatgaacatcatgactacaacacgccctcttgagcttctacatatggatttattcgggcccgtagccttcataagtattggaggtaacaagtatggttttgtcattgttgataatttttcccgcttcacttgggtgtattttctccatgacaagagtgaggctcaagatgtcttcaagcgcttcgccaagcaagcccaaaacctctatgatctcaccatcaagagggtacgaagtgacaatggaggagaattcaagaacacgcaagtggaggaattccttgatgaagagggaatcaagcatgagttctccgccccctatgatcctcctcaaaatggcattgttgagaagaagaaccgaactcttattgaagccgcaagagaaatgcttgatgagtacaagacttcggatagcttttggacggaggccgtgagcaccacatgccatgccatcaatcgcctctacctccataagattctaaagaaaacttcatatgagctcttgagtggtaagaaacctaatgtttcatattttcatgtctttgcgagcaaatgctttattttgagtaagaggcctcgctcatctaagttctcacctaaggtggatgagggattcttacttggctatgagtcaaatgcacatgcctaccgtgtcttcaacaaaacctccggtattgttgaagttacaagggatgtgacatttgacgaatctaatggctcccaaggagagcaagttgttgtacatgttatagatgatgcggatcctagagaagcaattggttctaaggctattggagacatacgaccagtcgagacgcaggatgaccaagaagatagggatcaaccttcgtcatcgacatccaatagccctacaacaagtcaagagtcagttgacccggaagttccgggaccagatgatcggaacctccagacctccccaggccaggaagttccgggtccatctgccaggaagtttcgggcagaggacagtcaaggcttgcctacgacacaagtggatgggattgatgccgtgggcactgtagagcatcctgatcaggctcaggtctcctcagtgcaccatccaagaatacatcacactgtccaaagagatcatcccgtcgacaacatacttggtgacataagaaagggggtaactactcgttctcgtgtcgctaacttttgtcaacactattcgttcgtttcttctttggaaccaaccagggttgaagatgcacttggtgatccggattgggtgatggctatgcaagaggagttgaataacttcactcgcaaccaagtatggacattggtggagagacccgaccaaaatgtcatcggcaccaagtggatcttcccaacaagcaagatgaacatggagtggttgtaaggaacaaagcccggttaattgtgcaagggttcacccaagtcgagggtctcgattttggtgaaaccttagcagcggttgcttgtcttgagtcaatccgaatgcttttagcctatgccgctcaccatgatttcaggttatatcaaatggatgtcaagagcgcctttcttaatggacccatctcggagttggtctatgtggagcaaccaccggggttcgaggatccaaagttgccaaaccatgtgtacaagctccacaaagcgctctacgggctcaaacaagcccctagagtttggtatgaatgtctccgagattttcttttgaaaaatggttttgaaattgggaatacgtacactactctcttcaccaaaaagtttgaaaatgatttattcatttgccaaatttatgtcgatgacataatatttggttctactaatgcctctttttgtgaagaatttagtagcatcatggctaaaaggttcgagatgtctataatgggtgagctaaccttcttcctcgggctacaagtcaagcaagcacaagaaggtactttcatctctcaaaccaagtacgtgaaggacattctcaagaagtttgaaatggaagatgccaaacccatcaagactcccatgcctaccaatggtcaccttgatcttgatgaaaatggtaaatgtgtggaccaaaaggtatatcgctccatgataggatccttgctttacttatgtgcatctcgtcccgatatcttgcttagtgtttgcatgtgtgctcgctttcaagcggagcctaaagagtgccatttgattgccgtcaagagaattctaagatatttagttcatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcgttatccaccaccgaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacactctcgaaccaaacacatagatattcgccaccactttttgagagatcatgaaaccaaaggagacatattccttacccatgtaagaaccgagagccaattagccgacattttcaccaagcctttagatgagaaaagattttgcgagcttaggagtgagctcaatatcttagattctcgcaacattaagtgatgggtagttggctaatttatagccaaacatgtatcactaaaatgtaaattaaaaaaatgagcttttgtgtcttgagatcacttcttggttgaagatggtcttgctaccaggaataaaactcaaacattcccccctttatccaaaaaccccatttgtaaaaatttg

SEQ ID NO: 71520 - DNA, 982 bp, Oryza sativa
attcctgcagcccgactggaggagtcgtcgacgaggacgaacggagacgacgataacgaacaccggcggggttcggatggaggggaggcgaggccgagggcaaccttgatgctgcgatgccagaggaggagatggcgacgtcggccggcgcacgggcacggcggaaggggttgcgaaggaattccggcgaggcggagggcgagaccggcgcgggcgatggcgttccggcgaaaccgagggcaggccggggtggaggtcgacgcggcgacgccgagggaggagacggcgcggccggcccgcacctgagcggcgcggcaggggcggctggaggcagtgggtggcggcaatgccaccggttgccggcggggacgcgcctccggtggtttccccgcgaaacggagggctaaccgggggagaggaggctgctacgaggccgagggtggcgacggcgcagccggacggcgcacaggcgaggcgggaggtgcggctggaggtcggccggtgccggagagagagaaggagaaggcggggagaggcggggcggccacgggagagcgcgggagggggctaaaactggagaacggaaggagggggttcctttttataggcgcggggagggagccggcaacgagagaggccggaacggaggcgggaatggcggccggtggccttggaaagcggcgggggttggcgcgtccgttcccggcaatcggggacacgattcaagggggaaaacgggggaaatcaaagaggaatcaatggggattaattccccctatttaatttggaaagagccggcttgaatggggtggatttggaggaggaacaacgctagggttcacgggagagagaggaaggaggccggcggctagaggtcggggatgcgcctgacaggcgggacccacgcgggaggcgcgcggtcaacgcgcggcaacggcgcgcacgcgcgcgcacgtgcgcggcacgggtgggaggcacggct

SEQ ID NO: 71521 - DNA, 2117 bp, Oryza sativa
catcggtgtatttgagaacatccgctttctgcaataggaaaaaacaagcaaaaactgagtaagcatcaatgcaggatatgaaggatgtacccaacacaatatacttcttaccttgttgtattttgcaaagtgatagtcaccagtgggtggagcaccatttacaactctaacctgaaagatcaaaagggtgactttctgagtttttttttctaagatatgtatgccatactacaaattcatgagaaacagacccaatggtaaagttgaaggttgtcagtccgtgcagaggacgtgaaaggtagccactgccatgctatctgcagaagtacttcaaatggtcagatttagtacaagctccatcaaaatgggagcacgaaacaccttgctgcaattacccatatgactcaatggacatgaatatgtgaggtggattcaatctgcttatttgggttgaccaccaatttcaaaacagaagttgcacatgatcaaatcatcatttcatttgtcccatattaatcccatgagcaccttacccttaatgcctaattcctaataggtattaagtatacgagtagctaaactctcagctcagttcatgtgcttctactagagttatcaaattttcagcacatatcagctcaccttctccttctcaacagctggtcgccgcttcaggtgcgaagcctcgatggtcggcatgagtggagccatccccacccctccagtgagcgcgtacacctggatcatcaacaaccatcagcacttcagcagcaacgagaaacgcggggtcgaagtgtgcgggaggatggcggattaggccgcgccgtacctcgcgcgagacgccatcgggcttccgctgcggctccttgggcgcgcggggcttcttctcctggacggacgggaaggcggtcttggggaggccgaggatgtccttcgcgtccattgccgccggacggaggaggcggacctagggttagggttttggtctagtgcgccatgggagagagatcgaggtaggccgaagccgccgcctgcgtctgcgttgcgtcgagctgagctctacctcaacttggcctcgcgagagagatggattggagaagggaaagcctgagattgtatgggcctagtcatattgggccggcccaacttcttatggcctttgctagaccgagtccgagtccgacttcttggcacggtagctttttttatttcctctttcccgtgtctcacggcgaaccagcgaggccgaggcgcggagctgagcggaggaggagacgcgccacccctcacggcgctccggcgaatcggcggtgaacaccggcggtaatgcccccctccccttctccctcttgtagactgcgtcttccggccgcttggggtgggtaggattctgcttgtttgctctcgatcgttgggcgtggaagctggggtttgaatcggcggcgaacaccggcggtaattccccctccccttctctctctggtagacgcaccttctctctctggtaggctgcgtcttccggccgcttggggatgagattctgtttgcttctagcatcgtctcgatcgttgcctcgttgggaaactgcccttcgggtgaagggcatttaggtaattcacattagtactaaactttcaatggaaatataaggatgagtttttttttataagatagagggaatatgccatatctcataataacttattttgggagacagagggaacttgcatattaccctctcaaatatagtagtaattatttttgggacggagacgataaaaatatattctttgtgcgtcgagaatctcccccatcctctctgcgtaaaaaaaaaaattcttcccgtattgtctcgcctgtgccgatcgagcaggaaaatttgataatttaacacttttttcattgtccaattgttttagttgacacttgtgagaatgacatgtgggatcatctgagtgaatgaaagtgggacaggatttcaaataatcaaaacccattttaaggagtgttaaattatcaaatctctcatcgagcatagtgcaggggagaagccagggaagagggaggtgacgtcgtcctggtgagcatccacagctgggtcctggtcttttctccaa

SEQ ID NO: 71522 - DNA, 2681 bp, Oryza sativa
tcatgagtacatgcttgttgggaaggttgcaacgatgtaatccattgcagtaggctgagtggagataaatgcacgcatatatcaggacagattgacataaacagtatcgatctataaggtgtaaactattttgcagggaagtaattagtaagtgtttgagatacagtataagtgaatggcctgactaatgggagaatagttacctggtttagagggatgttgtcatgtcttcttcagcgagcaaggtcgttgcggtagggttggcgagatgcggcggagaagacattgccggcgccgccgacgggagataggaggtcagcaacacatgcgatacgtggactgagacggaggcggggtttagaggcgactgctggttggggaagacgggaggaaatcgtggcctcgtgggcgagcgatccacgcggcgagactctcggagaggatgaggcgttagtcttgtgggtgagcgatccatgcggcgagactgttggcgcggcttgcgagaggaaaggggattagtgcgaggggagagaagtgtgggtgaggtgtggcagtgcagggagcgatccgaaggcgaaggtgcggttgccagtgcggaggaaggaagcggagtaaaaggggagacgactgatttgcttggaaggaaactaccgatgacccggtgcgcgatcgatctccccccgcgtgaccccgcgtgcgcctcgggtgtgcctgctgttgttggatgtgatacgctggatgatttccatccgttagatttaatgaatgaagtatgaaggaaatatttgatcaaacatctgtaacttgtccactataataacttctcgtagcttatatagcttagtttaccaaacatgggaaagtaatacataaaatattattataaacttactgtcataatcttataaattcaaactgatgattaaagttcattaaattgactgaaaaatcttattttaaatataaaatatttttctatagttggagttcttatttttcttttctataattttctatagttttgtgtttgctaggcatgcacacgcctaagataggaaggaagagagactttcttaatgagagtttgataagcgtcaggcccatgcgtgtatacaaggcccagccgaatgccaggccctcctatgagcgcaacgtagcgcttttttctcttttttttcttgatctctctcgatgcaagtatgctcgtctgttattttgcgtggaaaccgattttgtgaatagggacgtgccacgtggtttatctctccagcgattaatatgcatagaatttgttttaaaagattctgtactaaatatccaagtagataattaccattctggtgttctatttagtttttacggacgacagattagtctgaagatatacatttacatgactcgctcactcactcgagcagttacatttacatgaccatccgcggcagtagtaaggccctgtttgtttcaacttataattattatattctagattattaagccagattgctataagctggattataataaactgatatagaataagctgtgagttgtttgtttgtctgaattattggaggcatggattattgggtttgaaaggctaaagtctataatgcccttagatatttgttcggttcatggcataggtgggtaatttttcttaactatgtaggggtagtgagtctttagccacttgataatctgaaaaaaaaagctcctttagagcagcttattagattataataatctggcttatagattataataatctacttgtttgtttcagcttactcataataagctagattataataatcctaagctgaatcaaacaaggcctaagattctttatggcacaccggcacagcgctctgatgaatcttcactcttcaatgcagatgaatccatgttactactgcgtttgaggcctttttttctgactgttatggatggctgcattgcaaatatggattaacacgtgcgatattagcagtaaattaacatcagaatcgacaggagtattcctattcctatcgtgttaatctgccagattttagtactctactcggatgctttaatttcactacgtagcactatcagattttgtctgaacatcaactcctcatccattgccatggcggcatggcgccgatgctgctggcctgctgcccccaggctctgatgatccatggtccacctgaacaagaacaaaaccacacgatttttgaagtttcagatctggccatcattttttcagcccccgcatctgcatatgcagtcgcaaaagatttaagcctctgcatctgttcaaatgcaaacaaaccaaaggccttcatgaagtcaactagtaatcccctttctgcctattttcatcatataacttctctagttgccgattcatgaagtgaaggagttactgattgtgtcaatgggcttttctgaatttttgtgaataacttttttgcaagatgtgaatatgttgatctccacctaataattttgtgttcccttgtaaactaacaaagctaccgcgaaatcttataggagttttcataaaactagaataaaaatatttttgtacatgcacacccaatacttttcctaatacaattctgaagtcatgatatgtatccttattttctaaaataaaacaagttaagtgggcatataccattagcaag

SEQ ID NO: 71523 - DNA, 6217 bp, Oryza sativa
ctttcacagctatttacccagtagatatgtcagcgccaatgaagttgacgctgaagtctcctgacgtggcgattttgtgccaccttggacaatatcttaacaccaaaaaccttggcgctgagacgttatatctcagcgccaaacgccaaacccggtggcgctgaggtcgcggcttatttttggaatagtttttgacacggtctattcttataataagtttgttaaaagggtcaatttgtcaaatttttggtccaggacgtggtggtgtcaaaggataaatctcactggtgtcatccattaaagaacatcatagatacttgggttaaacaagaatccattggtgccaggtgacaccacacctaacacgaagaatattatttaaattatattgacaattgtcggtgaataggaacggggtacctatttatccagcaaaaggattattattaaataaacaacatgctcagaatgtctttgaaaataaaaataaaaccctagggtggcgtcgctaggggccctttccagagggcctcaggcccacgtaagatttcatatacagcgttcctcctggatgggggagaacgttgcgtatatggctcaaaactctaagtattgaagtagcttgcggcctggtttgggtcacaaataaaccgcaaacgtgccttaagaatatagcttagggtcagcctcgggcatggccatgttctgggcctcgggcttgccctaacccttgcagtttttatggtcctcggcaagaggggcatggcaacatgcaagtcctatatcttaagaagatgagctaagatctgcctcggatgcggtctaactctaggccctgggctcaccttagcccatacaggtcgcacgttgctcgaggaagaaaagcaacgaggcttgccaaacataaatgcgtgatcccatgtgtgctttgggcctggccttgcctcgggccctaggctcccccgagatcttgtatagctcacgtcccctgcttagaggggcgtgagaaggtacaagacgcacaatctcaaaatattcttccatcgacgacgtcttcaagaagctcatcaagaaataataaacattctttaagcgcggcagggcgcgacctcaaaaactctcaggaagtggggcatgctccccaccataaataaaacaggtttacagggggatccccggccagtctgaattgaaaggacgtggacaagacgttagcgttgagtcactttggatggtggcgcctgggacacgtgtcccgcatgactcgcgccacttgagttagccaaatgggcgttgtttcaggcaggtcgggcctcgtcgggcccaccatgcaccacatggtgagcgtattggtggaggcccaactgtctcgaatggagctcgggagcccggggctgtgaaccgtatagacttgaaaggttccttgatggttgcgttagaaatctggccggcagcgacaagacggctcataagacaagactaagagtagatttgtaataatgtgagcccctcctagactggaaggggattatatatggatgaagggttgctttctgttaggttagtacttccgctttgtagcctgaaaaaaaggcctctcttatactgagctgatctagagaagataacgaacatcaatacaggagtaaagtattacacctccgggtggcctgaatccgtataacctcatgcctccttctccttgcggggtggccgggcccacgaaaccaccgtgatcgcagatacctcgcaccgcacgcggactaaccccctggtcgaatctccactctcggggagggatctccactccccactgtctgagggaccgccccctcgacaacaataactgaaggatacttcgtacttggttttattattgagggaggaaaaatcggagcgtgccaatccatagttaagggaggtagtatatatataggcattttccttaggaatatgtgaattgacaatgtgcctatttttttttaagaaatcgtgcgttctacttatcgtagagagtcaaaatacatattgcacgagtgatatatttgtagcttcagagctacgacaaggctattgagaacagcatgatttgcggatggtcccgtcaaagaagtctaaattacatctagatccaacaaataagaaaataaggactccgaaagaaaataaaaaagcaatccagtccttgagctcgctgcttcttcttcttccagagttccagtgtgttcaactcgatgcatatggcaatggatacagtagcgaggctagctacaggagaagatgacaagccacaaacccgataggggcctcccaaagttggatgttaaagcaagcaaggcaagaaaaagaaaactcagctaaaccttagaacttaacttcgttgctgcagacaaaggccctattcatttctccaacaaatgttagataaatttttcgatactcgtggcatactttttaaacggctaaacggtgtgtttcgtgtgaaaactttatatatgaaacttgttctaaaatatcagattaatctatttttcaagttgtaataattaaaacttaattaatcacacgttattatcgtctcgttttgtatgaatcacttaatatttatctttatcttcatcttaagagatacaaacaccaccaaagaaacactagaggaatagcaggaacctcatcgaagaaagtttgattggccagtgcaacctcttcgaatcctactttcgcagcagatatgttgcttgcccttcaacaattgtaggtgtgagagcttaaccctacaaccgttggccagacaacgaagctagtgcaaacaccagctatttcgtcgatgagccatggttgccacgatgaggaagacagacacccgcatcttcaaactatgcaagagggagagggaaggaacaacaacaacaacaacggaacgagccgaactatgagataaacccaactgctcaccggccagactccccccaccccggccaccaacctgatagccaacggccaccagagacgtagatggaggggaaagggagtctcatgggaggaaaagctggtcgcgtttgggatcgcctctcaatctctcatgttagaataggtgtcgaatatactagtcctatatatgatcatagttggacttggagttgtaataggtggtaggggtggagataaagttggactctgtaacccggcaactctcttaaatagagagggggcaccacaatatagcgtagatacgcagggagatgatggcagcgtagccatggacttatagcggctaggagctatgttggttgaggagaagcgtccataatcagagccccggagatgtagccttcggctgaatttcgttaacaaatatagcatatctcgtatgatcaatgattgaatcgatcgagaaggttagtcgtcgttacgctatatcgactaacttttataacatctcatagccttaggatggatcgagagaggagcttagtttgtttttcttgtgtgacatatggtgacataggctgttacttcacagttatttttgttgggtggggacgtggggtggggttcatggagtggttgaacattagcaaacatcttccgaaaacgttcgagatcgaacatgtgattaaaaaaggtgattccggtcatactcaaatgccggccgccagttctaaagtaatgtcgtcgttctcatcagccattagcgcctagaataatccaaggtcaaccacccattcatttatcatgatgcatgcatgcttaatactgacactggatgcgtgtcaaattggagttccaatataatgggcactatgatttgctctaaatattggtcattacagactaataatccaaagactcgacacattttcaccatggctggatttccagtctacctgctcttcctcgctgccctgatcatccttcccatggccaacctcatccgttctgcacgccaccggcgtcttgccggcgcacggcggccgccgccggggccgtgggcgctcccggtgatcggccacctccaccacctcctcgccggaaagctcccgcaccaccacaagctgcgtgacctcgccgcgcgccacggcccgctcatgctgctccgcttcggcgagctccccgtcgtggtggcctcgtcggcggacgcggcgcgcgagatcgcgaaggcgcacgacctcgccttcgcgacgcgccccgtcacccggacggcgcggctgaccctgccggagggaggcgagggcgtcatcttcgcgccctacggcgacgggtggaggcagctccggaagatctgcaccctcgagctcctcagcgcccgccgcgtgctgtccttccgagccgtccgcgagcaggaggtccggtgcctcctcctcgccgtggcgtcgccgtcgccggaagggacgacggcgacggcgagtgtcgtcaacctgagcaggatgatatcgtcgtgcgtcgccgactcgtcggtgcgcgccatcatcggaagcggccggttcaaggacagggagacgttcctccggctgatggagcgagggatcaagctgttctcctgcccgagcttgccggacctcttcccgtcgtcgcggctggccatgctcgtcagccgagttcctggccgcatgaggcggcagaggaaggagatgatggagttcatggagaccatcatcgaggagcatcaggcggcgcgccaggcctccatggagctcgagaaagaggacctggtagacgtactcctaagagttcagagagatggtagccttcagttttccctcaccacggacaacatcaaagctgccattgctgtgagttacaatctaaaacttacatggatgcttttattttttttccgggttttctaattaacattcaatactccatccgttttatattacaagactttttagcattgcccacattcatatagatgttatatgtatagattcattaacatcaatctatataaatgtggacaatgctagaagtcttataatatgaaatggaggaagtagtaaataggaggagaaatattacatattttgataaatccgattcactagaagattcatgcgccacgcctcctctaattttactgactccagcaactccaacggtgaaaattggtggtggcctgacctgttagggttcgggtatgtggtcgaggtaggggagaggggagagtggagataggggcattccccaccttagatggatgctgggggaaggggggagggagggcagcgatagcgaggcggtggcggcatcaccaaagccgtggggtcgacaatgggcaatgagcagggtaggcgacagggcaaattaaggctgtgtttagttcacactgaagtttggaagtttggttgaaattgtaacgatgtgactgaaaaattgtatatgtataaaaggtttgatgtgatggaaagttggaagtttagaaaaaaaaactttagaattaaacagggcctaaaaaaatagctggatcataagatggtgagcgaccatagcttatccgcctgcgataaccactggagatagggagaaggcagagcagggcaagggagacgacaaagatgttaggtggttgtcggtgacatgggaccgggagtatcatgacttagagacttgaggcagacacgatcacccacgtggcaccgggagtatcatgacttagagacttgaggcagacacgatcacccacgtggcctaaccccctcggggggggggggggtcgggcccgagggtgatacggccgcccttctctttgtctccccgaggggtcggaccgctcccgtctcggccccgagggccgaggcgccccgaccccttgtgggttttgcgccgtgtatatggggtaggtgagcatagcggggctcacctaaccacatttattgcggtttggacgagcgcgtcacgccgcatgtaacgcagtgcagcgcgctcgtttatccggtctgtgaccagtcacagacatatcagatcgtgggttaggtggcgataggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctga

SEQ ID NO: 71524 - DNA, 1975 bp, Oryza sativa
ttaggctgaacatcttgagcaacttcttgagccgctaggcagacatgttcgaagcttctatggaaatcaggggggagggtcacttcctaaggatacatcagttgctgtatgtaccatagagaaggccaattctttggtaaacaagttgttggaggaaggccgtctttctgaacttggcataatagtaatagatgagcttcatatggtaagttaaaccaatttggtcctcaaaatttctccattttctttactttcaagatgttgcattggcttcttgcttatgtttacttttgtgagtcatgggcatgggtcccattcatggcggatactcaaacacagtatcttccgctgacataacctattcccatgacaaatttctaacgtgtattgggatttaacttttatttcacctaataggcatctgtacacttaagagatacatacatagtgacattaagtgcatggatgtaatcatatctaagtaattcagaaattacatagctatttgacatgatcttcaacattttcaagctaaccattgacaagacatatagataagagatttatactagttgatcttagtcttatagaattagtacttattgttctgaaaatcagtttatcttaatgacagtatttgttgttgttccatgtaaaatggttttgaaaaatgggaaattggtttggtaccaacaaaatattacccttttaggtttgtacactgatatttttggttcacttccattaccttatttgaaatttctgtgctctctttgcgagaggaacacttgtaaaatgcctgacttactactgtatgttcctattacctgttgccacttggccagctgatgctggcgagtgaagtgatatagattcatgagagagagatacagaggggaaaattgccatgataagagcaaattgggcaaatttgagagcgctgaagtaggtaaagcgatttaggtgggatggaaaattcaggtggtataaaactaaacaaatcaaaatttggtggtatgaaaaattaccttttcatttgaaaaacataattctgccatccaatatattgtaaatgcggtacttccagaggacatgccaatgtagtgtacatacaatataatacatgtgatttttggcctatactcaatatttgcaagtttgaaagttcttgatcacactgcgaaatgaatctcttcacattacaatatttgaagtactaacagtgtgcatgtgcattacaaccgaagttggtcttcattatattggaacatattggtgtacttttttttttttaaaagagaagatgagtttaccataacatattggtcaatgcttttgattagggaccagtctagcatttctcgttgctttccccattttttttgaaaaattcaatgccaaaaatataacaaaataaaagtgtttcgagaagcatttgttatgtcaagaatattgtgtctctgagtcccaagtcctgacctattcctgtttacctttcccctcatgcaatttgaagttcttttcttcttcctttggaagtcctttggatgttgaagaacatgcaatttttgagtgaatcgcacattgtgccacctattattaccaaagtttcactttgtaccaccacctgagcaatgcctttacttcagactaggttagatatcatttccattgcactttggaccacctcttcctcttcacccctctcagcctttcttctctccaaaactttggctcatcaacatcactacaaagagaagagaggaggaggatattgactgacaggatcaaattcagccactggcagtgccatgagttgaccaattgacagcgtgaggaggcggtctggtttgactagttcggccaacacaagcttgtccacggtacctctattagcagagccctgccactgtgcccctttgtcaatccctactgctatccgctgcactgttagacacagagttccagatggtgg

SEQ ID NO: 71525 - DNA, 5453 bp, Oryza sativa
cgctgcaaatcctgtaacgccccaatttccgtatacccttaaaaactatttaataaaattctatgttcaaaagtttggttatttgagtgtatctaggtttgagtaccaaagatctcaattaattcattcctttgtgaactcaaaatcttgaccaaaatattctatcctaaattaaatttctaagattcaaatttcgaggttcgagtcccctcctaaaccattcaaaaattcatacaagaactcatataaagtcgtagaatcattagagttccaaggtcctaagcaaagtccctcgaaatttcatttcctaaaattcctggaaattggaaaatattactattccggcacaactaacggaggaggaggaggaaggggaggatgaagagcggcagaagcaagatgaggtggtagagctgtacaacctccgccatggctggtgggttagcttggatcaaatcaaagcataaaggattttgtatctaagcaatggagtttaaatgcttgcattttgcttgctgtttttgctcaataggtggctgattgttgggccttgtttaggggagccgcagatttgatattcttctgctggtaaccaacttctgaaaatttagagacgctgggtttttcagcttttagatttttcattttctggattctacaactatggatttttagaaaaatttgggtaacaatatggaccgtttgaggagctgaagattccgggtgtgtttagatcctaaaatattttggctaaaaatatcacatcaaatgtttggacacatgcatggagcattaaatgtggacgaaaaaaaccaattgcacagtttgcatgtaaattgtgagataaatcttttgagcctaattacgccatgatttgacaatgtgatgctacagtaaacatttgctaatgatggattaattaggcttaataaatttgtctcacagtttacagacgaaatctataatttgttttgttattagtctatgtttaatacttcaaatgtgtgtccgtatactttaaaaaaatttggccaaagaactaaacacggcctctgtgagaagctatagctgctaaaagctcttccaaacaatcccttgttcttagtcagctctgcattctgcacccagctagttttttgaattagaaattattgccaaaaggaattatgaaaattaatggaatctttgtgtattctatccagtgtttcataaaaaaaacaatttgttgctagcgtttcgttggttatcagaaatttagaaacaatttaatgaaatttcgaatttaatttgttttaatttatccagattactcagcggtttcttgataggaaccggctaagataactgatggccacagtaaccaggtgatattttaactacttgatcattggatcgttattttgaggaatctaattatttactatgatagatggatgatactcattaattcggtatatggtgacttttatatccctcattgcactaacgagatggttgactaacctatatcggttcctgatttcctacaattaaacgaattgtaagaacaagtgatcaattaactaaggctatagctatagcctcgattattggtcagatctgcatcaacctaatgaattactttcaaagaaaactaatgtcatctctgtgtataataacagcctgatcactaagcatctaagccgccaaagtaaatagaaaaggcatgctgctaacattcgcatcccacgccatactcgcatcccgctaagctacgagctcatatatgatatatacaactagccaggcaactgcacgtacatgataaggattttctatacatggatgtcatgaaacccatcatttacgcgcgacttagatagttataggaaaaagtaacattaattgtgatgttataaatcgatacacaaacgtacaagattagattgatatacaactagagaaataacactactacacgaatgatttttcatggacgccgggcccttttgggcgggccatgagtggaaccgcacgggataatcgagcgaccggcatcgggcggacgcccacacgggaaaatcaattatcccgtgctggcatcttaatccaaccgcacgggataatcctcattatcccgtgcggtcaacttaagtggaccacatagaaaaatcgattttcgcgtgcgggctttttaagtggaccgcacaggaaaataaaatatcacttcctattttctctctcacccacttcaattttttttgacaccctctcttcctttttccctattatattcctctcctcccctcccctctctctcgtctctctctgcctctttcctctcctcccctcctctcctcaccgagtgcgcacgggacgggtgccaccgccgatggcgtgggaggcgacgcggagagcgatggagccgcggccgcgccccctcaacgacgatgacgactgaccttgacgatgatgacgatggtggcgagctcgcgccaacgatggcggcctcgggagacatatccatcgtcggtgggctcgggggaggcggatccattgccggtgggctcaggggtgcggcggaggctgccgacgacgatgacgacgacgaggcaacgcggcggccgttgccgccgacgacgacgaggaggcggtggccgggagcagcaccgccgctgcctccacttgaccactcttcccctcctcccaacgctcgcgcaaggcgtccgggagcggcgccgccctccccactcccggatccggtggcggcggctaccccacgccggatccagtggcggtgggagccggcgcggcagtggcggcagggtgccccgatctatggttaggatttcaattttttgaaattttatttttttttcagatttttatttttccgtgcgggtgacataagcacccgcacgagaaaatcacgattttcccagacagcccgctccaaacgggcgaatctaccgcacgcaaaaatcaaaacatccacacgcaaaaatatctattgtagtagtgtaaaaataatagaaactgatagtaaatagaacctgtataacgcagataaaatttattattttttcttcatgtgtagatcaaatttagacttcatatttatatagagtcttacatcgtcatagtttatcttatcaaattttatgaattttttatataactatttgaactacatgcatacacttaaatgttatggcacctgggtgtagaaaatacttgcccacgtagactagcatcatgtgcaaacacagtagcaacagttctttagctagcttgagaaaattcattgcaatggcaacctctggctacacaactgcctccctaggctcccatcggatggcctaataagaaaaaaaaccaaattttaaattttcaaacttaattttgagaatgactttgagatattttcaacgtagatttttttagcattggcttttaaatcacaaagaacacatatataaaagttttacctacaaattcaatttttattttctaataagccgttttggcttattagaaaaaaagcgaaacgatggcgcccctaaagtccctatggtggagctttagctcgtgcttgtcgcagggtgactgtgaggcagagagaagttggggaaagaaagagagtggtgctaacaggtggcactcatattttggtggtgtttgtatctcctgaagattaagataaagataaagtgtttcaggtaaaataaggtgataataacgtatgattaattgagttttaattattataaacttaaaaaaatagattaatctattattttagaacaactttcgcatagaaagttttcgcacgaaacacatcgtttaacagtttgaaaagcgtgccacgaatattcaaaactttatccactctttgtggtggaaacgagacctttattttattttactgacagatgggcagtgcagatgttttctataattcagcatgaaaccagcaggggcggatcgaaatagtgctaaactgaagttgctgtaaagttttcgtacgaaacacaccgtttaacagtaatatagacaaaataatgtagatgaacttgcataataattcaaatatccagtaattaaacatccagtgatcgcatagtgctaaactgaagttactatcctgaaaaaacacaaactatatactttatactagatacatatgagcaaaataaatagcaccacaagtatttttctttgcacaaacatgatattataaatgaatattaaaaagcttagaccaggtggccgtgcagtatccaaccggctatacagtaccaaagaacaacacttaacggctcagagccttagagccccaaaaatctctagaaataaaatacctaaaccaaagaaatcaatagaagttttaaacattatttaggtgacatgttatgtaaatgtaagtggaaaagaaattagtttgcaaactgaatgggaagttggagaaattcattgagacattgggatgtgcgtagttgattagacacaatacgtttggctgctcactgcccagcaggcaatagctagtcggctggatagtattagctaattttagctgaagcaatttaagcaaatgtgatgggttttcgtggctgcttccatggacgattaaatttgacaaattgaccctctcattaaacttattataagaatagactgtgtcaaaaactaattttaaaattgagtcgtgatctcagcgccatcgggattgacgctgaggtataacctctcagcgccaatgtttttggcgctaagatcactggtgcacaacccatctttaacaccggttcgcaacccctttagttccggttttacaaccaggacaccaaatccggaaataaagatggatatctttaattctgattaaaataatcgggactccatctttagtcccggttggtgttatcaaccgggactaaatttttagccagttctttttttttctgctcacatgatttgggcacaaatcatttataaaatcattcataaaatcatccttaaatcatttgagcaccacgaatcattcctccataaatcattcgagcaccacaaaacattcaaaaaatgcccaaagctgcattttctccatatcccattcacaaaattcccaaatacatcacaaatcattcacaagataacaaaaacatctacaaattctaaaccaaaattatccacaatttcatccacacatcgcacagatcggaaaattcatcacacatatcgggaaaggaatcgcatagatcgagaggagggcgccggccatcgccggccttgctggcctcgctggccgcccgtgggagcgggctcggcctcctcgccggccgcccacctgccgctccgccgcccgcccgtgggagcaagctcggccgcctcgctggccggccggccgccgctccgctgcccgcccgtgggaacgggcttgaagccctcgtcggcccgccgctcgcccgcta

SEQ ID NO: 71526 - DNA, 3210 bp, Oryza sativa
caaatttgtgattcattgcatggatctgagatgtataatcgatctgtgatgcatttggtttgtgtgtaatttgtttaagatttgtgatggtttgtaagatttaggatttgtatttgtgatgtgaatgatttggtatattacattgatttggggatttgggtatatgcatggcactcagatttggggatttggtttttgatttgtgtatatatatccaactcgatttgggagaaaataaaaagaaaacggaccaaccgggactacctctatcgtctctttagtctccaaccaggactaaacaccaaccgggactaaagatcgatctttactcccgttatttcacccgggactaaagatagcgatttttagtcctggatttacaaggggttataaaccaggagtaaagatgatttctccaccagtgcaggtttcagagcatcgccgagctcatcccagactaagccaaggccaccgacgatggcatctaccacagcaccattgacatctaacacccaccttaaatttctgttgatacactcttagataatttttgttgatagttttctagggggcaccttttagttttagaaagccaattttaaccaatcttttggagggatgaaaattttaagaccctaaattctagttaggattcccataactcttggttatacagtattaccaatgcaagaaagaatggtaacaaaggagtaaaaaacacattaattgaaggtcaaacaaccaaagtttcatacaaggacattcacacatggtccttaccaacttgaggggatataccttcatgaaaaggaaaggtggctttagcagtttcttgagttttgataataaaaacctttaacaattattgggttcttctaacactcttgcacagtatacacgatggtcatcatcagttcatgattcatcaccacatgcaattattgctcatcaccggactgaaaaacgaaaaagtctattttgaccctctcaactattttcggaatcttatgtgtatcgttcaaccacaacattgggtatatcagaccccaagtattaaaaccaatacaaaatgactcccttggttattttcagggtggttttgtctggcgtgacgcactaaccttggttagactggctggttttagggctagtacttgaggaaaaaagagagagtaaaaatataacgggatccacatgtcagtgaagtacccctcctttcttcctcttatttagctgccctcttcctccttggcaagcggcaagcggcaagttgaacttcaggtagagagaggaaaggctagggagagagagaaaacgcgcgcaggtgggggatgctttggggcttgagaaagccgtggctgctcgtcatcgtcgtggtggatgactgcggaaaagaagcagcaacaatagctcgcaatcttttgcccctactgccagctccccttctaggatctagagactgttgtgcctccatttaggctccgcccaaagcgctgataactaacgggcgtggtggggtgcagcatgacgacatgggagatcttcatgttggtggagtcgtcgatgacgacaaaactgtacagaggggacactgaggtgagcaagacaggctacgcatctgctatagaggatgctggcatgaccgatggacacctcatccgtcgccaccgcggaagagatgatagagggaagaaagaagatgagatgcgggatttacatgtgggtttcattgctttttttgctttcatgatacccacgtaggataaagactagttcaacgtgccacttaagcaccacgtgacatgatcgatgtccaaactgcttggggagacaaattaaactggtattaatagtggagagatgcaatttacctgtttacagttgagggatacaaaacagattcagcttatagttgatggaatcaaaatggacttctcctaagaaactatgagtcgaaaggcccatactaagccttgtaataaatgacgcaaaatgagcccataaatggcccaccaggggcccacctatttccaacgtgtgcaaacgaatccaagccccataaatggcctacacgacacaaggccgtaaactgcgaacgcgattactcgacaggataaagcagagcaacgggagccatggttctgcaccaaccgaactaaaagagccgttcgttgctccacttatgatttcgcagattagtgatgaactgatgatattctaatttttggtttaggcgtgctttagccacagaaattagaaggcatggataaatgctaccggagtatatactccatttatctcgaaatacatcttatatcaatatttgtggtgatagctaggttgtgtctaatccagtagtaaggtactacatccgttttgctgctgacttttgggcacacgtttgaccattagttttatttaaaaattttatgtaattacaatttattttgttgtgttgttttatcactaataatagtttaagtatgatttatatcttatgcatttacataatttttttaataagacgaatggtcaaacatgtgttcaaaagttaatagcgtcatcaattaaaaaatggagggagtactatattttgggatgaagggtatgttactttagaatgatgtctaattcgcatatctgaattctttctttttaagatattgatttcttaattgttatatgacattgtacattgaagctttattaataaggttttgcctcatggagtggtttattattcgttgagctgatgaaatagtaaacgtcttctccaaaacaaatgacaatactgaaacttacgtacttgatggccacgtcattcatgtcgaactcgaacttatagataatcatcagtcatcagatctgcgcaaatttactccaaggtcaatatcacatttgtagttcaataggcctaatgtcaacttgaagttaccaataggcgtgtcaactaaaaaaaaagatgggctctagaaacacaaatagattaaagtagaacacagaaggttctcaacatcactaaacgcaagggtaaaagcatcatcggtttcttttcttactcagaaactgataaaaaccagagttcagtggagggaaaattaattctgatttggagaaaattaactgcaaagatctgaggtccaaaaacaccctagttaatattcggagtaaaacctgaaaacattgggagtcagcatgggctgcaggaat

SEQ ID NO: 71527 - DNA, 2066 bp, Oryza sativa
attgttatataatgttgattgttggctggtcatatgcatcataagtctctgcaggtccatagttctctatttcccctcattgaattctcatcttctccttgtttttgggcctgactgccctttatctgtcaggccggaagttccgggcctccctgtccgtaacctccgggtgtcggggagtatatattctcagggggagttagaaaccctagtctctctcctcattcttctccctccccgacaccagccctagccgccgctacagtgccccgagtggtgattttctcttccctccaatcaaattcgattattctctgtggatttatctacattggtggctaggaggttctttctgtgatcgattcgcagtttcctctctcaatttagcacttttgatcttctcttttggttcgtcatgtttttgccccgatctctaaatctgtgaacctagggagaaaaccacttggatagtcttgtttctgctaccttgtagatcaccgatctataggatttgttcacatgcactggctatttttgaaacctctgttcctcttttttgccggccggaagttccggtgttcttgcacccggaaccttcgggtgctgtccagccagtctgccattcttgattctctcaaattttgcctaactactgcactccaatttgttgattcctgttgcagtaagcactctgcctcgtgagaaaagacagaaagcctctcaggatgtgtccggtgatgagagtccccctattcggtttcctcgtggtcgtttgggtaaagagaaagtgattgagggtggcagtggcagcggcactcgtacttctcctaggtttaccaggcaatccagcaatcgtccagttcagattcgggatgttgacagtggtcaaggaagtgatgctcctaatacaagaggtcgtgggagaggtggtggtcgcagttctggggctggaagggcatctcatgatttccctattggatctcgtgagaatcccgttcagctctacaagactcttggatttgacaccactcctatgcaccacattggaagacccaagtccaactaccttcatcagcttgccaagtgcagaagggaccgtttgattgatttagagactcagcctgaggagtcacaggatcctcgtttcaggactttcactcaattggattgatataattcagtgattacggctagagaaaatccaatggttaagatgaagtggattgattggacttacatgaggaagaagaacaatgaagtgttcaaccaagtgatgcaagtgtgccacaacaagaatcttggagatattcttgccttggagtatgattggaatgaggaggtcattgcacagttctatgcgacagcattctttggtactacaaggaagggaattgtcacgccctgaagtttcccctttcttctttctttaaaaattggttaaataaattgcccgaagaaattgtttaattaacctagagctaatcctcaattaataaatgcatttaataatcgaattcagcgtggtggaatttttcttgagttccccatgctccaatgcattaacaagatttttagtggaattttcagagccttggaaataattttaaccaattaaaaatcaccaaagtgcaattttaaatcccaggaaaaatcctttcttcttttttcttttttctttttcctcctttttcctcttcttgggccgtcggcccagtccaccccgccgcccgcgcccccttcccctcccttcgggacgccgacaggtgggccccacctgtcgggttgtccccaacctccagctgtgcgcccacgccggcaaccgccgctgccgccccacctcctccgctcctcccgtgcccacgccgcgccgttccccgtcctccccacgacgccgcccacgccccgtcactgccgccccgcgcgcgcgcttgagagggcgggattcgatttcggatcccaccccactctctctctctctccaccccacgtcgctggcgaaatcggagactttcccggccaagtccgcctccctctctacctataaattgctcccccgagcatcctct

SEQ ID NO: 71528 - DNA, 1376 bp, Oryza sativa
tcggcaacgaagccgaccggagagggcccgcaatagagttggggcgccggcggagggcgcaccggccggccacgcggatggagccggaggtgggcgttaacggcggcgccgtggatggcggacggcagtgctggagctccaggtggcaatccgacgaccacgtcgctggcggccgcgtcctccaccgtcgctccccatgccgggctcgtcgccgcggccacgtcctccgccgtccgtgcctcacaccacgctgaagctcgtcgcctgagtccgcaatgccgggggcttgtcgggggtggccgcatcggagctcgtcgccggcgaccgcgacctccgtcatccacacccatgcaacaccggagctcgtcgttgacttagttgcagcagcacacgtgagagagatgttgtagaaagaatagctaggtagaagaagagtggattggttggtgtctatcctatcccgtcgagacggtataccagtgtttagcatttcccttaaaatattgctaagaacacatcaactaagccctcctctgtcctaggtgtgatcatttcttggctacgcctatgtggaaaatgatgtatgtttctgtgtacggctgtcaaaaaaagctcgagctccagacgagccgagcccgagcctctccctaagctcgcgagctttgtcaagccgaggtcaagcttccaacgagcctagtaatatatgatttttgttgttatttaataaattaggatatcaaatatgttatttgtatgccttatattgacatcatatatttattttattattttttgccttttctattaatatgatgaactagaaattaattatttttttaagataatctttcaaatatatactgtattacgtaaaaaaaatcaagctcggtagtcgagctcgagcttggtcaagctcgagccgagcctgtcagaaagcttgaacattttataggctcggctcgagcttgtatcgagctcgagcctaggcagacgagctcgctcgagctcggctcgttgacagccctatttctaggcatgataccatttttttcatttccgttgtttaacctgtttgtcaaaaatgtaatccattttactataaagttataaccctctaattctaaagctcaacatgcaaacattccacatcatcatctactagcaataattacatataaaacttatgcaagcatgcaacttcatctataattcattgaattctacaaatcaatatctaatcatcttccttcacattatttttgacaatatttttaacatttttactctatgtgtgtgtgtatatatatatatatggacacgctaaactgcacccagggtgcgttataactaaaacgctcccctcacaacacccctcc

SEQ ID NO: 71529 - DNA, 12621 bp, Oryza sativa
  unsure (1)..(12621): unsure at all n locations
attcctgcagcccccagcagacaggctgcagctccttcagtttaagccatggcggcgtttctggtctacgtgctcgtccttgtccctctagccgtcgtgcctttcgtctacttcaaccgcgtcgcgcgccggcgcggcggcgacgtccggctgcctccgtcgccgtgggggttgccggtgatcggccacctccaccacctggtgggcgcgctcccgcacgtcgccatgcgcgacctggcgcggcgccacggcccgctcatgctgctccggctcggcgagctccccgtcgtcgtcgcgtcctccgcggaggcggcgcgcgaagtgatgaagacgcgcgacctcgacttcgccacgcggcccatgagccggatggcgcggctcgtcttcccggagggcggcgagggcatcatcttcgcgccgtacggcgaccggtggagggagctccgcaagatctgcaccgtcgagctgctcagcgggcggcgcgtccagtccttccgaccagtccgcgaggaggaggccggccgcctactccgggcggtggcggcggcgtcgccggggcaggccgtcaacctgagcgagctgctgtcggcgcacgccgccgactcgtcggtgcgcgccatcatgggcgatcggttcagggaccgcgacgcgttcttggcgatgctggagcgcggcctcaagctgttcgccaagcctgcactgccggatctctacccgtcgtcgcgcctcgccatgctcctcagtcgaatgccgcgtcggatgaagcagcatcaccgggacatggtcgcgttcctggacgccatcatccaggagcaccaagagaacagatcagccgccgccgacgacgacaacgacttgctcgacgtgctcttgaggatccagagggaaggcgacctgcagtttcccctgtccagtgaaagcatcaaggcaacaattggagtaaggaccttttaactacgaaataccacgtcactttctaggaaatgtaatactacttgcctcaatatatagcaatctagaaccgaatatgatacatcctaatgttataaatctgaataggcctatggtttgaaacggaggtagtaacgctaatgaatttggcttcgtgttatgtgtgtacaggacatgttggttgggggcagcgagaccgcagcaacgacgctgcattggatcatggcggagctcgtgaggaatccgaaagtgatgcagaaggcacaagatgaagtacgacgagagctcatcgggcatcgtaaagtgacagaagataccctatgtagactgaattacatgcatatggtcatcaaggaggcactccggctacacccaccgggatcattgctgctaccacgggaatgccgacgcacgtgccaagtcctaggatacgatatacccaagggagcaacggtgtttgttaacgtatcggctattggtagggatcccaagtactgggacgaagctgaagagtttattccagagaggtttgagcatagtgatgttgactttaaaggcacacattttgagtacacaccatttggagcaggtcggaggatgtgccctggcatggcgtttggtctagccaatgtggagctcacattagcgagcctcctgtaccatttcaactgggaactgccgagcgggatacacgctgagaacctagacatgacagaggagatgcgattcaccacgcggcggctccatgaccttgtccttattcctgtagtccacgtacccttgcctacaatataagctcatcatagcacactgatttttgtacaacacttaagcaatctttttgactggcaactcaaaggtgcaaccacctatggtgaagcttgaggctatatgtgaaaaataaattttcataagcggcttcttataagatttccacctacactaatcgtactttgatatgcaccttatcatgaaatgtatttggaagctttgcttgtttgatgtgattgttatgttaaactttttcttgtaatttctttgtggaaattttgtgacacatttggaattcctaagagctctcatgtttttcctatgatatacatatatctcaatgtctcatgtgtaatttcttatgcaaacctaatctaatgagaagatacaaccttcaagactatctcttttgtgaaacccatttagggctatcaacgaatcgagctcaaacgagcttgattacctaggctcaagcttgacaaatgctcaagtcaagcctacgtagttcatgcatctttgtacaagtgtgccggaaagatcaaaccaatagaactgctcatatcacagtagtcatagtatctattgaagacctcaaataggaaggcctataaattcccccatgcagcccaattccttggggagagcccacatatgcctgatgcatctggaaaagctcttgagcacgttggcgtgtgagcccagctagctgcacgaacaggctcctttctatttttggctatctttcggatttagctcgttcccttctttgcccacccccgacttctgtcaattgtttaaagagcatagcccatgaatgaaccatatgagcaccggctctatgaagttcgaatcaaatctttgggttcccgtgaataagaattgttgggtgcacaaagcaagtgcttctagctgtttcacttgcttctttcttatcgtggccccaggtttgccacaattgtagcaacctcctttctttttcttctaaggttatttctgagtaatctattcaactaggagcctgcgctataaaatagagataaaaggattaccatatgctcattcatcaaaaactatagagacatgaaaagaaaaatgatatttttatcaaatcaacagaaggaaagatcctttaccaggtttgaattccaccgtcctactggcttgcttctctcgtctatcctcccatcgattcttcctcatgttgtgtcatgcaccacctctaccaatctatggatgcttctcaaaagctcttactcctctcaatcgaggaactaaattagaagaaccagagaagagaagtaaaaagcatgcaagtgactacaagctaggtctactattgatacgccttgaggaaggaagtggtgagacccaatgacagatcaaagtcgaagtaagtgaaaagaaaagggaccctctgctgaccggaggaagcattttggaaaataaaaactcgatctatacctctataggtagcagagcagagggaatgtcgccctcgttcccgaggaataattctcttaatgaactacttccgaatatagaagtgaataccaattctactagttgttaggaagagctagggttgttttgctagagctcacgtgtacgggggtacgcatggagaaaaaggtctagaaggacaattttcaacacaaacccataatcttttacaaatttgagccccccccccccacctaatgtaaaataagcatggaagaatatctttggtgacaattcttcgagggaagaacaacttgtcgaaagatctcaatacctagaggaaaggatggtacaattagccaagagagtgaaattttccgtaaccatcctgaaatcggttgaccattctggttctaatttgaaatcgtagtgagaatatctagcatacatctgcataagacaaccagtcaatccggagtttagtaaaacacgttgtctcatggcctattagtagaataatatatatgctaaagataatcccctactaagaaaattagattatagttaaccacattaatgaaagagaagaaaaagaaaacgtttagagtaactcgagacgatgccacgttgctacatgtagtttttttaacctatcgctatatattggcacttccgtgtgatgtggcaagattcatccatttaatgacatgttcatttgctaccgctcataagctcaatacacgattaatgacttgttcggtttggagcaaattccctcccttttgggatttaaccaaacaggatctaatggttccactacaatatataatagcaactactccctttatttttcaatagatgacactgttaacttttaaacacataacaattcatcttatttaaaatttttatgcaaatatataatatataaatcatgcttaaaatactgtgtgataaaacaactcacaaaataaattatatttacataattttctttaataatacgaaccatcaaacatttaaaaaaaatcaatggtttcatttactttaaaaaaacggaggtaatatattatagagagagtactaacgaaagcaagttggttggacgtatgtccgctagacgcctggcacagacacaaggaggcatgggcggagatggagatcggccttccgccgtgcagtgatgccgaacgcttctgtcatgtcgagcttggccgggtcggccaagccgggcacctcccaatcaaagtggaaaagcaagctggcgagagggagctccacgttggcgagcccgaacgccatccctgggcacattcgccgcccagcaccaaacggcaggaactcgaagtcggttcccctgaagtccaccgccgccgtcgcctcaccgtcctcgaaccgctccggccggaactcctccggcgagccgccgggccagtaccgctcgtcgaggccgatcgcccaggcgttgaccagcacctgcgtgccgcgcgtcacgtcgtagccgagcacccggcacggctcccggcactcgcgtggcagcagcagcggcagcggagggtgtagccggagcgtctcacggatgacgagttgcaggtaccggagctcgccgagcgcgtcctctgacacggcgccggccgcggcgaaggcacggcgaacctcagccatcaccttgtgcatggccgtcgggttccggatcagctnnnnnnnnnnnnnnnnnnnnnncgtcgccgacgtctcgctgccggcgctgaagatgtcctgcgtgcacgcgacatcatcgtcaaaaatactctcgaggaatacaatgatcacaccacatcacttacaaagatgatggatttgatgtcgtccatggcgagcgggaactggagcccaccctccttctgtatccttagcagaacatcgacgaggtcctcgccgccggcgctagttctctcttggtgttcctggatgatgccgtcgaggattttgtacaccgagttgcggcactcctcggcgcggcgtacgacactgctcagccgaccggcgagacgcgacgactgttggaaataaacacgtcatggtgtattcctggcgtggttgagtcagtgtgtgtgtgtcgtgctgctgcatgtgtgcgtcgtatgcgttctgttagtttggttgagtcgtgatcacgagtgcatggctgctgcatggttgtttgcatggccgttgcagtgttgatcgagtcgtgggtgtgcatggtgtgcgtggcgtcagttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgagtaataaagccaagatacaggagcgatcggctccgcggcgttcgtcgctgtaaaatccattgttcatcgtctccctcaccggcgtttgtgttcgtgagtgtgagagtgttcctgggctgagccaacaacgacggccacaggtcggccgggttaaaccctcccgcgaactcgatggtgcgctcgagcaggacgagaaactccccgcggtccttgcaccggttgtcgaacacggtgcgcgccgtgatgtcactcacgagcgcggagagcgcggcgcgcatctccacggtgcccgcggccacggcgaccgcgcgcagcagggcggcgacctcctcctcgcggatggagcggaaggagtggacgcggcgcgcggtgaggagctcggtgacggcgatcttccggacctggcgccagtagtccccgtacggcgcgaagacgaggtcccggccgccgttggtgagcacgcgcagggtggcgctcagcggccgcatcgcgaacgccgtgtcgtgggtcttcgtcacctcgcgcgccgcgtccctggacgacacgacgagcgtgggcacctcgccgatccggagcagcatgacgggcccgtggcgacgagccaggtcacgcatcgcgcggtgcgggatctgccccacgaggtggtgcaggctacctatgatcggcagcgtccatggccccggcggcagccgtagcccgccgtcgccatgcgctgccggcggcggcgagcgcctgcgcctggcgagcagcacgacgaacagcgacacgagagccaagccgacgtagacgtagccatgagacgcgtcttccatttccctttcctttcgcaaaggatttatgtggcagtgtgggtgtacatatcgagacgacatttatatactacctcattactagtagtactatctaatcttggataaaacaagattatcaagaacaaaaacaagattatcttgtatgcacgaaggcgtccatggcgagagctgttccaagacgattgggttcattacatagattagtatggtatactaagttattgacatgcatgaagcgcgcacgcaagcatatatgcgacataaaaatgcccattgaggaaatcaagttgactttgttaaattaaattaataaggataaaattcagtagggaaaattaaatagggtaaggtttatcgtcttccgttaagaatgaacgaatacacaattcgatgtcggtccctcgacctcaacagcatgctcgtgcacctcatggcaacaattaataacaaccttcccgctgacttatctcaggctaccattagctccttcaaagctactcccccgtctcaaaataacttaatctaaaagaggatatgaccagaccactctaaagacaacgaatctcattccctcttaggttgagtttttttgagacgaagggagtaagtttcagtttccccctagtgaacaaggtatcgacaaggctgacacattggcaaggaaagcttctgaatcaagccggtagatccgcccttgtaaggccctgtttagttcatgaaatgagaatttttggatgccacatcaaatgtttgaccggatgtcaaaagaggtttttggatacgaataaaaaaaactaatttcataactcggctggaaaccgcgagacaaatctttcgaacctaattaagccgtcattagcacatgtggattactgtagcacttatggctaatcatagactaattaggctaaaaagattcgtttcacgatttccatgcaaactatgcactatttttgtttttatctatatttaatgctccatgtgtgtgtcaaaaattcgatgtgacgttgttgagaaaaaattttggaaactaaaccaggcctaaaggtggtgctaatctcgcaacccatctaccatctcacctccatcaggtttccaaagcggtgttagaggcgctagacaagctcaggagaaaattcctttgggctaggggagagaacttatcaggaggaaaatgtgaagtgaattaggaatggctttatcgctcgaaatagcttgggggactcggggtcctcgatctataatgcttcgcaaacatataaatttaaattcaacttatacaggtagaaataaaaataacaaatttaactatgaaaagaacatgtaattcactgccaaatttgtttttttaattatataaatcaaattttaactcgcatatttataaaaagatataccgtatattaacctatcttataaagtatttaaaattttttgataacattttgattgtcaagcataaaacaagagaatgtacccttaaggaaaaaggaaacacttccatatacctccataaatgtttgacggtggtcagttgaattttgagctatccaaacgtatggagagagtactctagactagatgtgtgtcgtggcaacatagagaaggccgtcgtcgtccagcgaagccagctagacgccgggcacagacacgcggaggagtggccggagatggagattctccttccggcgtgaagtgataccgaacgcctcagtcatgtcgagcttggtcgggtcggccatgccaggcacctcccagtcgaagtggaagagcaggctggagagagggagctccacgttggcaagcccgaacgccatcccggggcacatccgccggccgccgccgaacggcaggagctcgaagtcggcgcccctgaagtccaccgcggcggtcgcctcaccgtcgtcgaaccgctccggccggaactcctccggcgagccgccgggccagtaccgctcgtcgcgaccgatcgtgcactcgcgtggcagcagcagcggcagcggagggtgtagccggagcgtctcacggatgacgagttgcaggtaccggagctcgccgagcgcgtcctctgacacggcgccggccgcggcctaagcatgcatgagacggactcgaaaaacgaagaatctgtatcgtttggcacagtttcagttctagataaattggagttggaagctaaagttgtgctgaccggggcctaagcatgcatgagacgggactcgaacccctgatccttaacgcggaagcagcgaccacgcaagccaacacaaccacaaatcacctttttttttctaaatgtacttgttacatgtaagttatgtgcattacattataattacactctatctatagtataactttatttcaatttttttcaaaaaaaaattatcgaatgttttataatctcaacatacgggcaaaagaacacatcacaactttttattaagaaaaaagcctcaaccaaatctgtcgagaaaggccacgaattctgacccccacacacgggctcacccctatagctatagattggtccttgacttgtgttttaaggcctccacccctacacgagaataggtccttcgtatatcgattcttaacatgtaattttacaagggactagcttgtaaaattttaattagatatgaaattcgttcctataagaaatcgaacccatgaccagaaggtagtgtaactattacatgcactttggctcgaagctatatttatatacctcataactgtctaatcttagataaaacaagattatctagaacaaaacaatattatcttggatgcacgaaggcgtccatatcatgatcagagctgttccaagacgattgggtagactaatataaattagtatggatgaatcacacatgcaagtatacgtgccacatgaaaatgccctttgatgaaatcaaattgactttgttacattaaatcattaaattaataaatgtaaaattcagtacggaaaaataaataggataaaatggagctttatgataagaatggacgaatattcaacattattgatggcggcaatatatattaaaactgggtctaaaagtatgtattactccatccagtcatttatatttgaaatatgggatttactagatttcaggctcataaaaatttataaattttcagtcatctaaaattacacacattgctaaaactaaaatcatagtgctatgcaatgtgaaatttcaactctaaatattttgttatatgtgattttactttatttttatctaaatttgaatttctctgcgatgtattttttttaaaaaaaattgttcaaccttctaaagaagggactataatttgttaaataaataacaaaagagtaatgggaaccattatattataatacaatgggtgacaaaagtaactaaaattttcgaaaaattctatgtgcctcaaatctatacactcccttgaatatacatgacttatgggagtagcataccgacctcatctgatgtactatctcattgattttatatgtcctcatcgatttatatgtcgtatttcgattttaaattcctccaattgacctgacaagtgaagtaggttgaagaaatagaaaacggccatgatcggttattgaaagtcgctctatagcttgcacctatatattttggatgcccgcagccacagccgctgaagcaagaacagctgcggaacatgcccaaggtcatcaccttcaaaatatatgggatttttgcaacagtttgttgcaagtttttgggacaaatattttcaagtgtttcatagctcatttggaaccttacaaatttaactaatcattgctctcacggatttataggatgttgaatcctcttgttgtgttaaatgatgctcacattattttggattctgcaataaaactttcaaattaacatgttgttaatcccttctgttgcaactctatttattttgtttcaatacaatctagtactatggattagtagtgatgtttcaccctcaacctttgcttgatttcttttttgtgtgtttgtggtttgatgtttttccactgcaggggtagacaggtcaaacgcgctcactattgaattctcatcattagaatattgtttgaattcttgatattgttaaattcaattttggtaatttgttgtgagggtgaggtcacaatagtagtgccacctctattgattcccattgagttccgtgcaccgccattgatgcctatggagttccacgtggcagtgagtctatagagaagagacatgcagcgccatgacccgcataccctctccttatctctgcttgcatcacgtatccgctcgagggtgcgagtatttggtaggagtgcaacccagaaggattcgggagcggggactgattttaccccattgttcactggtgccaaggccgagtgaactcgtaggggagcaggggcagggtttttcctgtccaacttgcccctgccccaccccagtgccaatctatgcttgtttatactatcttctaatctttatatctctagtttgcttactattgttgagaaactttggtttatgtcatgatgatttatgttaatgtcgtcattgtttacgctctttttttattaaatattatggtgaattgtcaatatttctaacaaatatttaaaagttacgatttgtttggaaatccgcaaaagagttgctacgtgtttaatgcaaggagtcaagtgctataactaattaaagccaaaatggaattggttttgtgtatcttggttatgcagaggtcgagagtattctcagtcggtggtatcacttttatataattagctaagtttaataaagcttccattatatgttaaagaaattggaatatgtcaatgactacagaaaaaaccacttagtttaaaaatccgagcaatagtcgtgtactattaatagccacaaacagcacattctactatattaattagctgagactatctagtcagaattcttgtcacgcaattgcttggataactctccttaatagttttagttttattggtatcaatcctttctgctgcataatttggagaagaatatcaggttcatctgctactgttcgcaagttcatttgtactggttcatctcctaagtaaccaactttgtttgatttgtactaggtatggctcattcgaagtcggatggcacgagcttttggtggcacgcaaaatgccagtaatatatgaataattaactgttataaacttacaaatgaatttgtttaattttagaaaagaaaaactttatatataaagctattacaagacgtatcgtgtaatagtttgggatacgcgctagggagaagaggagagtagagccaagctcatataaaggactagatctgtatggtggcaagcatacataatattaatcaccgctccgagccggccggcaacatcagctagacgccagacacgagcacgggcacacgaagtgtggggcggagcgggaggtcggccttccggcgggcggtgataccaaatccctcagtcatgtcaaactcagcggggtcggccacgtcgggcgcctcccagtcgaagtggaatagcaggctagcgagcgcgagctccacgttggcgagcccgaacgccaacccagggcacatccgccggccagcgccaaacggcaggagctcgaagtcggcgcccctgaaatccaccgccgcggccgcctctccgtcttcgaaccgctctggccggaactcctcgggcgagccgccgggccagtaccgctcgtcgcggccgattgcccagacgttgaccagcacctgcgtgccgcgcggcacgtcgtagccgagcacccggcacggctcccggcactcacgcggcagcagcagcggcaacggcgtgtgtagccggaacgtctctcggatgacgaggtgcatgtagtggagcttgccgagcgcgctctccaacaccaccccgtccgcagcgaaggcacgccgcacctcggccgttgccttccgcatggccttcgggttccggatcagctccgccatcacccactcaagtgtcgtcgccgatgtttcgctgccggcgccgaagatgtcctgcatatggtacatttttgcgcgtaggtgtgtgaaatgattagcacgagacaaaaaaaatccgaccaaaataatttatggtaaaactttttttatccacattatttagtggtaaaaggtcaacattgtaaaacaggtgaaataacttaaaaggaaaatgtatga

SEQ ID NO: 71530 - DNA, 19228 bp, Oryza sativa
ccgctagcttcgtcgccgcgagagctacctcggccgccgctcactttccgtgcgccaccgccgtgccgctctccccacgccacacccgagctccgctgccgctgcccatctccggtcgcgcgtcgccgccactagagccaccgccgcgccgcgcagtcgccgccgtcgcgctcaccgagcccgcccgcacctcggccaccatttggttgtcgccaatcgtcgccgaagcgccgcttctctcgcacgccggtgagctctccatttccacccaactccggccggccgctctagtcgccgtggtcatcctccccttcccctaacccgttcatcgcctttcccaggttgtgcccgaccctgtccgccattgtcgaaagcgccgccgccgctcgtctcttcccacgccggtcgccgtcatcgcctcggtgaggaatcccctctcctccttcctttcctctctcccgtgagcgccgccgccctccgcgcgtgcgccgtcgtctttggccgccgccgccgccttcgcgccggccgccaccgtctccccgcgccaccggtcatcgccggcggtcgtgcgccgtcgtcgcctcgccatggccagccgacttgagccgtgctgagccagcagccacgcccctctcccgccatgtgccgctgcccggtggggcccaccagccgatagaccaccccctcccttttagctgctgccaatggggcccgcatgccggcgcccctccctctctcttgagccgctgacatgcggggcccgcctgtcggcgccgccccccctcgctgacgtcagccctgggattatattgcgcaataaataattaaggactttttctttattagtaaaaacatagtttatcttctaaaattcataagtaattcatccgagctccgtttaagtccattcaagtctcagtaaattcataaaaatccctagaatccattaaaaatggtttggttttctgtttcagtagtcttatatcatgttttgcttgtgtgctttgtttgtcgcgtagatttcggccgtttcgtcgatccgcggtttctcgaagacgttgctaaggtctcatcagtgcgagagcaaggcaagtcatgcattacaattgatcatattgtacccaatttacaaatatcccgcatttctatcaaatgttgcattcttttacaatgtcatgtgggatgggtcctattactcggccatatattgtttaccttacgccattgataacttgggtatcaaaatgattagatgttggtttaggaaatgcttagccatgcttagttcaactaggacacaaatggagatcacatttttacatatactttgactattagcatagctttggactggtgccaccgcaagggtgtcagttaattaaaatatactgaatggcgggctgtgggtgcatggttttgctggttgcacccatggcagttaaggaccggttcacaggaaaccctgggagacttaccatgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccacccattgccttttgaggggtgggggtgaaacctagcgtggtgtggagtaaaactattcgaatagccgtgcccgcggttatgggcgatcaaccggattcaccgtgattagtctcacccctagtttagcttaatgaactggtgtagtttaggtggttggttgggcctgttgcaacgtggtgtagcgttggacagtgattggttaatattgattaatttagtacaattgttttactgctttcaactactgcttttaaatgctagctttatgcaaaagaacccctagcctcctttggttatatcctgcaccatacctcctcttccggtatgacttgctgagtacagtgggtagtactcagtcttgctctcttttcccccacaccagagctaaagatctttctagttggagctgtcttgttgaagttggttttgtcgctgccgtcaaggattgcctatggagtggcgtcgccccgctgctgaagtcaagcttcccggtttaactcgtttttatcttttccgctgcatttgtaatattttctatttttgtaagacgtggatctgtatgtcaacaattgtcatttgtgtaccctggctggtcctggacagggatttaatgcacatttagcttagaaattctggttcgtgaatttctaggcgtgataggaaccccttatgtgaagtggttgactgagggtgttaggcacaagatttccatggcacagtttgctgagatgttggggttagatgatgaggatctcaataggcccaacattcatagtgaagcacccctccccatgatcaagaccaaattcatgtatgcaaaggatgctcctaggacttgcatgggatcaactcatggattgcatcccaactacaaggtgttgtactccatctttcattggtctttgcttccaaaggttggagatgctactgctctgccatccaagcatgctcatcttctcagtcgcatgcgctacaatcagcctcccttcagtgtgatgaaattgatttggtatgagatcgccaacaccattcttgagcctaagcggggttgcatctatgctcctttcattatgaagatgattgagacaatcaccggggtattctacatcaaagatgggcaccataattcttttcgccatcgtgctccaccttcctcttctccagtggtcccttgatctgttccttctacttcagctggtccttctactagtgccccaccaagttcctcgagttcttctctcttcaagaagacacttcaggcaattttctgtatgtgtgctaagactgccaagaaagtgaagaagatcgaaaggcgtcagaaggaagatagaagagaggctgggaaagaagtgtcagatgattctgaggatgaggtctatgttgatccatttgaggcttatgaggcagcccgcaacgttgccggtgaaggtccatccaccttcttcaatgaaaattcttcccattctaatgatgatgatgatgatgatggtgatgagggtgacaccgaggcagctgctgaggatgctcccactgatgttgatgagggtgacaccgctgctcagtccgatgagtctcatctctccggcgataccgagattgttccctctgatggagatgagtgatcctcttcttctcttcatagtttctcgcctttttggtgccttgatgccaaagggggagaagttgtgaattgaagggggccatttaaatcctttttgctgccttgactgttgtctggtcatttgaccggaagttccgggtcctgtgatccggaggttccggctaggcagatttcctctctattatctctctctatatggacatgtaatcgtattctattatggttggatgtaatgactgttagatgctttattatcctttttgtcagtaagttagaccatatggatgttgcattttgatgtgatgatgtgttcttttcatctttttgagtgattaccatgtcatctagtctttctttttgcatcactcatcattcgagcactttcatctgcatctcttctttgataagggtagtgtgaggtttcttttgagctttccttcatcttatgcatattgttttcatttccagttctttatatgcatatctttagggggagcttcacacttctctcatcattcaaattttaaattctatcatctttttatttgctttaaccatgttgtcatcaatcaccaaaagaggggagattgaagatgcacttaaaccccctagtgggttttggtgattaatgacaaggtggttaaaggggactaacgtgtttatcaagtttattcacaggagtttagtcccaaagcgagttgtgatggctaagaatgcaaggagaccccccaattcgaatgttcctaagtgcaaaaatcatcgaaggtgattagactaggtttttcactttcgaaattgagtttaggaaaaaccgtactattaagaggggtttcaagtgtggttctagggtatacaaagtgctcttagtcttatccatgagtcaaaagatttttggaatcatttttgaaaaatgattttctccccgggacagaaaaggctaccccgaggttatggccagaacttccgggcaccgtttatttgcaaaaatttcctaagtgctgcccagaagttcctggcacttttgcccggaacctcctggcaggtttccagttcaaacttgtgagtaacggctagatgacgtcacctagccgttatatatatggatttcatccccaggtcactttttggccattccacttctgttcattcatgttctagggttttctagccactcccaagcttcctttgcttcctccactcaaatctagagcctatcttgtgagattgtgagattagatgagagtgtatgagtgttttggagatggcttaaagattaggtttgattgagcactttggatatcttgtgggctgtcacttaggcttattactcttggagatcttctcctagacgattaggtgtcgcccgtgagcttccaaagatcttgtggatgtcccggaaaagtttgtgaaggttttcctcacctccgcaaggaaacgaggtaagtgagtaaagattcttgtactgagttttcagaggttgtcctaggtagagcaacttgcacttgtagtcttttctaaaagaaattttgagttggatcttggtggtcactcaattctagaaaatgacctagaagtgttgagttgaaggctgtggacctcttctgggatctttgcataagtgaggcaaggggttaatcgagacctggctctttggagcacctcaacggagagtaggattcgtgtgatctgaacttcgggaaaaaatcgtctttgtctctcttgtgcatgatctttgtgtgaatctgctgatattctgctatcttcatcttgttcttctgtgtgtctaaacttctcttgctaggacctgtttttcatctcagttttaatttatctcagctgcccggaagttcctggctcaagaactctagtagttcttggctactcatcctgcccggaagttccggtgttcatcaccaggaggttccgggccctgttaatttaaccgctgcaattgtagagaaaatttcaggaaagcctattcacccccccccctctaggcgacatctctgcacattcaaaatacagtacacaaaaaaacacgtataaacgtgattatgacgtagaaaatgttgtggaagtaatttcacttaaattgtaatggcatttttccaaatagttaaatagtggtatttttccaagcctacaattttcagtgacatgtatcaagctattctctttctagtgacatgtatcaaactattatcttctttcctttttttttttttgccaggagaggagattattatttctttattgggggaatgggcttaggccggattttaattcaaaatagaggccatttaagcatgtttttacaccgaataaaaaaatgttacggtccggaattttacactattttttcccccaaaacaaggcttgcaagaaggcccaaagtattttcctcagtgaggccattaagcctgctaatggtgcaaaatccaccccatatccaatccaatccacagcagctagcaatacacctccaaatcatcccaatccactagccatcctataaaatccaaaccaaccaaatccatttccctcgtgagtctaaaccgaaccaacccattcctcttttatgggcacaatccattctccgaaccattcaaacccacttcaaatccactttggtccttgcggtgggtgtcggcgacgccgacgccgccaacgtctgggacactgagggtcgcactgcaaagcatgagacgcatcgtgtgaatcctcttggagcaaggaaggacggcggggagagaggcgctcatggtcctcgacagcgctggtgtgatgtccaggggaagggggaggttgttgcgccaccggtcatcgtgctgtaggcgtattaggtgtcgcaggggcggatgagtttgttgccgccatcagagcggtagacgaagttgatctccaggtccttctcgtcaggtccggcgaggcagcaaccgtctcatcgagccggcctaacgtgaccatggctacaattgataaaaccattgctcacatcatggatcaacaagaagtcatcaaggccaagtcctccaagtgttggaatccaattcggccacttgatgcactgacgacttcaaactaccgccaaatctacatacgacctccgttttcagtccgtgagtacttgatggaaagctctcggagtcttctttccaacggatctagcctcatcaccaaactccatctcagttggcctcaatcaaagaaacaaagtgttgcgtccccaatagtgggcctatgggcatgtaacttcgtctgggaccctggcccaagtggggcccatctggggtgcgccccaatctattggagcacgaccctagggtagccttggtcgtcttcccttctctataaatagttaggtaccactccagggtttctagggttttgttagattaaagtttcgcgcgtgccggttagaccgcctgtctgcttgttcttcggaaccccaacttattgtgtgtattcattcctatttgcagttcagattgctgcttttatcttgttcttacttgtttcatcgatttgctcgcaggaatagggttgatctacaccagcaagatcaacaacccatgaagaggtgtatcgatcgctaaggcgcaacgcaacgtcatgtacggttgtagtcgggtcgtcaacgtttctctcaaatcgtagttatctcaactcgccgaaagatcgggccaatcctagccttgagtttcgagtggaactcagggttcatcacatccagcggcagagcgcggagcggaggtgcgcaccatgtctctcgccgccggcaagaagctaaggattattagcagcaagtcttcggtgaggttactgatcgtatcgtcgactactgccaccgccgttgaagtcgtctccggcatgtttttggagtctgtggaagtgtacacgtatgcgcacgccgacgccctctttctcttcctcttcctcatcctaaaaaattttccgccggtggagatgcaacaacacatgttcctgctctaccaggaggtgttcctcttcggctgcctcggtctcagctccggcggatgcgatggtgcggtggtgatgtgaccatgactactattgatacaaccgtcactcacatcaatatcaagttgaccaagtgctggaatctgattcggccatgtgcgacattgctaaattcaaatggccgccaaatctgtatacgagcttcgttttttacctgtgagtacttgatggaaagctctcggagtcctctttataacggatcctgcctcatctccgaattccatctcgtttggatgcaatcacagaaacaaagtattgtgtcacctgtaatgggcttatgggcttgtaacttcgtctgggaccccagcccatgtggggtgtgccccaatcatgtggagcacgaccctagggacccctaaatcatcctcccgtctccataaatagcttggtaccccttcagggtttcttgggttttgttagattaaagtttagcctttgctacttgcttgtagcgcgcgtgtcggctagaccgcctgtctgcttgttcttcggaaccccaacttattagttgtattcaattcctatttgcaatatcagattgcttttatcttgttcttacttgtttcttcgatttgcttgtaggaatagggttaatttgcactggcaagacaaacaacccacggagaggtgtatcgatcgctaaggcgcaacgcaacgtcttgtacggttgtagtcgggtcgtcaacgtttctcccaaatcatagttatctccactcaccaaaagatcgggccaacaacagccttgagtgtcccgagtggaactcagtgttcatcaggtggcgccatgcatggcctctccgccactgtcaccgccgctgccaagttcaggtcatgcgcgggcagtgcggcctctgacgagatgaagagaacgggagaaaagtgggaaaagcaatcggattcggtccactaaaggaatccattcagcctacatggattgaatccattttcaacccgaaatcaccaaaccaaatccagtccacaccaatccacttctttgtgtcatccaaaccaatccagtccatttgaagcagcaacccattttcgtccaaccaaaggcaatccaaattagaaaggaaaaagtacatcgaaggtccctcaacttgtcatcgagttacaaaatcgtccctcaaccacaaaatcagatatatgacatacctcaaattataaaaccgttcactttaagtccttcggtggtttgaccctggttttgtccaacatggtggctgagtcagcataggacccaagcgggccccacatgtcaggatgccacgtatcacactctccctttcccctcctctcccttcctcctcctccctctctctctctctgtcactttctatctcacttttctcctcttgcacaggctggtcgccgggtagggaggactgaggaggtcgaaacaagatttcgacaataataaagggggtggctgtcaagctaggaaagtggatgggtttggagacaaggaattttatacaggttcaggccttcttattaaagaagtaataccctactcctgtccggggatgattccgccaagtgtgttattgattgtatgattgaagaaaaaagaatcgtgccccaagaggcacacggaccctccttatataggggaagggatccgtaatacaaggtacagtctatatcctaacggaatatgggattacagataaaatacaatcgtaaccgactaggatcctgggtattttcttgacatacaagtttagaatctaacccgaatcctcataaagatattctatctatatttggtaccatatatctgactaaagtataactgtcatgcagatatggggtatccataatctccacagtagcccccgagaccttcgcagttgacgaaacaaccttctcgaaacaaaaaccagtagtccgagtgctttaattcaacttgctccagcttgtcgagtactaaaaatcaaaaactgtgaaggacgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatatatcaaggacaaaaaatacaagaagggccgagtgacaaacactcaaaaggcccaaaaatagatatatttggtaggaatccgagcaagaaactcttaaaatgatccaccaaacataacagaaaatcatggtaattaatgagtctaacagcctaggctgtgacccttaccataaccaaaataagcatataacatgctaggagaatgactactgataaaccagtcatcttaaattaacccaacagctcttgtagcctaaaaaagcttacaaaaatggtataacacctttctgttgggcaccttttcatgtgcatcataataattccaaagaattattgaatcgcgttaaaaaggattttaacagcatcgggccacatcattgtgagcacatattgccaaagcaaaaagcgcctaagtccctagggatcacaatgggccgcgctgaaaacataattgggctgaagtactgtacagacccaggcccattagtactcccgataccctaataataccgaagtgaaaaacgtctcttcgtcttccccgccgagactctcgccattttccccatttcctgctacaatgcaaaactgcgccggacaaactagggttcatcaatccgctccaatccaccctcaaaaacttcacaagatttctccccgcatccaccgctccgattccccatccctttccagccatatctcgaactaaatcaatccatccagttcacattcatggcggaagaaagagaaagcttcgagagtcagtgggcgccctccgatgtgacggaagacaatctgaaggagatggtggcacacggcgttcttccagcaaaatagatcatcgggtggcgaccggcatttggtgaggctttcccgacccccgatacacatgaaatcgtggtatttgctcatttcttctatggcggattttctcttccaacttcgagatttttccggggcattctgaacttctacgggattagcttgcatcacttgaatccaaactccatagtacatattgccaattttatccacgcttgcgaagcttttctgggcattaggcctcatttcgccttgttccgccgcatattcttcctcaagccccagccaaacaaaaacaagtcgtgcgttgttgggggagctggtttccaactcagaggaaccttgagccaaaaatatttctccatgcccttcaaaacctcgaacaaaggctggcatgcgaactggttctatgttcagaatcctgagcccgcacttcccgagtactgttgtcttcctccggtttaccaggacacatggaactcattgcctatgggagatgaagctgctcaggcagtagaactgatggagaggatgataaagctgaaagaacagggtcttcaaggagagcagatcacccggcactttatcaagtgtcggttagctccaatcaaagaaagatcacgcacagcttttgagtttgatggcaagcatgatccaaatcgggaagatccagattctcttgactttaaggtcatgaaagaaagaatgtacaaaatcttttcaaacgctattgttgtcagctattcacatctgctgcccgttgtgccattcaacgcattcaaccctcctccaccggtatgcactcaaacatttcacccttcctcaaaatatgatcttgctttcctgttgaatcaattaacaatgaaagatattacacccaggaatttgctttgatgaagtcggatcccccaatcgctcaacgtcgatctccccgccaccaaactgggcaagggagcggaggaccaagaattcggtctgaacctcaaccaagtgcttctgatccagtcggccagtcagactctcgaaagaggaagctggttttaagtaacgacgaagccgatgatactaccaggcggcctagagaccgagagacaaccaagaaactaccaaaacaggctactctaaggaagaaaaccaccagtcgccctgcgccaaagatcaggaaatcttctaggtacaactcatataacgatctctcttgcattaatgtgcatccattgcggcaataacactgataatcaaatttgcaggaaaccatctgatatagatctgtctgggaaagattctgacccgactagcgtggacgcaagttcttccaaagaaaccgggccaactgccgaggaccgtccgagtgacaatcagacggcaaccgataacgtaggatccggtgatcaacccccgactggaaaccagtcggccgaagccgaagccggagttaattaggagcccccgactggaaaccagtcggatgcagggccaagccaagagattccagaagtcggagctcaagcaaacagccttcgcggtcaagacgccagcaataaccagagatctggatctcctttaaaggcatccaaatccactcgtcctcgtccagaaatcattacgggtaaaacactttgtctgaaaccatgtcgacccaaataactctgaccaattgtctaacctctgtcagtggatacattagggccaatgatcagtgatgaagaagaagttccccgcatacaagcagctgagggttcacgccctccgattctggtcaagtggtgggatgacaacatgcagcctcatgggatcgtgataaataagcaaaaagaggacgaagagttatgcctactgaagaaggcacttggtcaggcaacccgtatggaaaatgtaagccctctggtacctgatcttgaccatcttgtttgccatttaatccatgcgctaattaaactgtcttgcagaggattcatcttaggaacgaagctaaaacggcaaccttagagaggctagtccctcatctcgggaccctcgaagccaccaggagtctgctgcacgaaacaaaagagcttgccaggaaaaatgagcatgatctgaggaatcgaattgccgagctccaggaatccaattttgaactgagtggcttatcaaaaggttcgcacaaactctgcccaactgattcatactgttatctttgtgatcttgatttacagtaatcaatgtagtgcaagctgccaagatatctcagttcgagaagcaaattcaaactctggaaaacgacaaggcagaactggcaagacaaaaagacctggctttaaaggaagttgaaggtatcaacaatcaatacctcaaaagccattatcttccatatgctgacttattaatttgagtctgtcgatgcagaccgcaagatcaaatctcaagctcaattcgacgtcctagttggcaagatcaaaaaacttgaaggagcccgggatgaggttgctaacgctgctgccccaatagttcaagcgatgttcctcaataacaacggccctagtgcacttgatgcttctgaaattttcgacaagctgagagttgctccggatatatatttcaagaacatcaaagaagctggaagtatgggagcaagcatggcattggcgatgactaaatccctttatccgagagttgatattgacgccattgatggctttgcagacgggacgagcgaagaagctgctcttgacctcatcagtaatgcgcagaaagcggctgacaaaattgctgctgatgtagttgagagatttcaggacaccgatcttcgaccgactggtcttgatatttctgatgatgaaaagactgatactgattaatgtactgataatcttgatgattaataatgatggaggcacaatttgtacaatactgatgaatttatgctgtgcttgatatcttaacttagctcctgatttcttaaaagtttttgtcaaaccttgttgagcctaaaacccgcaaaagttgttaaaaaactttcagtcctcattgactaagccgagaaatcgaacagggcaatgatacatcaagtaagcaaattgaattcataaaaatcacactccattattattatagtagccccctgactgaaaacttcgaggaaaaacttgaagttagcagtcaaagaggaaagatacaaacgaaatgcctaagtgtaaaatcgacgaaggtgttcaatattccaagaattgttgatgatagtaccatcttcgcgcttgagtcgataagaacctggccgagtgacttcagcaattatgaacggtccttcccataagggagataatttatgccgatcctgtgttgtttgaattttccttagaaccaggtcaccgactaaaaaggctcgcgatcaaacatttcgattatgataacgacgcaacccttgcaggtatcgagtcgattgaattaaagctgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaatggcgactggccggtagcccgactaggagtagtgcgtaaagaccaaagtacggacggcagctgatctacccacttgccagcataggggcgtagtcggtcgaaaactcgtgctttgatcccttgcagtatcatgctgttagcgcgctcaacttgtccgttactcatggggtgtgccatggaggcataacaaattttaatgccgaagtcttcacaaaagtctttaaatgttccgccagtgaattgagtgccattatcagtgatgatccgattaggtaccccaaactgatgcacaatgttgatgaaaaaatctctagctttatctgctgtgatcgtgataaccggtttagcctcaatccatttggagaatttgtcgatagccacgaagagatgtgtgtaaccgccgactgcccttttaaatgggccgaccatgtcaagcccccagatcgcaaacggccaggacaacgggatggtttgcaactcttgggctggtaaatgagtttgtctggcaaaaaattgacaaccttcgcatgtccgcacaatcttatctacatcggacacagctgtaggccaaaaaaaaccttgccggtaagctttgccgacaatggtccgtgcagcagcatgattaccacaaataccagagtgtatatccttcaacaattgtttcccttcctccaaagatacatagcactgcagtattcctgatggacttttcttgtacagctcagtctcatgaataatgtaaagtctgctgcgcctggaaatccgctcgacttcatttttgtcttgagggagttcttgtttgctcaaaaactttataaacggttctctccaatcggcttcaagcatgcctacgccttgagtatccatggcttcagttatctcctttctgggtacggtcggttcgtaaagatgttcgacgaacacatctgaaggagctgcttccagttttgaaccaaaattggccagtctgtcggctgcctcattattatgtcggaggacatgggtgagctcgagtccgtcgaatttatcttccagcttacgtacctcttgtcggtaagcggtcatattaacatctagacatgaccactctttcgtgacttgattaacacccaactgagagtctccacggacgattagtcggcgaatacctagagatattgcaatccttagtccatggagtagggcttcgtattccgctacgttatgggacgcagaaaaatgtatccacaatacgtagcttaatctttctccagtcggggaaatcaagacgaccccagctccagtgcctgtaagcctcttcgacccatcaaaatgcatagtccaatattccatcttttcctctggcatgtcttcttggcactcggtccactcggcaaggaaatcagctagagcttgtgacttgatcgaagttcgtggtttgaaagatatatccaaagacatcaattctaaggcccacttcgcaatccgcccgtttgcttcgcgattatgaagtatatccccgagtggaaacgatgtgaccaccgtgaccgagtgactttgaaaatagtgagataatttcctgacggtaattaagacaccatataataacttttgaacctgaggataccttgtcttggagtcggctaaaacctcgctgacaaaatagattggtcattggactttttgaatatggccttcctcttcacgctcgacaaccaggaccgtactcacaacttgggaggtcgccgacacatataacagtagcggttcttgtggatgcggtgaagccaatactggtggagtggtgaggagtttcttgaagtcttcaaaggctttttgtgtttcgggtccccactggaaatcgtcagttttcttcagcagcttgaagaagggcatcccccgctcgccgagtcgtgagacgaaccggctgagcgccgccatgcaaccagtcaacttttggacgtctttttgggagctcggcggtttcatgttgaggatggcgttgattttctccgggttggcctgtatgcctctctgagataccataaatccgagcaacttccctgatggtactccgaagatgcacttttccgggtttagtttcatcttgaaagcacgaatacttgtgaaagtttcttctaaatccgcaatcaggtcatccctctacttggtcttgacgactacattatcaacataggcttcaacattgcgaccgatctaagttgaaaaacacctttgaatcatgcgttgataggttgctcctgcgttcttcaatccaaagggcatggtgatgtagcagtaggccccaaagggtgtaataaacgaggtcttcaagtagtcggattcttttagtcggatctgatgatatcccgagtaacaatccaagaagctgagtagctcgcagccggccgttgagtcaaccacctggtcaatgcgatgtaacccaaaagggtctttgggacaagattttttgaggtcggtataatcgacacacattcgccattgccccgtctttttccgaaccaggactgggttagccagccagtcgggatgaaggacttcctttatgaaacctgctgctaacagcttggttaattcctccttgatcgcatccttcctgtcttgtgcaaaacggcggagtcgttgcttgatgggtttggcgtcttccttaacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaggggaatctttttcgccttggcatcactttcttcggtctttgtcagcttggttgcaggcacttctccctcgcctgccgtggttgcagacagtcggatctcttcgcgagcaagagtagtctcgtgggtttgggccatctcgtagctttctttgtcgcatgtgacggcctgcttgatgtcgctccgtagtgatatgacccctcgaggaccaggcatcttcatcatcatgtaggtgtagtgtgggacggccataaatttggctaaagccggtcgtccaagtatagcatgatatgctgtctcgaaatcggcaacttcgaaacaaacattttctgtgcgaaaattttcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccactcggtcgggatgatccgagcggtcgaacttaattgctgtttctgaccaccgaagatactggggcgtgttaggctgaaccgcattgatctcccgttctgttagcttctgttttctcttggactcataagccaggggtccgccgaagatgtgattaagttctttgcgatgatcttgaaaaccagtcggggcatcatcttcatcatctttcttctttgatgtgccctgatctccgtctgcaggtttgcgtgcgttcttgacgtattgctccgcgaactgtttgtagacgaagcaatctttggccacgtggttggaattgggatgatgcggacattgagagttcattatcttgtcgaaggtgttgacgcggggacgttgtcgggaagatggagaggtggtcgccacaagttcttcgggcttacgcttgcgatccttgtggttgttatttccactccctcctgcagtcagcgtgtccttctttggcttccaagtggtgcccgactatttggacgcggtgatagcatcttcggcttcggcatactcgttggctttttcgaacatctgcttaaccgtcctgggaggtttacgtccgaacttactgactaggtcctcgtggcgaatgcctttagtgaaggtggcgatgatgacgtcgtcggtgatgtcggagatcttgttgcgttgctcggagaagcgtcggatgtaatctcgaagggattctccagacttctgaatgacgttgtagagatcaaactgtgtgccggggcgttcaaaggtgccctggaagttggcgatgaagtgatcacgaagtttcgcccatgatccgatcatgccacggggtagtccgtggagccaggatcgggcggagtccgctagggccacaggtagatagtttgccatggccttgctgtctccacctgctgcgcggattgcgagtccgtagacggtgagccaagactccagattggtggtgccgtcatacttctcgattccagtcggtttgaagccgactggccaatccactcgacgcaggtcattagtgaaggcagctactccatccacgtcgtcgtcgtagcgatttggtgaatgacggtgacctcgtgctgcacggcgctggttgatcgtgtcacgaaggtcgacgggacgctggcgaggtggagaacgaggccgttcagctcggcgctccctgtgacgttcgggaagcgagtgaacagatcgttcgtcgtgacccctgctcctgcgactagatcctgtgccggtgatgctgaggcttggctgatgatgagggactcggctaccagtcggggtgcgggtgcttgcggagttggctggaaccgaggtagcgatcatggtcttcgtctggttcaagatgttgacaacatgatcggcttggttgagggcgtcttccttgaggagggtgtcgaggagagtgattgctgcaaccacgttctgctggggggtgcgaaagaccgctgtcccgtcgacgtcttgttgcccaatgagctctctcgctcggcgcccagataccaaggcgcggtgccgtcgatcttcagcttcctttgcaatccgttcgcgatcttgttgttcacgctatagtcgttctcgctcctgtcgctgtcgctcctcctccagtcggcgacgttcagcttcttgccgtgcgcgatcttgttctgcttctcgggctcggcgctgttcttccgtttcgttgtcagccatgaatacgccgaagaagaggggcgtgtagttatcctcgtagctgtcgtcgaagttgtcgaagtcgccatggtcgtagtggtagccgaagtcgtcatagtcgaggatctcagttggtcgggaactgacgccgggggagctgaggtagccatccaactcttccgtcgagactgtcccaagaggttggagtataacgccaacctccctggatgtagactggatcggggccggtgccggagctcgcctagatctccgagtgggagatgttttggctgtgaagacggcggccaagtcatcaggaagtttcatcaagattg

SEQ ID NO: 71531 - DNA, 677 bp, Oryza sativa
agcctcagccgcaggggagagggtgggcgccttctctgcttcgtcgccgtcacctcccaagtctggcatcccctcccacacggcagcggcgacaggcggacggggaggcggtggtgtcggcgatggaaatgaggcggagccgtttggctaactgggtgtacgcgagggctagatccgaaaataatggagagcgcggggaagaagtaggggcggcttctgtagttgggcccctgagtagtatacatagcacgtacagttgacagtaatcgaattactatatgaggaggggggagggtagggcgccccccggggggtgcgggctggggtgttgtgggggtgtgttttaattttctttttttctctctctcctcttcccatctgtaatatagtgtatatatatatatattccctcctcattttttttctttttttctctccctcctcttcccagctcctcctcccaatctctctccctcctcttcccagctcctcctcccaatctctccatccggtttcttttttctaaaaaaaagaaaaataaattaagagaatttaagacttgaaaccatgatctcatagttcacagaaaactcccctaaccaattcaccttatgacactaagtgattagaggttattgtttgtttgttttatatgtttgttcgaattagtgtttgtt

SEQ ID NO: 71532 - DNA, 1057 bp, Oryza sativa
aatcccaaagtgagctagttgatctaagcatgactaagcaatcctagaccaatcatctagtcaaattattaacctaggctatcaatgaatcaggataaacaaaggctgagtatgggtagaaaccatcccacatgacattataaaagtaatgcaattttgagagaaaagcaggggttttgcaaataggctcaatatgatgaatgatatatgtatgacttgccttgctcttcagctgacgggacctcggcgaccacttcaaaataaactggagcgtcggaactgccggagtctaaacgacaaacaaggcacacaataaatacaagctaaaaagctactgaaacatcaaaagaaaccaattttaatggattcttgacattttaacgaatttactgcaatttgaatgggttaaaacaaagctctgattattaagttatgaattttacaagatgctctgtgttatttactattgacagaaacttaatcaattgataggaattagagcccaaaaggaacataggatcaaaggataggttgactagcaagcaaacctcacgagataccgactcaacgagtcaatttaacgtgacacgggatcaccgaaatgatcgaccgaaactggcgaacggaaccggccgctctaaacgactctaacctaaagaacgaatcgggttggacaaacgaacaaaccatgggggaacacctcgttcgaacgaacgagcggacgactcaacaacggctgtggctaaaccggtgggctagacatgattcacggtaaagccccggtacagcaaacgataggcccagtaggaacctagggttgcacctatggctagacaactcgactaccaagctatgggacaaaaacaacggctaggattaagcggcacacggctgcgacacagcggcgcaaagcggcggctcggctcggcagtgcggcggcatggcatagcacggctcggcggcggcgggacgacccgacggtggcggtgcaaggtggcggcacggcaacgacacggcgacgacttgactaaactacgacacatgaaaagaaaaccct

SEQ ID NO: 71533 - DNA, 735 bp, Oryza sativa
catcatgcatgggcgaccgtggaggccgccacgagcactgacgtgtccaaccttggcgcgccgcggcgaggcatcagtggcgcgtgcagcctgagggcgtggtgtcgaggcatatacgtacgtatatccggatcggacagacaaggatggcggacatatcttcaccctgattatcgaccatcgccgacttcagcgaccagtacacgcactaacaggatcgacgacaagctatctaacaacgacgacgggtggctcgagtacgtttcgctgcgacaactggcgcgtgtgctgcagccgggccgggcaccagcgcaagccgtagctgaccagtgccctgccaacaagcctgggcgcccgccacatcttcatccgcaccggcgccggcggcatcaaaaaccaccgattacttccacaaggcgcactgttccaggcaagccaaacgtctctcatttccttaatttgcatattatttcttatactctcaagctagaacatgcagcatggctattatttatcacgctaatacactgaaacactaggtcgaatacgtacgtgagctgagtagacatacacaaacaatcttttatactagcacaagggttcactacaaattgttcaagtcccaaacggttcagaaccagcggtccatagcagcacagtaaaaatttctaatgcacggacctgatgggaggaggtgatcaaccgcaggaggtacatgaggcagaggggcaaact

SEQ ID NO: 71534 - DNA, 2390 bp, Oryza sativa
tgttttgtttttgtgcacataagtacgtacgggagaagacatcgtataaacctgtacgtacatgacaacagtagtagctcttaaatcatatacagagaaagttgaaattttttaataatagatataatccaatggtataaaataacgggtccaccaatttaagtgaaaatcgacggtgagatttgataatgccaagtggcagcctatgagcgtttgtagcatgccatgtggcggtttaggagcgtttgtaggaagtttaattgacttttagtatataatagataatagatagatagatagatagaagattgcatacttactgtatgaatgtttcgttcttgtaaattttatcagtgatatgcctcacaatcattaacacattatcagtgtactgcctgctgccactctgattcgagtcaagtttgttgtgcagagcactgctccagttaatatacgtagttcagtaattaatttcggaggtcaataatatcgtcataccacttattgtgcttcttgtaagtgtcacatggagccatctttgttattccaatgatattggcccaaatcgatttcatcaaatttcttggaacatgctcaaattttaagtggggtattaccgtattagtgggaaatgttcgatctttctatagatggtgctgggtacatatcccaagtggtgatttgttgctgaaagtgctcctccttttgaaagattgtgttttcagtagatgctatcactgaagaatcatttgatgttttaggtttttagctcttagcattatctggctgcagttgttaggccaccttgatttgatgtagatattagcctgtagccattatcatgcaagatctaatttgttgtgtattctcagagtttactgtactctcgatgctgtaaccgtcctttcttctgatttcttttagagatattaaatgttaagatcatttcagacttgcattctgtgattgctttggttactgcaactttattagtgaacagcaccttgctgtaatcttgctgattgaattctattttgatgtgcagagtattacccagttcagtaattaattcgtgagttgctcaatggaagttattctagtcatctcactcgttttgcttcttgtactaggagccatctttgttattccaaaatccaacaacaatggtaaaagttgcatcaattgcaatatttagttttagttgctttaaactaattggcactgactaatgtaatgcaggtaaagggaaggaaatacaatcaccaaacggtggaatggtgaatttctttttctatatttggatagtgtagttttctgtaaaagttgtacatgtaattttatttaacaaaaagatttatctcaaaaaaaaaaaaaaccccatgaggcttcagaattcagaataagctttctgtttattgatctaaggatacacttgactcattgttggttcattaaaagtacactccattctcactatttgcccatggaatttcacattcagaaatttaggagctatacaaagaaagaggtatcgactcacaacacaaggaaggattgttggatcatagtcaaggacaaggttggaagaagatgatattccagttttgcaattgattttgtgtaacaaaactatgaagtttgaaattggaaaatttgcactattttgtctgatgattgctgatttcgtgattgatccaggtgtatgacgtaacctcttatgtggaggaacatccaggtggtgatgaaattctaaacaatgccggtggtgattcaacagagggatttttggggtctgtatcttatcacctcaattataccatactatgtcaatattgttcttgaatcttttctggagcataatactatgttgctgctttagcatgaatcgcagaagtgtctcatgttactttgctgcatcttttccgaggtgaaatctaatttagtttttatagtaacttactaattgacagggctagacttatggatccctgtttactccatcgaaattactcaattgactaacatagtaaatgttgctaatgacatttataattttctgtaacagcaacaagcaaaggcaattacgctcttattttacctgtcaatgaatttccattctttctggtgtattccaatggtattgtgcaatggtttcctgtgtttgagtactggtcatgtatttttgtcatcattgaaactatttatgctcagcgacatacacccataaatccatatccgtgattttagggacatgtggatgttactgattttaatacatttaacattgaccatttcaagaaccaaaaagaaaatctagatgatggatgctccaaagggtagtgttactttctcaactgcgacactgaagggatctttcttctcatatcatt

SEQ ID NO: 71535 - DNA, 8645 bp, Oryza sativa
  unsure (1)..(8645): unsure at all n locations
tacggtgatcctaaatttgccaaccaccctaatctaccaagcgctaaatcaagatgagttttgataaactaaaccggcttgtggagccgatcttgttgttcggtagataattacccgtctggtgggcaaaacggaaggttttcaggacaaacctacaaagaggtgtcgcactctcgtngccgtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaatttatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcgatctcttggatcgctctagtttggttgatatattttcttacctgatatctcaattctatccctaattgcattgtgtttagagacacatcggtttagttaggactgtctcggtaaggtatgatcttttgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttgttattgattgtgttcttcgattcgcatgcaaggattagccttctcggcgaggtcaaccgggtttcggcatggttgataactagaggagacgtggtgctgtgattgcagggctcagtagcgtgtttgttcagaagctggatcgagttgtgtcgcaactccgcccaaatcattgtttatcagaacctttcggaagatcgggacctgacatcccctcatcaatagatttgttatatccatcacattagacagatctatcagcttatcgaggattagattatcatatccaatctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatattgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaacacaagggtaggcgtgatggagtttggatggacctggattttggtctatgctgcttccgaatttacctaggcatgagcggggttgcccgcccctggattttggggtgggggtgaaaccgaaggtgggtgtgctagttagggtggttatatggagggttttgtcatgatttccccctttgcagtatcatggtggtacttcgggtatggtttcatgtgtagaatcgtgtcttgtggttaaagttgtacacctctgatcagagtaaaactattcgaatagccgtgcccgcagttattgggcggtcaaccagctcaccgtgatttttgctgggcctgtcgcaacgtggtttagcgttggacagtgatgatgttaatactacttaattatctactgttttactgctttcaacttatgatttacaaatgttgcttttactgcaaaaatatcctatgagccaatcctttaattatccttgcatcataccttccccttggtatgacttgttgagtacagtggttgtactcagtcttgctttattttttccaatcccccagaagtagaagttggttcaaatggtgagttctatgaagattaggcttgtgccagccgtcaagagtttgcctgtggagttttggaggaagcttcgctttgctgagaagattaagtttagttctctagtttttccgccgcatatgagttttatcttgttatttttgtaagacgtggaactgtatcaaattgtcatctatgtactctggttgatgcctggacagaggttaaatgcacagatagccggtgattcgggttgtcgaatccctgggcatgacagagaccaccatgcctcctcccactgcagccacagtcgccacagcagccgctgctgccgtattccaaccacctgctgtcgccggccagccgctaacgccaccgtcaccacgagctctgcgcctgctatcaccaccacgacgacctctcccgccgctagtgcccccgttgccacagcagccaacagtcgctgcacgtcggccagccactgctgccgccgccgtccagttgctgtcttcgcgccgttgcctccgtgccgtcagctgtcacgacaaaaaatttagcccaaatttccagactattttatgtattaaatccctatccaggaccaacaagggtacataaacgacaaattaatatatagatccaagcgtaaataaagcgtaaaatacttatagaagaggcacttagtcctcacatcgaaacaaaagcagcagcaatggaaaaaggcgatcctagcagggcttcagctccactccataggcagaactcaactggggtctgagccttggtcctctaacttcgtcttcagctcagaagcactatagttctgaaaaatggggaaatagcaagctgagtacaaccatcgtactcagcaagccacaccaatgatgcagacgtgcaaaaggagacaaagggaggtttgcggttgtttgcataaaggcggttgtaaatcattttattgagcaaaatagtaaaatagttgattaattaaggtaatattaaatctccactgatcaatgctacaccacattgaacaggcccaaccaaaccacctgaactacaccggttcattaaccaattattaaggatgggactaatcacggtgaatttggtcaatcgcccaaaaccgcgggcacggctattcgaatagttttactctggccagaggtgcacaactgtacacacaagacacaatccatcggcatgtcaccgcgtcatcatgtgcccatgatgagcatgtcaccatatcgagtgattgtgataagacccttcgcataactctcccctaaccatccacaccacgctaaagtttcacccccaccccctaccccggaggtgggcagtcccctcgtgcgccgtggtgaattcagcagctggacaaacgaacacccggccgacccaactccattacgcccagcctcgccaccggtgcctaggaaattgtcgagctataatatagatcaagtagttactcattccagcttgtggtaagcacagtaagtcttccagggtttcttgtgaaccggtccttaattgccatgggtgcaactagcaaaaccatgcacccacagcccaccatttggtcgcattttagttggataattacgaccaatgaaacatgttcggatgtctcgagcacgcaactcgtcaaggtactataggtctaataatgtaattatcccattatgtgagctagtggtaattaagcatggctaagcatatatgattttagctagatcaacataagtatcacgagctagataatttatcacctaaggttgacaaaggacgggtaacaagtaaacatggcaaaagcgagcaaataggttatacctgatcccatgtaattagcaaaacatgcatatttatttgcaaacagtaaaatatttataaattaggctcaatatgcttaaggggaatgtgtgacattccttgcttcttcacttggatcttctgaactctttccctcgcgaccgcgaacttccggaacgacggagtctacacgctggcacgcaaaatgaggaaaaactctaataaaaaccaagtaaatagtacataaaaagtaaacaaacatgtagagctcaattttagatgaattttacaagttgaatggaccaatatggagttcgtatgaattagatatgaattttagaagttttgagccatttaaatcaatttctagaattaaatacgatttattgcacaattattaattaatttctcataagaaaagggctgtcgctgacatcattaaggggagaggcgcgccaacaggcgggccccgcatgtcagtggcataaggggaggcacacggtggactcggttcaccgcggcgggggcggcaccgtggacctggaccataggaccgacggcctagattggcctgaagccgatccaacgggcacgggcggcgcgacaggacacgggcacggcactaaagccggcccggccgagccacggcgcgtggcggcgcggcaaccaacggcgatggccggcgacgcaagtagcggcggtgcatggcacgggaggtgggcaacgaagggggaaggaggaaaaagagagggggagtgctcaccgagcgccatggcggcaagggggcaacgggcagcggtgaggccttctcaggaagatgacgcggcggcgcctcagcgatgaccaacgaaggcggtggagcggctgaggttcagagaggggcggcggagccgatagggtggtggcgcgtcgcgacgaaggcccgcggaagtagcgggaattggcggctagtgacagggaaatggcggtgagggctcgggtgcacgctagaagtggtattttggtggagttccggcggcgatgaacggaggccggggtgtggtggggcgctgcgaacgctgtggaggcagtagcgtggccgagcgaggcgatgctcgccggcggggagcggctggaggcagtagaaacagtgatggcttagcctcgcggtgggagcggcgtttcggtggcttttggggaaaatggagcggtggacggggtggagttcggcacggcgatggcggtggcggcctagagcagaggtggctagggcaacggtggtgagtggctggagctcgccggaaagaggcggaagttggttgcgcggtgggagcgatgtttcggtggtggtggggaaaaacggagcggtggccgggcttgatctcgcagcggcgaagccggcagtggaggacccaggatttgaacccagggtaggcctagccaaagaaaatccaaatacaatacaatatgattcgatataaaatatggtaaacgatacgtatataactctaaatggttcgatacaattagaaaataacaaataagtttaacttttaggataaaagcttgtaagtctaactattttttttatcaaatgaggcaaatgaatcggacggattaaatgctgacatataaagaagcaactccatactaacttcatcaaaccgattctcaagctcttgacgaattctatcgatgacaccaatgtacacttctctcctatagtggtcatcaattgtttgttccaggtaaaaacggtgggatcttccatgaggcatatatttagcatccattgcgggaatatcaatggaatatttgatgcaaaatgatgtaacctttcctaagaaaccttcccaaccatgcaaaaatgtcatatgaagggggtagtatgctagtagtggtctactactactagaactctagattctagaagggggagagggactgagggactgaggaagtgaggaattgctcactggagaggcggactggtggagagccgaagaaggagtggccggtagagcactagcgctgggctcttgggcggctgccggctgggcgcgtgctgccaccgacgcacgtcgggcaggaccgcgggagccaggaggccgccggctggtcgcgccgacgcgggacagagagagtgtggccaggcggggcgcgccggcgaggggcggagagggcgcggccgcacgggctccgacgcggcacgaaaaggcagtaggaggagcggcgctgtgagtcgcggcctcgcgggagcgccggccaccggattcacgggctcgcgggagcgccgtggcctgtcgggagtgggaggccaggagagtaagtggagaggggagataagagagttagagttttcttttgttgggccaggctttcttatgggccaagaaaaataaatacctgttcttatctgggccaaattatagggtagtcctgggcctacctagactactctttggtcccgccactggaagccggtggtggcggtggcgtagcacggcaacgacaggagccgcggtggctcgtggttggaggacgccggtgggcggcggagctcaggccggcgtgggaagaacgggagagcgtggggaacggcgaggaggggaaacaagagaggatggccgggatgcgttttatagcgctcggcggccgggattgtggccgagagaggcggattcggggtggcaaccggtaggaggtggggcgccgacgtggaggaaatggcggccggatttcgcgggaaggggtgggggaagtgggcgcaaggtggaggaggaccacgtgcgcgcggtttgatgcgggcggggagcgggatgatgcttggaatttcggtgatgtgggcggccatggcgactgaagctgggcgactggaggaaggaggaggagttgacaggtgaagtcgctgcgccctcctgttggcgagggagggaccaaggaggtcggg

SEQ ID NO: 71536 - DNA, 2230 bp, Oryza sativa
tcaaaaaatcctaagctattattagaggggcatcaaacatacagaagttatcttgaaaggaggggctaagtggctatggagaagaggaattccacagactgctgcttatcatcaatctccagccaccgctggccttcgtcagccattttgcctcttcgcccacagttgtccagcaggaactcaacctctggccgcttccagtcgcccacgcaacaatctcagatggaagcggtgggctgcaccgcgcctcctcagcggttggcaaccaggaggatggaggtggccacgacatgagccccagtcaagaaatcaaagatgaatgtttttttttttttttttgaaatgccattgcaactttaacactgcacttcatttgtcccctgttaggatctggcatgagcacagatcacttttcagtttgccccatacgttaagaacttggaaattaagatagttgtaacaccataatgtccatcagaaaccttttgagacagcaatagaatgtaatctgctcaatctctgtagctgaaactaagctacctatgcctatgtacacagtcaaaaactcacaatgtaactgcttatataaccaggaacgggaaattagtaaagaaagacatgaattttattcagatagttgatcatgcatgtgcacttaaaaaaaaaatatagaactttcagattttggtcatacaaacaaagtaaaatgtaagctgtgcatattcttggaaaggttagggtatgtgtatattaatctgatttcatttagaagtattgaaaatcaacccagacttaatagaggaaccatcataaattattaatcatttgaattgtagaatagcatgcgaaaccagttggttatgaatctgggttaagtttgcatatgtatctagttctttactacgaaacacagaaaagagacaatagaagtacatctaagtatgcatatagtgataaatagtcgtagttctactaaatttcaataacttaacagaacatataagttttttttttctaccaaatcatttgtgtagcagaacgaatgtttaaaatcatactctcagaataaaaccacagtaaatagttagttaatcaatagtttatttttttccctgcatcaacaactctaatctagtaaattatagtcatgacatacagtcagtagcagtaaatcatccaaagaaatcagttaccatctatctgtattcaaggtgttccattctctatagtacatatcttggcatgattttcaaagtatagtaccatgtaaattactgcatcattcaataagatttattctagaatatgatcctgctgttgtgccaaattcagttatttcatcatgcaagcatatacaaggacttaattatgttagtgtgattttcattagcttttctaattccagtactgcacttgcatcagcattcattcattcactcatggcatacagaaatttattcgtccaaccctagcaagccaatttatctagaaccctagaaacagtaagtacaatcctgattatagcatcatcaagttggtcgctaggattagttcacaagcatcacaattcagagcatgctatcacacaagagagtaccaatcaaatcacatcacagaagtagggagaaaaggggatgatcagaaaggaggaactcgggggagacaagccatggttggctcaaggggtgttgaagctgggaaaaatcccaatctggaactctaggcgggtgtcttcgtcgttgggcagcagcatcgattggagagggttagcttgggggcaggctcatgagaagcatgaaaccgattcaggccggcagcggctgcggggcgcccgccgaagccagggagcagcggccggcgtgtgaggtggagcgccggcgatggcagtgagacctgaggatgcggcgggcggcggcacgggggagagcgagaggaaaagaaagagagcgagagaaagagagaggataggaagaaggtgggctaggtgggtcgttgtggctgatgggctttagagagtgggctttatatggggaataagttcactttaggtccctctatttgtcgtccagtctgatttttgtccctgaagcgcaaaccggatatgacccatcccccaacttgcgaaaaccggacaaacaaggtcccttggcggttttggctggcgtggcgcccacgtggctattttggctcggtcttcatctgacgtggcgcttatgtggcaatccgatct

SEQ ID NO: 71537 - DNA, 1204 bp, Oryza sativa
ttcctgcagccctttagaaatatttagagacttgaaccaactaaatccgagctaagatgaattagttatgaatttttaaagattaaatcgaattaaaacacttatatggattttaattgaattatgacgcaataatgaattatttttcaaaaagaaaaaggggtttgttgcgtcagcggctagggtttgcggtggaccgggcgcacggcagcggttcacgggaacgaacggccgagatcgatcctatccaaaacggacggccgagatcgaccggtccacggccggaccacgagggacgacgacgatgacgtcagcgacgacgtcaccaccggcggcggctcggcggctcgggcgcgcatgctcgccggcgaacgacggcgcgaggacgcgaacggaggacaccaaaacgatgcggacatcgcggcgaactcacccgtgaccaaagcgacggcggaggagcaacggacgacgtcggcaacgaggtcgaagcggcggagaagatcgggtcgacggcggcgacggtgctccggcggttgacagcgacggcggaggggcggacgaggacggcgacgcgacagcgaccacgatggcgatcttcccgaacgacgacgacgactggagcgacggcgacacacggctggagcggcggcgacgatggcggcgctaggtcacacggcgctagggcgctaccgacggcgagaggcgaaagcaagggtggcgacgggtagaggagacaccggggatccttttataggggcaaggaggcggcggcgaaggcccacggcgaccggcgacgcgaaggaaacctcggtgtcggtgacatgggaccgggagtatcatgacttagagacttgaggcagacacgatcacccacgtggcctaaccccctcgggggggttgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggat

SEQ ID NO: 71538 - DNA, 2382 bp, Oryza sativa
ggaggggagggagggggaggctggcatgagagggggagggggagggtcgaaaggaggctcaaaggaaggaggagatcttaaattggtttttcaattaatttaattgattaaatgaactttgtgatgttaaaattagatgttgagctccaaaaattcacagaaaaatcaagagagtatattagggcatagagaatattataaaatatttctggccaatgatttttaaaggaaacttttaatttcctcaataattcacttgattaaattgctttaacttttatttaatttgtagaaaatgatttattaattgatttttaatcccgaacgaaaatcggagcgttacattagccaccgccgctgccaccacgggcgctgccgcggctgtctcaggccacatccgtagctgtctcagccgccgccgctgtcacccatcaccagccgcgtggtcggccaccattgtctccgcgacggcggcagggtgcagggagttaggaggtgcaatggaggtggaggaggcagaaagccatggatgaacggtgcggcgagctggtgaccctaacgtggagagcggcgcaagtggcagcactgatgatgtaagagcatttcgaagaaagggctaaacaggttcctaaaaattaatttttgggattttggttaaaactaggtctgttaatcacggttctaaattttatcccctcctataaaatcgataccaatctcatcagaatttgggaaatttgggaagcagaacgccgtcctaatcgcaggaatcacgccaattgttttactgtcggcgccaaaagttttttttccgtccgcttccttttcctcgtcgcgccgttttttttcgagaaattttttttccgcccgcttcctttcccttctcgcgcctttctcctctcgccgttttctttttcgcgagaaacaacagcgcccacgccgccacgccgccaggctagggttttggggctcctagcgccagctctgtcccgagcgcccgtccgtccagggctctgccggccgtccgtccagggctccgccggccgcctatccgggggaccgccggcctgccagccgtccgtccaggggcagcgccgccggccgcccgtccagggcaccaccacctcgccatcgaccgtccatccaggtcaccccgacgacgacgtgtgctgctactgctgattcactttgaggtattttcagagaaactcatttctacctgtgctcgtatggtttatacgcactgtacaagtgcttgtgcctgtcaccaatcgttgctgctcgctgccgttgcctggttgcttatgccgccggcgctgacagaggaacagctctgcgtgcgtctgcagcactgtgtccttcgcaaggttgtctggatcgggatattaggtagtaatgttttgctccaagtattatcgtatcgtaatattggaatactatgagattttctttttttaagtttaattaatattcatattaattacatatatattatgcaaatatagacatttatcatgagaaaccacgttggttttgatatatttaactgatttctatatatacttgagcatattcatttacattatttccaaaccatcttattttaaataatattttgtagtaacgtagggatcgtagaatcgggataccacttaagatttcgtaggatcgtgtagtaatgaatagtaggatcgagatactatgaaaattaggatactaggtgggatcggtatcgtttcggcttggtaggatcgtagtatcataagatactagaatacgaatcaggatactgacaaccggacttcgttcgatatcatatcgctgcgccttatatagcctcacgaattcggacgtcaaagggtttttaagttgtatttggacgtcaaatattaaaacacgtttcttattgtataaggacgtcattttgagaaaatgaaggaagcatatactttacacactgtaattatatacataccacgttttgatattgtatttttaggttaaatgaaatgaagaacatttaatcaatgttagctaatttgtgttcaatgaaattttctacgtaaattatgtttgttttcgtggctgcgcacgccgcgctctcccttctagtaaaaataagattatatcatattggatataatgtgctcacattgtggaaaacttaatactaatatttgagtttgtttatattattgctgtgacatataatttgggaaacacacattacaggtgcacgatagctggtggaagggaaaggccaaaagggagaagaaaacgagaaaataaaagtttcaggcgccgcttcaaaatcccgcctcaaacggtcaaaagcccctgatccccctttcccctaccgggcctctccgctgccgcctcatc

SEQ ID NO: 71539 - DNA, 564 bp, Oryza sativa
ttgggatactcacaaaaaatgggattttgttttcagtcaaatcattttatgatgcaatgaaaatagaaacaagtggttaccctttcaagaagatgtgaatttaaaatttcagttaaactcgaagtgttcatttggttagcacttatcttgactaaagataacctcattaaaaggggatagaaaaaagagaacatgcggagagcgcgtggagcctcatggccacgcgcgcggcaggtgagtgatgggtgggtgagcgacggtgtcctccgcgtctctcttcctcctctgcctcgcagggaaacaggaagtagtagtacaagaggtgagaggagtagtgtgtagtgcaatgtgcacacgtataccggtagagtaattttaccatccaacatttggtacatcgaggtaccacattttgcatataaagttttaaaacctcgaggtactaaattttatactacaaagtacctcgaggtactaaattttatactagaaggtatctcgatgtaccaaaaatttgtggtacgtacctctgggtatcaaatgttagatggtaaaattgctcat

SEQ ID NO: 71540 - DNA, 1416 bp, Oryza sativa
tacgcgtcatttttttatgactcaggtaaataaaataactcttacgcgcttttcagaccgcaacatggctttagagtcttcgagatcatcgaagatttctgcatcggcaaactgaaggactgatgatgatagagatgagaggctcaggaatctcccaaatgtgaacccttgcgttccacggatgttccttgaaggaatgaaactgtctcctgcctgtgatgaggactggccccaagctctgtggttctcatttcatctttgacctggcactcttactagtagcagtgtttggaccatatggactatatttatgtgagttcaatctcaatgttttcgtcgatttatctctttgaaaagatatgtttccttagatttatggaactttctcagataagacaacgaaatgtgccaacttttgtatttattgtttctactacaatgacaatgatatgcattttttacttggtccaattctccccctggtcgtgtctgaggattacacggctattgggtttcaggaaacacgtttggaattttcatgtgctcatgcttgtgttggtgaagtaatctgggtggctacaataagaatattttttttcaagatctagtccatttttcctgatgagaaaatcaagagtttgtacaactattttggttcatttgtcctgatgagaatcatgatattgtacttcaagagtataaaactgctgacaaaattatattctttggatgctcagaacatgatcaagatcttattttccttgacacaaatcaataataataatactaataataatacaaagaaacactctcatttggggaaaaaaaagagagaaaaattaagtactagtactactatttctcatctctattgacctaggaagaaagcttctgctcttcttccctcctctgttctttcatggcaacagctaaagaacagagggtggtcaccatgaactgcttctctagtgttcatcagctatgtgaggatcggatcgggttggattggattggattggattgggttgagtttggtcaccattgatctggttctgttcataatctcatgcgaagaagctggtgatatcaatggtgaatccggggtcgaactcgaaggcgtcgagggcggagaggtcggcgtcgaccatggcggtggcgggcgccggctgcgcggtcgccgtcgtcgtcgtcgcggcgacgagcgcggacaccacctcctggagctcggcgtcccgccacgcctcatcgccgccgccggccgccgcctggtggaacggcgcggcggccatcgagtcggaggtcgccggcgaggccgccgacgacgcggcggcggcgaggcggttctccggcgtcgacggcgcggagaacgggttgtgctgatccggcggcgccaggccgctcaccggcgacgacagg

SEQ ID NO: 71541 - DNA, 638 bp, Oryza sativa
  unsure (1)..(638): unsure at all n locations
tatttttctttaaaaaaaatgtttcaacagtatatcctttcttgttctaccgttcggttctgtttccgaaaaggaaaaaaaaagcaaaggaaatggtctgagcatttttctatccgttttcattcctagccctttagccataaatattaaatattaatatttagcacaagttttggtcattttttacaatatttatgactacgtagagtatactagcttgggagagactacaatcaagtaaacactgtaacatatcactgcatgcgatctccaagggaagcataataatcttagttagctgcgtgatgtgcatgctacaaaaactcgctagtcattacaatgacaagcattctcgcctgtatgcacaaaacagtatgcaacaacaaatgtaccgacatataaaaatggccatggcaatggcatattggcatcagggatactctgtttgaattctgaagctagctttgtatgtttaaggctagaaccaaaaaacagcaaaattacatacgccgaatctgtaatcctatacaactcagcagcatttcttttcctctcaagtccaatgccgctatggctcanggccaaaataatcaaaaacagcctgaaattaccttgcatgtcacagctttcgtactact

SEQ ID NO: 71542 - DNA, 3616 bp, Oryza sativa
tccggcttgccggcgccggcggccaccgccttgtggacgcacgtgtgctcgccgtggtagatcacgtcgaacaccgtcgcgtcctcgtcggtgcgctgcacctgcttcgtcgccatgcatccctgcgagtggcggtgggtgcaacggtagtaacccctgaaaaaaaatgtttttagaaaccttgcaatcgatcaaagattcttaaaattcttcagaaaagtttgtgtgatttcgaaaacaatcaaactaattggcaggattatttgacaacacatccaattagatgcatgcaaacaaacaggtggtcctatgatcctatctgaatttctgacaggtggagtccaagcatttgagaacagaggaaaggctgcagctgctttcaccatgataaagaaaagacagccacaaacaaccaaaccaagcaggaaagcaaagcagatatatctttgatgatgccacagcacaaagcttatgaaaaacgcatgtgcagattaggctatgaaaaaggtggaaacaaacaccttttttgtactgaaatattggggggaaaaagtagagggaaatcagaaaaataccaaccttgggtgcttggctccaagaatctctttctgcccatactttctccagctatggccatcatctaccggtggattctccacccctcccgtcgagctcaccctaatctgatgcctcttcttctccgtcgacgtcttcctgcaaaaatcaatcaaaaaaattcgaaacaaacaaaaaattaaactcaatcaatcattcccccaaaaattcagctaaaaatgaacatgaacaattaatctttgtatatattcacctcttcttggtggccttgaaaggcaagtcggagacgtcgctgagggggctgggagtcgccgagtcgaggtcaccggcggcgacagcggcggcggagcgcttgcggtggccgtcgaagtggccggacctgatcatgccgatggagcgctcggtgacggagaagatctgcgaggccaggtgcttgcagaggtcgggggagccggagccacccaggtgtccctccagctgcctcacgagctccttgatgtggctcagctccgtcaccaccagccgccctcctccattgccctccatgctctccatcacccctcaacccttgatcgatctcttcctgctctcaccaacctagataaattgctagctagctagctcgatcttgcaggttgcagctaagctcgcttcgcggtacaagaatggcaagaacgaccaagaagagtgatcaagaattgggtaaaaagatcgagatggcgagagtgcatgtggagtgaggcgcagctgccaggggagctcgagcttataaagaggaggggaggaggggatcgagaggtagaagaagaagaagaagaagaagaagaagaagaaggggattggagaggtgaagaaaaagcgcgttggtggtgagtgggggagaagaggattttgaccggtgagagaactagatggcgacggcgagagggggttctttggatttgattggccaacgccatgtcggatcgatcgggctaagctacattagcttagctagtggacagtgttggggtgatgcaatgatccattaaacaaattttagattagtggagggttgtacccaaaagcgtcagcttggacactttggtttggaacaacatcaaataaaaaaaaaactagatttgaagggagatttgtacctctaaatatgttttaaaaagaaaatgtaagtgtattggggattgaacatgcgatctcgatgttaaaaccacacacctcttgcaactgcactatcaagtgcaaatcaaatgtgtatatatatatatatatgttggtggaaatacttttgtctgttctactttatttctggatgtttcggagatggtttgtaattaaaatgtcagctacaaagtaaccatggattaaattatgtggaagatagttttgtattagcacatatgtttgtgagcttgaacctatgcacaaaatgacattggttgtccgtaaattatttgtcattgttttatatatttttcaggtaaaaatttgatatatgctgcatagataccacaatcaactcgataatgtaatggccccatcgtttggcttttcttttaataagccaaaacggcttattagagaataaaaataaatttgtaggtaaaacttttatatatatattctcggtgacttaaaagccaatgctgaaaaagaaactacgttgaaaatacctcaaaataaatatcaaaattaagtttgaaaattcaaattttggctttttctttggctgaataggctattcgataggagcctaaattattgttttatatatttttcaggtgaaaatttgatatatgctgcatagataccacaatcaactcgataatgtaaattaagtgtggaggaggactaaagtccaaaatagctaaactaaggctagttaatttacttgggcgagaagttcactgatgatattatacgattctacgtggacacgtacacacagccctttgccactactcaaatctcttgtctttgtttttttgttttttggtggcatcacatctaaaagaaaaaggttattcgatatacaaacgacgaacgctaaaagcctatatatgtgacatattgcgacgctgtccagttcatattgggaatattttcatgctgtttcagttagacatacatctctttcaagtgctctggtcggtatatgtgctactggctcgttttttttttcttaaagaaaatgctagtagctttgttagttgcatggtgcttttttttgggttgtttctctaagaccttcagttgctatcatttcactctgtttcacactgaaagtactgcgtccattcattcattgtccgtatgaaaatcagtggaggcttttttttcctcatttcttgtctcttttacacttactgtgcctagtgtttattccaaattaagggcaggtaaattgtaccttttgaaaatgaagaggatcttattgaagttatgtatacgtatggcatctggaatgtacacctggccggccgcctgatgttgctgtatcatgagcacgaaggctaatgtcattcagatagtgatgcttaaaagaattgatattgaaacgtagggtagtatatatgatagaaacgcatgtgcactactaattataattaagtagtaccttttggaaatgtactaatatatgatcagttcattgttgatttgttgattagagcggaaagaaaaaggaaatttattgatacccaaaatatttttgttgtatatatatatatatatatatggtacgcgtggaattaaaacaatgaacgaattatttctgcataagctagaaataaccatgaaagcaaagcagcacaacatatcactaatgtaaaactaacccggtttaaaacatgggaatttttacaaaaacttcacacgatttttccaaatatccttttttctgatatgggcaaatattactacaaaatttcaaatgtgtgcgcgccaaatcctagtactctctatagacgagtcaaacacattcaaataacacttatttacaagtaaccatgcgtactaaattaaggctcgtcgacaagtaaat

SEQ ID NO: 71543 - DNA, 8527 bp, Oryza sativa
ttataaatatatatttctcctgttgtcaattttgatttccccgagtagatgacttcttacgtttaaacacttagcccaactagtcatagcccccaagcaccgggagtcagcctaggcacttcccaaacatgcatatgagcgacatgagttcgtcattaatggaacaaagtttcacgaatcagaatttactactcgagtacttttgcaattgttaagagcataagataaatttatctcatctctatgcttttgatttattccgagtaatacttagcaccttgcgttactcggtccatccaacgagcccccgggtgctaggaatcggcccaaaggcaactatccgtcgacaaaccaaatggaaagcatagaaagatagaactccataactcgataggtactttatctttacttggattatatcgcaagtaatcaagataggcattatgaacaatgttgaaaaatatgatataatatctgtagcccccggctcacttgtcaacgttgatgtagtgaggcagaggaaaaggaaaataccatatataaaaaataaaacaatgatgacttagctttttagtattcccgctggtgatgacagaactagccgatgtgggaataaagtcgtccatcaatggcaatgaaagcaccaaccatggaagcaactgagtcatccgtcaaccgtataggcgaagtccgccaaccgtataggcgaaaataccagtcagtggcgacgaaggcggtcgatggtgaaatatgatgatgcccatcagcagcagcataacaagccagccatgaaagcgaggacaccagtcagcggcagacgaggcggccggtcggtgaaaacataggtgcccaacaacggtggtgtgaccatccaaccgtgtaggcgagtacaccagtcggcggctgatgaggcggctggtcggtgaagacgtaggtgccaaccgaccgtgtaggcgaggacaccagtcggcagcagataaggcggccggttggtgaagacgtagacgcccaacaacgatggtgtgaccaaccaaccgtgtaagcagaaacaccagtcggcggcggcgaaggcaggccggcagtggagacatagacgcccaataacggtggtgtgaccaaccaaccgtgtaggcgaaaaaccagttgacgacgacgacggcggccaatggtgaagacaatgccgccatcggcaacggtggcggagtacgccaaccgtggaggcgaaggcaccaatccatggctgcgaatgccacatatgtacgtgcatacgaaaataacagatcaaaaagtaattagagatctgtgaattaaatgactagaaaaatcaatagtttaatctggtttacataaaaaaaattaaaacgatagacctggtgaaggtttatgatcttgatgcacgtatgttgtgacacgtcctattttggaacttgcatgtagatggataatttatccgtaaccaatgtccggttcactgatccaatggtaacctcaatgattggaaacgcatactgtgtagcagtagtctaagcgctgtcgctgtgcgatcaggagcatacacacgtgtagataatttcttccagatttcttgacatgtggtgtgcctgttacatgtatttcatcatcggggttgatctatggtgtaaattccagattagtctgttgttgctggactccgcttcggacttcagttggagaaactcgatctcaccaaggaaattaaatcgatgagatgacaaacattgaaagcttttttcccgtagtaggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcggcgtcacccctacctggcgcgccaactctcgaaacatgaattcggcaataataaaaggggtagcgcacgagacctaaaagtagatggatgcggagacaaaggatttagacaggtttaggccctctcaatgagaggtaataccctactcctgtttagggatttgaatccaccgggtgtgtattgatctgacgatcaggttgtgtcatctaccccctagagggcctcctgcctaccttatataggacggggggcaggattataagatagaaaccttaaccaatacggtatcggtttcctaaatctactttacaatattatcaaaccaggactttaggccgttccataatatacaaggaaacgtaatacccaagtcatgatttgttacatattccatagatataagttatcccctataactaatcgataaccatgacgtgtggatatggggtacccataatctctacactaatctccacaccttaagtgtttgccatttgcgttaccctataacaaacccaacgtttttcagctttgctgtgatgcatgccatctctaacactcaatgatgccgatcgcgttaaaaagctttaccaatcgataagatgatcttactagcgcgaaaccaaaatgatcttactagcacaacactacataattaaatacatatatatatcaattgttattatattgtacttatcaatgagggaataatgggatgcataaacgaccgagatgtgtctatgggggtggggtatgattgcgatgacaaccttctactctaaaatatcaacatcaacctacagggattcttttccatttgatggttaatatctagcactactctttttaatatcatcttgatatattttttagtgcaaaacttctacatcaaatcctttcaaaagcttgaaattaaaaagaactcattagataacacacgggctataaaaaaagcatgcacgactactttctagtattaaagctaactataaaggtagcccgtgcatttgcgcgggcttgtattttagattgcgtttgaaaaacttatatagatggaatatcaaccgaatgacacctgtcatttttccaaagcattatttcgccataaattttcttcatcctcgttacttagatactatttgttagcttttataatatataatattttaatacatcgctataaataatttataattatctatgatcaattttgggaggtgaatttttcttaaagataattaaagggtgttgcgatttcgcataagatgtatccataatactgacatacttataataaacataggtttttaactgtaaatttattacataaataatctgacaacataaacttacactaccacataaacaatttattacgtaaataatctaacaacataaacttacaataccatagaaacatggataggtaccacttgggaatccgtcataggtgttcgatttcccattcggcatctaggaagcggcaaagatgagggaaatcaaaggtgcgggttccaaaaccgggaccttagagaggttttaggaatcaaaaaaaggcatcgagcagctcccattcaccccgccgagaacacatcgaagaacatccaagaacgaatgaacatgaacatcaagaatattcttcccaactactgggaaccatcaaaactactcatccccatcaagaacacaattacaaaaaacacatcaagaacaaatagatagcacaaagagccaccgctcgacaccaccgccattgccgccgcctcctctcgtgcgccgccgcctgccaccacctcccctcccgccagatctagcggagcggaagacgctgccgccgctgccgggccgagagagaggagtgcgtgtgtgcgagagaaagaggaatgcgctcgagagagagagagcgcgcgttagatagagagtgagaggagagcgagactatcggtcttatccgtgcgagagagaggggcaccgagccctctcaaccttatccgctcaagaccaccgatcggctcggctcgacttttaattatccaacacttatagtaaattaaaggtgttagttttttttaaaaaaaaatacatctagctatataatagaaaactgacacctacagtctattaaaggtggcagttttttttttttttgtattttcaacccgcatagatgggaaatggtatatatgtgccggttttattacttccagcacctataacaccgagctctatgtgccttttttaagtagtgtgatcaaatcatatatgtatgatatagttactatataaataatctaacaacataagcatattagaatacatttatgatttaaatgctatagttgcctaaatgttttttacgtaaatctctgtgtcttttttagcagtgtgatcaaatcatatatgtatgatttagttactatataaataatctaacagcataagcatattagaatacttttatgatttaaatgctatagttgcttaaatgttttttacgtaaattctgctttcttttagaagaaggaaaataggagagataaatagataatagaatgaaaagagaagaatgggaataggagcgtgcagagttcatatgtatacgtgcatccgcaagaatatataggggcccaatttagagttagattaggatggatggattactcttttttctacatcttatctaatggtcaaaaaggatgggcccacctatttaaatgaaaattaagggttagatgtttctttaccacatggcagcttaggagcacttgtagagtgccatgtggcgacatatgagcatttgtagaaagtttaatggacttttagtatataataatagatagatagatttcagcccatgcatgctgttatcactttgtatctaaaaaccaaacaaagataaaagaaaggtgaggatcaaaacactcaatttggaactacgaaatatacttatattcaatagataaagaagaagctgcaaactcttccttttctttggagtatgacaccagattgcagtagttctatcctggtagacatgaatatacactcgacttcatgaaatagtagttcccatcaaataataatttttggatagacattaattcaaatagtagttttcattttggacaatcgtcaatacaacatagtatttgccagcaaagccgagtatacagggccagtacttacccatagaaaaatgaaaccataatcagtacgtacacaatcgcatgaatttgatagaaataaaacaatcataggaaaacaaaccatccatgacacctacagttcgtgatatacccggctgaaccttgtgataactccgcatcagactcataggatggaaaccatccaaacctaaagaacaaaatacactcaaattctaacaaccgtaatgctagtaaataaataccgccacttattcttccaataaacttttaaaccgaaaatctagaattttgaataaaccggtgaaaaaacttggccccactactttaattgtaatatttgaaccacataaccaaacttagcaaataataatgccttgcatatgtactgaaaattatctgcagctttcatattaagtgaaaaatctaattttatttccaaccatctcagatttaagtaaaagaaatcagctgcaccgctagaaaaatatcgacgagacctacgacttttgcgtacagcacaaaacataacttctaatggattaataccactatttcagtctacctagaaaattaaaatcgatctatggcaacaaaattaaaagtaaaattagaagtagcaaggaactagttttagtttacccttgcggccattataattcggtaaatctttcattctcctcaaccttccctttttctgctcctctgtttttgtcagcagcagtgcgtagagcagtcgacagacgactagccaatcagctgggaaggcagcagccagcaggccatgctgggtaacaacaggcagcacagcagatcagcagagcaacatactagcgtctggcctcgccacctgtgaacaccgtcacagctaatttgatcaaatggaacaaatagtgctgttgagattataggcataaaatgatttaatctatttcataaataaatcatgacattacagatgaaaactagcatgaacgcatcattagatctacacatgtaaactacacagtataacatgaacagatcaaatatgcgcaacatattgaatacgtaccgaggtagcggaaagaccggctgcttcggtcgaaacttttcgcaggcgtctacgaaggcacgcagcacgcgagcgaagaggaagacgagccgtcgcggacaaacagggagcagtcgcgcaaagcgcttcccaaaaatcttattgccgccttctcccggtgcaggacgtcgaaggcagaggttccggagacctgcactcccgatcgcaggtgcacgccggcaagcgggatggagtaatctacgagcgacggcgcagcacagagtaggaggcaaaccctagattgattttgcgtgtgttgcgtgaagacggcgggtcggtttatatagagaagggtcacttgatcagggcgcccgcacgatctccactgcgcgtaaccgaatcggataagttgcgcgtaacttatccggactccacgccgtttgcacgcaccagatttttcggaacgtttccaaaacaaaaacgaatccgaatttgcagcaaaacaaaactacaaaaggaggctgcatctgcgcaaggtgatgaaccaattttggcggatcattcgacgcgtacgtcgtgcacgcggccgcctgccctgccaggccaggcgatgcgaggcgagcgagcgcgcgcatatgttccccctcttctctctaccacacatgcttcaagtggctaggagggcatcctcccttttaaggaggtccccctcttctagaataagcaaggtggtactaaactccacatgcatgccatcctaggaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccgattaagattgaacatccacctagaactccaagctacacttaatcacaacttgaacaatggactatgccttgaattgcaagtcctgtgcaagcaagtttcactcagagtcttatctggtactagaccgtctgtagactacccctcgggtggagcgtataagtcatactcctaggtctatagtaagcttcctagaagattcacccaaaatctccatagactgcgaccaacagtcaagctcacaaaggtgagttctttcaagaatgctctgcaggacaacatcttcgctaattaaagccaacagaacacattaaggcatagccaacctgccttacagctcacgagagtacatgcatcttcacttagagagggtatagattggtactctcctctagtttactaatggtttgttcttcccagattctaattcacgggatctccgatcacatagactgggttaccaccatagtataactcacatgggtctcaaacccatctccttcgatacattgtttatcacatttcgttatagtcccttcgtgaagggatttgccaggtttctagctgtttggatgtaatccaacgttataactccggagtttcttaatttcctgatagatttcatattatccttagaactattcactttaacaattaccgtttgattgtcacagtttataaggatagccggcaccggtttttcaacaataggcagatccattaatagaacatgcagccattctacctcaacagtagcagtatccagtgccgtcagctctgcttccatggttgacctcgtcaaaatggtctgtttgcaagacctccatgaaacagcaccaccacccagtgtgaagacatatccactagtggctttgatctcatccacatcagatatccagttagaatcactataaccctccagtaccgcaggatacatagtatagtgaagccccaattccacagtatctttcagatagcgcattactcgctcaagcgcacgctagtgatcatatcccggattagaggtaaatcggctcaacttgctcacagcaaaagagatatcaggcctagttgcactagccaggtacatcatcgagccaatgatttgggagtattccagttgattcctagcaattctcttgttcttgcgaagcaacaaactaggatcagaaggtgttggagaaggcttactatcaatgtagccaaaaccaattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcataaaa

SEQ ID NO: 71544 - DNA, 7528 bp, Oryza sativa
ggattttctttttaaggagaagaaagcacataaaagcatggagaatttattttggtggtagtatacaaatggaatggaatggataattgctaactctcagtgtaggagtttagcatttgcatatatgtgggtgtatgatcttgatcatagagcatgagaagtatctacacaagtcacaagaatttgataaagttcgatggaatagcaagtaaccaaaatttatatggtttaatcaatgaagcatatttttggctctagtaggaatttatatcaaatgaggaactttcaaatttatcatttcgaaaaacaaagcatccggaattcaagtcaaactaggactaggatcatagcaactcttatttactatcacatatctcacaacaacttagactcagattagcaagtgcagctcatttacctcaggttcctagataattgttggctacttatatttaatttttgagagagcacttacctatgaacccatatatgagagatataaaacaaagcaactattcatcatttcaacaaagagaactagtttgtcttacctagcatgacaaaaccttacctatctttttggtattttctattttgcaagtttttatgttgttttcaggtttataggatgcaattagaaagcaaacatgcaattggaaagggaaatattcaatatgatacaagttacctcagtggggggagagatgtttccccacaagcttggctttcgctcagggtccttggtaaggattgaacccctgaaagcggaagtatgtttgaaggtcatcgggcttttgctgcatcaggttgttgatgttggtgaactgagcatcagtagtttgttgccattcttgcgcttgtgctatgtgttcctcgaggttgtattggacctctcccatatgcatatcaagggtattcattctccgggtgatttcacccaagtcccaacgagaggaacttgagcgccattcacctggagatagaggcataccacttgatctgggggttgattgctcatgtccccccactgtatgtcatgaggcacatgccgtaggtcctcattggcacttgcccattttgagactccgatgctgtggcgtggagcttggctccatccggttacatccccagtcagctcccaacctgcctcatacgtttgcacgggtgttgaggatgatgaaccttctcgttcattccttgccatgttgcatatctccctgtatgttcgacctacacaagattcttctatggtctgcaagggaatggttagttcatggcagttgtagaaatgataccccacattaggcaacgggaattcatttgtacaatcgggaaaaaagtaagtcaaagatccatctactccatgtttaagaatatgcctttgcactagataattctcatcaatacagggacgagcggctgagatataagcaatctggtcattgacgtcccctagtcccttggctatccgagtaatcaaagaactgcactcaacaggagcagaaaatcttatactttctaaccattgccttatcatacatttcacagtagcaactttgatcttcctaaccatggcaaacatgataattaattcatccccctaatgggtctaagatcacttctaggaaacaaagtcatagcaatccatttgtgcataagcctaagtgtaggattatgaatatcattcgtcctaggtttcttgcaaattggagaaccataaatatcttcccaaaacctatttttctcaaacgcagaaattcttttctgaagatcgattttacaggaatcgtgaaaatcaagaagtatacttaatccttccatgaaagtgtgtattccttatggaaaaagcgaaaggaaattctatcttctatttctttcaaagtgcacatgaatcgcaaagtaagcgaacaataaccaggctcatctaccacagcaaatctctgccaaccaacaactttccagatagcacgaaagttagtatccatacctatcttttccaatagctccagagagtattctcgcgtgtgagtatactcccggtctcttggcatgtagtaggcttgtctttcctgatcgtcgacaaggtcgaagtcggcatcgctcaagagacgttgcagaatgtcggcatcctccatcgagacatcggttgatgaacgagcactagactcatcatgatgacttgatgaagggctggatcccttgcacagacgaggcaatcgcttcattctgcataatgaagcaagaacagactaactcggcgggggttagtatagcaagaatttcacccgccggttagttttcaccaaagcaacttttatgtatgcgactaagtatttgaatttgagggaaactatcaaagcttgaatgaatttacgagcaaagtttgaagagggaatgaaaatgaattggaatggggtgcattcccctctcacagctggccggcttatatagggcagccacaacggtcaaaaatgacatgtgggccccttagccgttaccctgtcaaaattggtaggtagccgttgcctggctggttcggccgaacctctggtgggcccaaccggccccacttttggccattggaatccaacggttagtggggtcgtggcatagtgaatttttgttgaaaattttattttggtttgctctgaaaaattcatttgaaagaatttcttcaaaattcaaaatcctaaatgcaagttttgaaattcaaacatgtgttgatgcaaaaattcaaattgttgaaaataaatatgcgaattcataccaatttacctgttggcgaaggtcgcgtcattttgggtccgacgtgcaagaccgtacctcctttcagtttagttcacggattttccacccgtctccggaggggatggagcgggtgtctttggcttttccttccacaccttctttggttttggtgcagaagacggcttcttttgagctggctgctcttgctttttggccggtgtactgggttttaccggcgtcttctaataacggttcctgggaaacgctgtttcattttccagcaaattctgcatgaacttcaccaggctgtccgtctcgggtggctccacttcgacctcttggatgttttgcaggtttggcccatacttgattctgacactcaaacttttcttccttcccgttaatatggaaacggatactccccgttcccacgtcaatgttggctcctacggtgctaaggaacggatgccccaagatgtcgcgtccaggtagtcacgggacatgggagtgagtccattatagatgttttacaagataagccagtcgtccatcccatgatgaggacaggcggccacatacttctgaagtcgttcccacgcctcaggaatggactcatcccccgtctgctggaaacacgatattctcccacgaagggcgctggttttgcccatcgggataacttcgataggaatgccgtagaacatttatcccaggtgtagatcattgcacggttggcatagaaccacagcttcgctttcccaagaagggaaaacggaaacagccacagcctgacggcgtttggactgacacccttcatggtgtatgtgctgcaaatctccaggaactgttgtaagtgagcattggcatcctcattaggtttgtcgcagaacaggctagcctgcgccatcgtgatgaggctggacttcagatcgaaatccacttctcccaggttgatctgcggcccaatggccacgttgtcagctgagggagcaacaaattcatggagggtcttgtgactcttgtcagccatattctggaaggtcggtggcgctggtatggctggtttctttgtcgggagagttttctgcggagcgacgactcgcggcttgacgctccggaaaaaaagcttctggattttctttaaagttttccggcaagttgaaaccagtcatgcaataccgtgtttccacaacaatagtgaaaacaaccaaggttagcctgcaaaggatagtgattatgtagaggtaaatataaagtattagttctggtaatctctattataattctttcccagcaacggcgccagaaatgattgttggtatttcttagcgacattactaggaatataattcccagcaatggcgcagaaatactcctggtatattatggttacagagttcatccgcaagcacacggatataccattgtagcatttcaccagatagtattgcaagggtatcgtatttatttaatcccgtgggaagatcatagtgagagaaccggactaataatttagatgttacttgtaataataatagtctaagcaggagttaagataaatcaaagggtagagtgacacacaagcggggaactactcattctcatactaaaatatctaagctaagtggaaagaaaatagaaagagaatcgattcttatacttctagtatgcatagtgtacacacattctagttatataattaagtaactaataccctctatccgatgccctcttgttacttcgagaagccacccctgactgccgagttccttacgacagcccgtcgtgaccatacaaccggggctaaatacggaggagtatcgtccccaagaatttaacttaggactatatacatgcgcggaggaatacccgtactgagctttcaccatcagtggcccacctctcatccgcagcatataaccccaaataatgatatcccgtaatctagacaccacgcctaagctaccagatactactctaatatcatcgtcatgacatagagtaattgcataagcaaactttatacccgtaccaatgcatctcccagataagctagcagtataatcagtataacatgaacaaatgtaaagttggcattcatatactcagaaagtatttcaataccataaatgtataaggacgagtatattctaataaaagtacaaagtttacaaaagaggaaaggagtgttactagagccatacccgaactcttccgaaggcatccggactccgatttctactctattcctactccactagcttaagaacactaagctaaacttgagagaatatgagagagctttgcttgaggtgtgtgaatgaattaagaagaggaggtccttaaataggctgccaatgacggttgtggcagttggaatggtcgatattgccctccaaccatcattggggagtgatccacgccgtctagaagaaaccctgcatccaacgttgccaagggggttcggccgaaccaggggccggcccaaccagcccggtttttggctagcagcctcctctgttgcttctcttcgcagacttgtgaattttgacccaattcatcatgtcaattttgagttcttggcccattcatgcataagtctgattctcgacatcgtccgattgatttatcgactgattggatgttgattctcctccactttatggttattctctgcaaaaggttagtgaaccaaatactagtggaatattattattctaacgtgaatatgcattgcaagcataactagttctcctctattttggtaatattgatggtcgaaactgatcgcaaacgaccgtcaacagcctgtttgcacgacggcagggcaggagcaaagccactgagagcaccaaccacctcacctgtcctcccaaagctgaacatatacatacacatgatttgatatttttttcttccccgttgcaatgcacgggccattttccagtcttttttagaaaataaattctgcttccacccaccgttttcattcgttcgtctccccaattaagtggatcactgtcgtccacgtatcactactaaaaaccgatttttgtggacacactccctattttatacaagcggaccaaaagagcgtccacatgcaaaaagatttgcatgctatttggttatgagttatgacccacatgaaaaaaaaatcaaatttcacatacagacctcttacgaaacccgcatggagaaagaactttctgggcctcctcgttttcccttttctttttaaccgtccccccgactcccttctcctctacttatatctcgctccctcacttagattttcttcccctctactcctcccccctatgcctcctctacttctccctccttcagatccacaaagggagccgatggcggggtagcgatggcggtccggtggatgtggcaacgacagtagtgggcgggagggcgaagctcgaggccagtggatctggcggcaccgccctcgagagggtcggatccgtagcactcggtcccgctatagctcgagggcggtagatctagtggctctgcccttgggaggggcggatctgctgccctacgcccgggggtttatggcgaggacaacagccttgagctcgagtggatgagagtgggagctagggttttgggatttcggtttcttttggaaatttttttgttattttttcttttcgcatgtgggaggtttaactgaccgcccgcgaaaatcatttttttgcatgagggagcgttgcccgcatgtaaaaactctgattttcacaaatagttatgtgcatgcggacgaagtgcctgtctgcgaaaatacattttggtagtatggaaaaagttttctgtagtagtgtatacagccatgtccgatacaattccatcctctttctcatcactcacgacctcattcgtacgtagactaagaacaaaccaaagtcacaatcgatctgcccagattgacacggctgcacatatgagtatgtcgagtaggaggagaagctgctcatggacgggttccctaaccaatctctgctctgcacgcatgtctcgcaagaagccaagcaatggccgcacatcgcggtatcacctcacaccgtcaagcattcaccccgacaaacatcgagaatctccctttgcttcacatcatgtaggtaagttctttttgcacatcgacgtggcacggccgtgagaattaacgcaaagcgtggatgaataagtgcttattttctctgtagagtatgatgggtttcggaagtttgtgtctaggttgaaccgactatttaagatgatttcccgacgaactttaaagtatgattgcctaaaatattttgaagagcagaagctagagctacaagatatgtccagaaactgtacttctaatgtttttgtgcagaaactgtacttctaatgtttctctaacaatggctatgtggacctcaaaccagactagaggatatatatgtataacgtggcactttattgatgctgattggaaggtaaaaaaaagatttttaaggttctcacacttaaaaacattgcacatggatgttgttatattcaatacaatcctagagaccatataagattgtattgtgaagataaattgttttcatcactttggataatgctaacaccaatagtgcaatgtcgaagttattgaaagctaacgttttgcaaaagggtctactgcatgggcaagggaagctattacattaacattgcatgtcacatgttttgaatttaatactctattgtaatcaacatccatgggagcattaagtatattaaaggataa

SEQ ID NO: 71545 - DNA, 1426 bp, Oryza sativa
cagcagggctaattaaatgtcatgggtgccccaaactagaagtaaacatgatgtgcatatgaagtacaagaatcataccttttgagcatcttcgctaaaacaagagaatatcagacccacaaaacctggctccatcaactgaaacattgcctgggtccgaacatctgcagtatatgactcatgtaagtcagatataacaagcaaagtccagccctcactgcaaacgggcagcatctcataagagacaaataaagcataaaagcagatgcactagcgaattccctagatctacattgtcatcgtcaatttgtcctgatatggaccctctactgccttcgtactcagggaagtataagttggtgccataacggaaaaaatggagtaaacccacatgcctaaatatagcattcccaaatacaaaaaaagcatacattaccaccaacaaaaaggaaatgggctctagcataattaacattcgttttccaaacatcagataggataacgaaaggtttcacatcacttcaaattcaaaatggcattagtacaataacacaattgcaatcaaatttcaaaaccgtgcaaagttccatatcatctcacgacatcacaaatacggaatgcgacaaagtactgcacaccaagggggttatcagaaggcgctccagccttagtgaagcacagcaaattggaggtaacttgaaccacctacctacatgggaaggcagaacggtgatatgcgggtgcgagtggtaccatccaatcaccctcgttttctcgccgatggtggccgacaagctgtgcgaacagagttaagtccaactccaactcccgaaaccccaacattaggcttctcaacacaaaaccaaacacacaaaatcacagaaatggaggggaaaaaggatatctcggcctgcgccgtcgccgccgcgagcagctcggggttgacctccaccctgtccttcttccgctcgcacctcatctgcggcgacgccccccatatcagagcagtcaccccgcccctgctcgaatgctgcgaagcaggcaaaaaaccaccatgatctcaacaccagcaagcgccacgcattcgcgctggaggaggagcaggagaacggggagagaggagaagcaggtgaccttgatgtcgccgaagaggaggcccatgacctcctccgtctcggtggtgagggcgtgggagaggcaggtgagccacacctcctccccgatcctgacctccgtcagcgacatctcctccgcccgccggcctcctgccgccgccgccgccgccgatccggtggggtttcgggccgcggcggaggaggggttgggtttggtttggtttgcctcttcgatttggcttgtagcgctgcgcctctttgaagctcggttttttttttcccttttctttttctttctcgtgcgaaatggg

SEQ ID NO: 71546 - DNA, 1214 bp, Oryza sativa
acagtaaagtatttaattaaacaatattaatccaacgctatagagcatacccgttgcataggcccaaactttctgaacaaccattcctggctacacagttctatctccaaaccaggaatataccattccaaaccaggagctaaacaagttataatcaattacaacatcatatattatggtgagaggtgtgagactaatcatgaaagacattgttagacccacccataaccgcgggcacggctattcgaatagttttactctggctagaggtgtaccactgtacccacaagacacaacctcaacatcatgtcaaccatgcgtcgcgatacttaacaagtacccgaatagagattgtgacaataccctccgcataacacaattcaaagcagtgcaccattcctggatcataatcaccctcttataaaacaaggcatggactccccagcgacccccgtgggcttatctctgccacttctcagtctggtgcccacaatgaaccacactatacaaaatgtaaagccgttgcccacgctggcttgtggttggcacggttaatgtttcacaactgaaaatcgtgaaccggtccttaattgtcatgagcacgaccatcaaaaccatgtgctcacaacccacctttaccatgttttagttggcatcttaattaatcatcctatcatgattgaccttcatgagctaccattaatccatcattaagtagtagtgaatcattagttatcccattcatatgagctagtgtctctaagcatggctaagcatcctaattactttagctaaaaccatataatgttctagctaatccaattattaaccaggtgacaaagtataggtaatcaataacaaagggctataacaaaggaaataggtcgttcccacccggtgacattcaaaaataaatgcaatagttgaatagaaacaatagctttaaataggatcaatgtcacatcctcattttcgtttcaggatttataaattatctaataaattattaatagaatttatattaaatattctttaatttacaagtgaagtcaaatgtgggaaataaaatttcctaaatttaaagcatggatggatttaattttcattaaattctccatgattaattatactctctgaaattttctcggatttttcggagctcaattcctaaatgatacaaagaacagttcagtaatatttaatcattaatgatc

SEQ ID NO: 71547 - DNA, 834 bp, Oryza sativa
atatatatccagattcgtagtgttaggatgtgtcacatccgatattagattgattttttttaaaatggagagagcatagcctaccatggctgatggtaaaacatataacgaaactacccgaacttgactcgacagtgtgactgcaaggaccggacatatatgttcccgcccttcaggagcttgaagattattacgttgggttccacctctagatttccgtgtccaactttgactgtccgtcttatatgaaatttttttataatttgtattttcattgttgttagatgataaaacatgattaatattttatacgtgacttgtctttttaatttttttttataatttttttaaataagacggacggtcaaacgttggacacggaaaccatggtttgtctttttttgggacggagggagtaccctccaagcctccaagggctaagagtgtggtggcgactctggtcaatcctgttattttctaattaagattcggattttacatcgttttttatttgcatagttttttttaactactaaacggtgttacgtacgaaaactttctatatagaaattgttttaacatattaaatatgttaatttgttaagtttgtactccctccgtccaataatatagcaacctagtattggatgagacacttcatggcataatgaatctggaccgcaggagtgtctcgtacgttatattatgggacggagaaagtaataattaaagacttaattatatgttaaaattgttttcgttttcgagctcaaactccctccctgcgcgccggccacgagctcggcctccctgatgcgtcgccgcattcacacc

SEQ ID NO: 71548 - DNA, 529 bp, Oryza sativa
ggcaccatggtttcaaatgcacaaaattactcaaatttttcaaaaattttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatatatatatatatatatatatatatatatatatgtcggtggtcggagggtgctactttcagccgcgggggccgggggtaaaacgctacatcccctgcgtccctccgaagaagtgggacgactggaagagcgactggttctacacccccct

SEQ ID NO: 71549 - DNA, 4637 bp, Oryza sativa
ctatgcaaagaacccagaagatgtgcaaggccttcaacccaacacttctagcaccacaagggatcatgtcttttgtgatgaaaaacttcatcactaaaaggctgtttctcatcacaattacccccttgtgacgaattttggggtcgtcactatgttgtcaccactactggcgtcacaagtagcatagtgatgattttttttttcatcacagataatggctctgtttgtgataatcctatcgcaactaataagcagtacattagagatggtatcgtggtcacaattacaggagacactagtgacaatagtgccctcacatatgtgaacgtgtagtgatggaatttttttctcacaatattgtcgacggttagtgctggtttgctcgtcactacatattactaattaccgataactcatcatcacaaatatacctttgctaataacttttctcacatatgatagggtttttgtgataagatattagtttatattgagaagtaaaaaccacaagaagtaagatatattgtggtgaaatgacgtgttatttgttgcgaaaactggtcattctttacaaatgtagtagtgaccaagctaatatgtatatgtgacaatacctttatcacatatgaagtaatgcatcagtggagaaaaaagggtattgctgtaaggaaaacttttatcactaaaaaattaaatatccagatgcaagttttatatatgtgactaaagtcttgccacaaacaacacgtcttttatgacaatattcagcatgtgaacaatgacaaaatctaatgatgaaatctcgatagagcaatggcaagttcaaacattcataactgagcacccctttattcatgaatgattacagtatgctcggaatagagcacttcagaactcaattgaaatatcacctaaactaaaaaggtgtaacgctccgctttttgtgagacgttaaaaactaattcagcaaaatcctaatttcaaaaattccgttatttgtgtgcgagtctaagttgtgccaagatctcaattcaatctccatctttgttccccctcgtcgccatcaaaatcgcccacctcaaaattccaattccgactcaagtctccgaaattcaatcgcctcctttgaatcctcgccaaatacctgtcccgattccaaaatgtccgagtccaccttgaatccattccttggctcctccgtatttcgctgagttcaaatatgcaatttgaattcaaatctcgattcaaatccaagctccaattcagtcttctctgtaaaagtctatttttgccttctccctgttttgaatgggccggatccactctccagcccatctctcccctttgccatctccctcacgtgcgctgcacgagccatcgccgagagaaggatctccctctctctcgttttctctctctcgcgtcgacgccgcttcccgccgtcgccgcccaaaacctccaccgccttcgctcgttcccgcgcgctcgcgcgtggccgactgctcggttgccgccgcgtcaagccctggcgtcgcctgcgtcgtgcgctgccgctctgccgctccacgccgctatcttccaaagccgagagaggcagcccccctcacttactccctctccctccttcaacttttcccgaaacagcaaggagcagagctccctttctcctcctcctttttcgttttgcccgaccaccatcagcgtcaccgcctgccaccaccttgaccacgcccgaccgacagctcctctccttgaacgacccaaggtcggttctcccaaaccaacatcgccacctataaaaacccgagcccctcccatctccctcactcgtttctctcgtcgccacaatcgcgccttgtcgcccctgccctgcagtcgcccttaccatccgtcgccgaagcaccagggagaccggtgcgtgtgaaggacgcgagaagaggactccgggcgccgtcatcttccccttccccggcccgaggtcggagaggttgctcccgcgccgtcggccgctcgtcacagcgcccgtcccggctcggcagtgcctcctcccgttccccttcctcgctctccctcgccccctctagtctgcgtgatagctcggtggcactcccgaacgcgcgtggacatcgccccgagccccgccgccgcctggcatggcctcgcggccattgccgtccactcccggaggccaccgctcgtcgccggccctccttggtactcctttgtcccatccgtcgccggaactggattccttgaaccaaggatatgcttccaccccttttaatcgaacccccgttgctccgatgaagtttcccccttttctcgccaccggtgtgcgccttcctccagcgaatccgatccggtggttcacttcctctcgtccgtcccatcgttccggtgtactccctctctctcgaatcgtcgcgacgagctccggtgaacttggccgccgtccgccgtccatctcggcctccccttcttcctcctcccgccggcccgcgtggctgccacgtaggcgccacgtcggcgccacctcggctttgaccgggccaagccagtcagttgccccctccctccgtcttccctcccgtgcgcgctgtccatggcaagccatgcggctgcacgtaggcccaccgccattcgtccacccggcgcgccgcgcccgaaccacggaaaaaccgaggccagttgagatcagtctccctccgaaaacctagcgcccgctcccgcgtgcgccgcttccaccgtgcaccgcctcactgacaagcgggcccactcgggaccccgcgaggtgagcccggtccacccggctccccttccccctctctctccccgcgcccctctcttgggctgcctccccgtagcccgcaccggcccaataagctcggctgagccgcgcaaatcctctcgggccgcgccaagctactcgggaaagtctggttcctatccctccttccttttcttatccaaagggattaataaatccttttccctttttcacaaatcaattccttattcccaaaattccatgaatcattttctttggtcccgcacgtcagtgactgtcaataatattcttgagaatattatttctataaattccataaaccatttctcctattccaaatattccaattaaacctccgaaatccatatctcccaatccgtaactccgtttgactccgttcaacttccagtaattccataaaattgagatctatataatggcactattatttagtctaaataggatctttattttggtcttttgtttaggttttcgattgtttgcgtatagttgcggttaccggattttcgtcgattgtggttttctcgaagattcatgaagcttcgcgaagacctttagcaaggcaagtcaccctttgatcaatatctcctataattgaaaaatcattattattttgtttgcaacttgaactattagaatcacacctataacatgcttggcctcggtttgcatgtcaaaccgacggacctacccagtagtcacacaaattcctgcaggccgtactaccctgattccttgtcgctccacccttgtggtacttcggtatccggctctctgagcgcgtataccaactactccacatacaccgttgattgtcgataatttgggaaatgggtttgagaagccttgaaaacccgacatgtggtgtcggtgtgtttgaaaataaaataaattgtgaaaactcgcgatgcgggagttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggttggagccaaaccgggttcctggtaagcaaggaagagaagcttgctgaattaccgatcgaggtggttggagtttgatttgtgaaaactaaaatggcctaaatttatgtgaggatttgatccttctatgtggcatgaggtatccctaggtcggcttgggaaaggctttgttgcgaacctccgacaccgacgggtgttcggaataagttcgtatcttgggggtacccctctgaagaggttaactaactgttcgaatagccgtgcccacggtcatgggcggatgtgaggtggttcccgttgcttagatttgtttgcctgtgctttgtgaaaagttattatggtgtgggaatcataaccagaatcagccaatgtggccgatggatgacctgagtggtcagaaacgaatctgtgtgattcgggatgtctgcgggcatcatagactaggcttcccgagtagaagcggattgttgtgctgctgggcagcaggactttgggagtccgagaaaaaggaaaaaggctctgggagacgcttaatcaagtgaaatggctctgggagccgagaagtaatgatctgacccgggtggtcggtacattaccatttgagttgttgaaaagcatctcttaaagtcgaatcgagacgcaagtctcttttcggcccacacttagaaagaaataaatcacttagtgatttcaaaagtggtttcaaacaaaggatttgcaaaacaaccttgcctctcttc

SEQ ID NO: 71550 - DNA, 742 bp, Oryza sativa
ccatgccgagccagtataaatcacttagatcgaaatatatattaataatgagactatatatattcatagcatagccgatcagatagatctagcatgtatcggctaatactccgataccactctatactaagatatcaaagcaagtaaaatatatcaaacaaaagcctaatatacttaaatgcgacaagatcttaacataaagggcagatttaacatatcaatgaagcatataaggtaaacatagttaaatcaggtaagatcggctgaaaccccgatactaccctaatcggcaaccaagaaacaggctagagattgatattctaatcatgactcataagatcaaactcaactgatacagctataagtatgaaagaaggacaatatctagacaatcaagccattggaagtttcatagagtggtggatatcctatataatctaagccaacgtcattatttaacctaatcggctgccctccactgacagatgttagccgattataggttagatagcgatattgctagagattatgtaagatatatgataactcaacgaattacataaacaagattagagtatcataaagatggaagcactaatcccgagaacgcaagccgtcataacaagttttacctcttgttgaagatcaaaaacgatgcagctcaacctgaaagcaagaactcgtcgaaataaaactaaagcaaaaaggtggcgatgcgccgaaattgtattgaacgtgtgtt

SEQ ID NO: 71551 - DNA, 641 bp, Oryza sativa
  unsure (1)..(641): unsure at all n locations
ccccccccgcgcggtcnnnnntttganatgatatcgactcgacgccnnnnnnnnnnnnnnnnnnnnnnnnnnnnnnnnnnattctcgctcgacaaccaaaaccatgcttaccacctgcgatgttgctgacacatataatagcaatggttcttgcggatgtgatgaagctaggaccccaccaccaagaaaaaatatcacttttatttttatcttgccgtaatttaggtttgttttgatatgctgcttgattggaatcaaattttcacctcttgctgctgctgctgctgcggaggggaagtaggaggactatttggtggctagattatgggaggaggggagggggtggtccaaccacttgatttgatgagccgactgatgtgtaccacatattccttcatgaacttccccgagtgcaacttttggctgagcggcgctcgaacatttaagaatcactatatcaatcatccgataatagaggacatcatccaataaagtgtatttcaaggccttataacgcaatttctgcgaagccgattgagatggattctgtaaatactgaaacacattatatcttcattcatcggctggaattgtagcaatctctatttcgatattttttggcattggcttatatcccgacg

SEQ ID NO: 71552 - DNA, 1368 bp, Oryza sativa
cggtgattatggatggatgcttctcaattggtgtacaaattaatgtatggattgtgcgtcgtgctaaattgttacttatatgtatcagatattcagaaggtagctaggcttgttcatcttgccgagaccaactcgtacaaaacttctcgtgcataaaaaatgttcaaaaagagaagttcacacacacataattgtgtcatacctgcacgtgcagtagattagaaggagggtttttttttcggttgtatacaccctattacgtacacggaagaagattaggagtggtggatttttaaaagatctaatctaatggtctaaaataacataacaggtccaccgatttaaataaaaatagagggtttagatgtttcttgccacgtgacggtctaagagtgtttatagagtgtcatatggcggcttagtagcgtttataggatgtttcatggacttttagtatacaataactaggaaggtagcccacggattcacgcgggcatgtatcttaagatgtgtttgagatacttatatagttataaggatggaatattaacagtagaacaccgtcacgcttcgaaaacaatttctatgtgcattttttttgtcatcattgcctgtaattttttttgtcatcattgcttgtaatttgattaatccccataagaagaaggaaaacttagtttgttttaaaaaatatatctaacaaattaacgtaaattaaaaatcctaaaaatggaattattagatcccaaattgataaattgttgtttaaatggaattattagaaatgattttaaaagcctagaagaaaagatctaattttaagtaataaattccaatataaaagtgggtaaatttttattaaatacttcccttgattctacagttcctagatttttcggggatttatttgagccaagaaagtatttttaataaatagaattgcatttcatgaataatttataaggaaaaaggtttaaaaatccttcttttggttttgggccgaaagtcagcccaagtctctctctctctctcaccggcctatgcgcgcccggctcaagccggcccagttcgcccctctctccctcctctctctcccgctgacaggtggggcccacctgttagggtcgtcttccacctcccgccgccagccgcgccctagctgcgcgcaagccgccgccccttccagattcggtcgcatcttttccgattcgatcaaattgatagaggggaaatgatccctttgatctcctctatcttttcccctatagaaactttagctaatttcgtttcgaaatcgtcggattcgagctcgattcggatttgatttcttccctccaaccctaaaccttccattgctgctgttggtcg

SEQ ID NO: 71553 - DNA, 10413 bp, Oryza sativa
cccctaatatattatggcaacatgccctcctattttcagcattttcttaattaatattggaaaacatactttgtaataaattatttaaacaactatatcatctaaatagctattttttatccgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatttttaaaccatatgagtggcaacattttgcttatattagtaaatacaacacccgacacattttctaataggtctaaaattatatctatattttaaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatatttgatttttaatttgttttaattattgttttatttacagttaattaaataattcaatatccattatagttgtattttactatatagaaattaaaatactcctatgcagggcaactgaatgaaattgaaaaattataacagaatgaaaacatgtattatttcatattaaacaatctacgcaataaaaaccaaaaccaattaaagacctttagagcacacttaagtcaccatatgtcacattttaaaattataaaatatttcatttaaatcgatggacccattattttcaaccattagatttaatttacgaaaaatcttacgctgccacgcgtcatgtcctgaaaatcataaataatcttaaaaattttgagaaaaaattaaacctatcatcattggttttaagttacattatttggagaagttataaaaataaatcgcatctacctcctcgcccccttcacatgcgcgcagaccactgccaatcccatccctatttttgggtaggagtaaactaaaagagaaataatcaatatgttaaaacaaccatagtttttaagctacatgtctgatttctaatataattattgctctatttataattaaactaggaatttaagatccgtatccttatattttcctatatacaaaatatggcattcgaccacattgttgacgacaaacccagaagtaagatttaggatctgcacaggagttaagcagatctcctaggccagtgtgtgtttttcacatcaacacacattcagcccatgtgctttgcataccatccaaatatgattcaaataccttaaacaagttggctgcacatattacatcactatacatcattctgcaaacatgtatagctaaattaaatcaatagttatccaaacaaaaattacaaagtgaactatgaaacattttttttattaagggagaacaccctgcccttttacgtgtgatttgaattgctgtaaaagaattacgaaataatccaatacaggttgcatcatcatatgttgtttgtcaaacatgcatagctaaattagatatacattgtctcagcaaatacaactaactaaaatatgaagtccaaaccaccaatgcatagaaaatccaatggctttagttagagaaaatccgattacttcatgatttttttaaaaaatatgtgctaaaataatccaagcaagctaaatgatcttccgtgtatttgctttaaactatgttaccatctaattgactttagatggtgcttaatgcacttttagtatatcattgatatatgttcaagcgtgttgttttggccttctaagcattctgggtaactccgtttattttctttgctcatagaccattcaaaaggtgaatcatccctatatataaacattaatcatctgcaaatatattttgttgtatatatatacttaaatgattaactttggagtccatttagattttatgatataacaagacatggaaatattagtaactaagctccaccaaaaatgtgatcacaactgcgatgaatcacaaggcaacctctgtaggtgcaatgaccacatctcaacacggtgactaggagctgcataaaaccgtatggcgggggaaaaggaacaatgaatttagctaggtcttacattttcatcaatagggcccatagcattcaacaaacaaagaaaaaaaacaccttgcttttaattaaataaacatgttttctaaacaaactaggtctaactcctttttagatgatgatgaagattatatataattgcttatacatattaattaaatactatatagtatatagcatagagaaattatcaaagtgatgcaacgaagaatatttgctgaggaaatgcacttccaaaacatggcggaggctctctgataaatatgatccattttcaaatacagtgcacgatacatgcccgcgcgaatgcgcgggctaccttcctagttatcttaatgcgtctaatctgaaaagaataaaactaaaagatggacagttactgcatcggaagtacactaatctctggatgtagtaaagaaatttgacctttgcaaaatataataaccgcagcctgcctcattctagtacataatcaaagtgggcatgcgaatctaaaaagaaaaaaaaagggtatccttgcaaatcccagcagaaaatcagacaatgcgtcgcaaacaggtgaaaaacggcatcattctcatgccagaatatactgaaaacccgaattttagttcagaccgggtcctcaaatctgaggcggttttctgcaacgaatcaactcttgcgcgcaatcatcctaccgccgactactgaaagaccacagatctctcccactatttccccaccgagatccacgaagttggcgcctggcaatccgcattaatccctcgccataggacgcagcaaaaactacaggaacagaatgcagtagggagcatggaaagttctagaagcgcacctggagaggagagcccgcaagaagagattaccagtggagcttagctgactgagagtgagtgagtgagtgagtgagtgcgcaaccaccaactaggtacagaatctggatttagaccccctgaagaggactcgtttaatattcccaatcggactaaacaagagtgtcttctgatgtcgccatggccggagctccctgcatcagccaatgcgccagcagaaaacagaataaactgaaatggtgacagcagaagaggctcagctcatatgatgaggggatcgtggggtccgtttctttgatctgaactgggtactgctcgaaaccagcggatcagtaaccgtggcccccggtttcatgggcacgattgtgtgggcagttggaatgttgggatcttgctgaataaagaacaggatcagtattgaggcttgacagttgagaggatgggcctctttgggtaatcagccatttgtcctcagtctcaaaataggtacagctatggattttttttcggttttagatttttttttaatatttacagaaataatctatggacaaaaaaaaattgcagaaatagcccctgccgcccacctctggggcggcaagctgacgtggcaaacgggggaggaacgggtggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatgttacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagaggaaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagattgttgtccctggagagtgcacgcgtataaggggaaatggaaggattattggacagtgtcagttattaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttgaaacttacgaagcctcgtatgacaatttgccatgcctgcttggtgttatcgaggaaagaaaccgtaggagctcttacgaagtgaagaaattcccctcaattgaacatcctggcaagagtgtgctgcaaagggcgttcttagctctacatgtatgcaagatggcatttgtgaactgtcgtcctgttctctgcattgatgggacattcttgacaggaaagtatcagggccagatactaacagcaataggggtagatgggaacaatcaggtattgcccttggcatttgcttttgttgagagtgagaataccgacagctggtactggttcctgaaattggttaaaacaaaagttgttggtatgaggctaaatgtatgcctgatacatgataggcacgctggcattctgcgagcgataggagagttgcagtttgggagtatggaacgaggatacctcggtgtttgggaagatgtacagagtaggtggtgcatgcgtcatatgggagctaatttctttaagcaattcaagaacaaggagctcatgaacatgttcaagaggctgtgcaatcagaaccaggagaaaaaattcaatgcgctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtaatttagggatcggttccaggcagttcttccctctatgccgaacaacagcattttgtttggagctttcatgcatgaaaaagctagaggagttgcgtaaaaaggccatgaaacatctagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacagggcatgcacccatgtcattgctgcctcagaggagtgtctataccaaatgtaggatatgtgtcacagtacttcaataagcaacaatatatcatacatggagcggcgagatttatgggttcggcatagctggggagttcacagagactaacgatgaagtactcaatattcctgacccatcgaagctccgaggcaaggctggaaggaggaggactcatcgcatccgcaacgatatggacgagtcggaggctggtagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgttggactaaggcgcctaacgtctttaggtatgctgatgtatgtcggacttcgatacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttattggacccggcgatagatcaccgacaccggtctcaccttactgcggtgcagggggctcagcttgggacgttccgggcacggacgtgcggtgagctactcatggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggtgacgcggacccggccagacgatggtctgtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtacagcgcgcaccgcacctcccactcgagccgttggcacactaccgcaacaccggacctacgaagaggtggctgcttcagttcaccgtgagtgttttttaccgaaatgacaatcgtattacatatttagtccgtagttaaggtgcctatcattttatcgacggcttgtaggttgagcagctacaggcggaggccgacgagtactcctacagccgatgtttggaggcgtacttgctctggctttttggctgggtgatgttctgtggcggtcatgggcacgcggtcgacaagggactcgtgcactacgccaggagcatcgccgatgctgcggtaggcgaggtgcctcagtggagctggggttccgcgttgttggcagctctgtaccgtgcactttgtgagtcttgcacgaagacggatcccagcgcgacctttggtaggtgccctctctttctttctatctgggcagctgagaggattgcgatcggccgccctgaggtggaccagcacgcatacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtttcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgtggcagttcggcttccgtcagccctttccagtaccgtttccgaccaccgtcccagctgctgttcactggtaagatcttgcactacgctttcagttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctatatgccaggcaccgcgaccaggacttcgctcgtgctgtgagtaccctgcatcgcaccattcctttatgttttcatgtctttctcttcgtcaaattttacgaatatttatgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcaggatttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgtaggccgcccacttctcccaggctgcagggtcagcgtctcaggcagctgtgtcgacctcgcactcaacgcagttctggcagtacaccgggacttcgtcacaggcagccggcacgtcgagtcagggtccaccactggaccatgctgggacctcgtcggaccgcttgttgccttccaccttcctcttcgacatcactgacttcgacttcgcttcaggcttgacagaggacgtcatcggcccctcacagctgggaggcgcaccgccggtgcagacgcaggaccaggcgcaggccactcctccgtgggacactcgtgctacccgtgctgtgccaccggatcgttccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcatcgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgt

SEQ ID NO: 71554 - DNA, 2592 bp, Oryza sativa
ccactcattaaatttctattagaaacacatccgcgtgtatgtattatttatggacaccagaattaggaccttagtgggtgaaatattgtagacatgattacataaccacacattcggtgctttcccaattatcaaatgatgtattgggataaatctacttgtatacagtgactatagtcccattcacacagtttactagtactacctctacttctgttcacaaatataatcattcaaactgcttaaaatttgtctaaacaaatataagcatttcaaaagtactacttatcccatcaatcatctctcatttaacttattttccatctttatatccaaccatatccatcatttaataagtagcatttgttctctcatcttaatatctgccaaatacctataattaaattattatatttgtggacgaggggagtacatgctacttgaatgattatatttgtggatagagggatttacatgtgttcgacgatacaacaatgcatagatgagggtgatatagagcaaatgagaagatagagtggccgtacgtagcattcgtacacaagtgacctttgcagtcacctgttgtaattatttcatatagtgatagagtgcaaatcctctttccaaatattactacaaaacaacaattgaagtgttagataattggaaagaagatcagcactgaacttagaagcctgcatatgtgttttttttttaaaaagtcagccttctgttgctcctagtcctgctaaacagcaaaagtctcctaggattaaaaagcaaagcactcatctgttgcaatgagtttaatggtttcttaattgggtgagtcttttcgtttgtggctttgggtgaatgactttgacttcagtaacttatttttatttttcatgctcaatcatgcatccaactttggcagtttataacaaatgcactgcttgagttaactcacacacataagttttccactgatcactaccagaaattaattggcagtagttttgacaaaaaaaaacacaagtaagagaaggtacaatagcatactataaaccagctataaacacatttcgagaaaataagagaggagagagaagagcagcgggctacagatttatagccagctgcagcacggactccaagataaatgtgtatatgataggtaggaccaggtagtaattgtgtagtatactccctccatactcgtaaaggaaatcgtttaggacatcgacacggtctccaaaacgcaactttgacttcttaattctataaaaatatttattaaaaagtgatatatgtatacttgtatgaaagtatttttcaagaccaatctattcatataatttttatattttcaaactcaataacttaagagttattcatgatttatattcccaaggtttgacttaaacattgtcctaaacgacttcctttacgagtacggaggagtatgtgtataggtaactattgtataaattgattattaaattgactatagataatttagagccagtagttggctatactattaaacttgctctaatactactccctccttccctaaatgtttgacgcagttgactttttaaacatgtttgaccgcgcgtcttatttaaaaacttttgtgaaatgtgtaaaactatatgtatacataaaaatatatttaacaataaattaaatgataggaaaagaattaataattaattaaattttttgaataagacgaatggtcaaaacattttttaaaaaagtcaacggcgtcaaacattttgggatggagggagtactatttttcctctatatgactaatgcccttgagaattaatcaaattaaccttgatctcacagatttttcatgactggaaaggttattttttcaaaataagaacataagtaaatattaggaataaagtcagtgtatctttaaataaaatatatagccaatggtgatatcggtgaacaaataatagagcatatatatatagagctcaaatataatgttctccacaaatagtgtgaaaaaggctgctagctagcgtgatatatatttattaattctccaacatacaagtatagttttaacctaccaaattaaaatgtcaaataattaatataccttttaacatgtgtacattaattgcaggcattaatatatatgtcatgcaaaccagtgttaattaatttgtgattcatgcattgatgctagttctagaatttaaacctatacatgtatagggggttacattttatagaagcactcagaaagcaatcagattatcacatgaaggaatcacctttcaggggctgtaatgttcgacattagcacttctagttgcctttggttttatcctaagcctttaatatgcctatattatcttatcatcactgcatgcatgcatctactctcctttacaaaggtctatcctttgctaaacctttcatcaaaaaatacagcgaaaaaaaaagatctccatactcctgattcttgtcttagctagccgacattgcatatataattttgccttaactcctctcttatactgattgacgactggccagcaacatgtttttacagctttgagtttgttataccac

SEQ ID NO: 71555 - DNA, 686 bp, Oryza sativa
ggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgttcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcatttctcgcgcccactatcttgccccctcgtttctcgcgcccacgcttccactaatcccattcgcccgtttgcggtgcatgaggtggatatgcggctgtggcagtcgagatggaacatctcgtgcgcgcattaattacgctcgccgaccgaagcgccatcaccatatctccaagaaaaacgaaccggcttgtcccgatttttagaccggccccacctgtcaccaggccttaggaagtggcgtcacgcccgaccgcttccctcgaggagggcgatcgccctggcataacgccgggggctactgtcgg

SEQ ID NO: 71556 - DNA, 3061 bp, Oryza sativa
agtcaacggtgtcaaacattttaaaatagagggagtatatttcactactttgaaggatttatttatacagggcctcagagcgaagatttgttaagacaaaaggaagttatggccacctccagctttaccagaattacaataaagttttttaaattttaccactttaggataaatcagtaaaatatcctctgatttaaaaaaaaatcacattgacctcctccaagctatacagctagctcctccactgcttacaatcatgaaatgtttacaataatgagatatatttatactaccaaacgaaatagttaaaaaaaagtccaaattaccccctccctccccccctccccctcttccgccctaaaaaattaccggacatttcataccttaaaactctttaaatcgtacgaattaaacccctagaactattttgagtagttttggtccaagctggcacacatagcatcacacaatagtaaaccaatcagaaaaaacacacacataagggccacttgtcatctatctcttccctcattccctctcctctctctccctgcccgcccgttccccctctcttttgatggggttaagtggcagtcgagctcgcacgaaggcaatgacgagcacattgctatctactgccaacgagcaccatgcgccccctcttcaagctcccgcctgcgacaaaggcttgggcaggctaatcaacgagcacctcggccctcgcggttaattagctccatgttcttcgtctccgcgcctctagctagagcggtcgtcagtgctgttggagggataagacgtcttgtgtttggatgaggtgggtaattcggacgatctcaataattcaggggtgatttagatttttttttctctatagctattgcttgagagataagtgtttcaagagatagataccatgggtacaaaatgatcaagtggagagttgtataaggagatcagcgtatgttcgtgctctctagcttagcttgtcgtgtcattgccatcatccatataacactggttgatgacgttcgagcgagagctaatcgttagttagttagcaataaaattatgtgcgcatgcatgtgtagtgcgtgtgcacgcgtggctgcagtctcgatcattaatccgttagaaagccaatccatgttgacatgcaatgtgtctcaaaaatgacccatacaagcatggtaagtactacaacttttgataggataatgtaatagtatcatgcatgcttatgtaagagcagatacaatagcagactattagccagctataaacatattttagtgagatacaagataagagagaagagcagcaagctacagatctgtagccggctgcagcacggactctaagacacaatgtatatatgacaggtggaaccatatattaatagtatagtaagcaactattgtataaattggctattagatcggctatagatgaattggagcttgtagtgggctatactattaaacttgctctaaggaccagtaccgtttgccattttgtaccaagacaagaattggacagtgtgcatatatctagttatgcagaggcccaaaataattatctttcaacatggttttgtataatcttcatgtaattatcttggtttcaaagaaactaactttatcaaagaaagaaagacacgaattagattggagcttgttcggtttggatgaaaagcaaaacattttgatttctaagaaatattttcctgtaagggtcatttcgttttaaggaatcgagtataggaaaaagaaacaaatctttgttcctatgagctgtaaaaagaaaacatagggaatttttcaactcaaatctgttgaaaaattctgcgtgcacctattccttagcttttccatttcgtacaggttcaaattcctcaagaccttcctcgtggtactgtgccaatgagcccaatgagctttcacaaacagttcaaatatacgcatatgtaggtaacttcaacacttaccaaaattaaaaatgggttcatatatacactgaatttatcaggattccttattaattagtatattactccatccggtcaaaacatgccatttaaaatatcaattgtcccctaattaaaatgtaggtttgaccactaatttctattgcagtatatttgattttaaaatctgaatttctacattaggaaagtatgtatttcaagacaaatctccatatgatttacatataatcaagttagcgaaagcggagaaaataacgagatgagtcggtgtcccttaaacacctttttaatatcattttctttatggtggcttcatcttaaattgaagaaggcctttatcacacttatgttttaaaacccagaaaatgttgttatcacgccaagtgaaatagttgttttttttcttgtctacctcctttcaacctactgaagttgcgctcactgctatcctaagccctaatgttgcttctcttaccatatattctaaatcaactgccctccattcaaaacatttgataagttttttatgtttaaagtattcatgctgttaagagggactagcccttaacattcaaatatatacagcatgaattgtttctaatatattcttcaattatttctgtatagaaacaaagttgattaaaattatacctacagaaactatggtacagatttataggatcttatatgcatgagaggtcaattgttggctgaggcacaagtatgcagttgtcctgaaaatgatgcttgttctctcatttgcaatagcaaagatagatcccctcccatacatttaagaacatatagatatcaaaattataatttgggaggtggaaaaagatttgtacatattaatttggctgtgcctcccttatcaaggatggtaaaaagatttttagaaaataagatatgctctaattaggagattgaatatttgaagctatctgatgcctcaagctagacagctgtgggtttttcaaatgcttatatgccaattttgaagttatccctttcacacagctaaaccctgggatattgttctaaaaggcaagttggaagaactgaagaagaccg

SEQ ID NO: 71557 - DNA, 638 bp, Oryza sativa
ggcaacgactttaccttttgtatagcatggttcattgcagggcaccagactgagaagtggcgagaagtccgtggggttcgctggggtgtccatgcctctgttttttttgagggggtgattatgatccgggaatggtgcctgtggtgaattgtgttgtgcgaggggtactgtcacagctcttttccgagataccgtggtggtattgaggcgcatggtgacatgttgtggagctgtgtcttgtgggtacagtggaacacctctggccagagtaaaactattcgaatagccgtgcccgcggtcatgggcgggtctaacaatgtctttcgtgattagtctcacacttctcaccataataaaagatgttataattggtaataatttgtttagctcctggtttggagatagatctgtatagccgggtatggttgttcaggatagttgggcctgtgcagcattggggtgctgtgcagtgttggttaaaattgatgattaattactctattgttttactactcttaaatgtttgctaaatgctgcttttgcaaatgagcctatgtatgcccatcctttggtacccttgtgcacttgcatatttgctgtgtggcttgttgagtatgtcatatgctcaccttgcaata

SEQ ID NO: 71558 - DNA, 31556 bp, Oryza sativa
  unsure (1)..(31556): unsure at all n locations
cggcggggggagagcggacgacggcatcgtggggaggacgaacggcggagacaggtccccgccgccggtgcggggcgcggtggggaggagatggggagacggccgggtagggtttgggccttggttaattggatccatgccactgcaaaagtgcaaatatggcatatcaaaataatgccactcttattcgtcatatcggctacgtactactgaaatctaggaaaattggaaccatgccactacatcacattttccatcaaaaatccccgttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgccatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtagtggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaagttgaaagtttaaagaaatagtttggaactaaacttggcatttgtattgtatttctattcaaaccgaggggttttccaaataaaacataacagggtgtcagtcggttcgaggatatatacgatattccgtgaaaagcgaggagtttttttttgcaaaaatactcaacataaaaaaactcaaaaaagggggaaaaacgcagcatacacactactatcatcgatattttgtttgagatgtgcaacagacaaagcccgaccgaagaaccctaacaatggcgtcgaagctcgtgacggcggtcgcccgtcaagcggcggccacatctcgcgccgcccgcttagctgcggtggcgcgccatgacgcggcggccgcatctcgctccgccggcttagctgcggcggccgcatctcgcgccgcccgcttagctgcggcggccgcatctcgcgccgcccgcttgaagcctcgtcccccactggacgacgctgcccgcctctccttccgctacagcagtgaacctccaggtaaatcataaccaatccctccctgatccctccctgtcctcatggtgcagctctccaatttagcatagtctagataggcaggcagggggattaggatttaggaggaatacacccatctctggtctgtatcaaattcattcaattgttgcatgctattcgtacaattcactgttttcttgagcacttttactgatgtaatgtttgcaaaatggtgattggttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctccatatcctaaaagttattctgatgagaggcatgttcactgacagcttgatccatgtgtcatgtatttcagtgtttaaaaaatgcataccccaggttatgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgtattgcacctgctcttatatacttcgcttattcgggtgtccccttgtcgaatttgcctttggtgctagtcaccacacgtgggcgttatatttttaatttcttttatcaggaccgggctgccacgtgtgcgacacgtaagaccaaaactgttccgaagtttgtcaggggtaattcgtccatataaaaagttgagggtgcagtttttgaattgagggggtaatttcaactgccacaatagtttagggggctaatttgggctttttccttaataataccttgatagtagcatcttctcatgacctttatagttccacctccccgtgacatatattgttttgaccaaaataatgcagacctcattgcggctggcattcgccttccaccgtcaacgccagtgatggtgtgctgcatcggcttctccctgaaaaagacactgcaaaggatgactctgccactgcgcaaaggatgactctgccactgggatgccaccgacgaagttcttggcggaattgcatttgatatgtcaattcttttttaaatttgtgatggtggaattgcattctgattttcaaattggaggatattaaaatctagattttcattttttacactagaaattctttttgtatgtgggtaaattaagtgtgccacctataaaaaattgatttttgcaagtgggtctctaaggatgcttgccttcgaaaactgtagatcttctcaagccttcaatcataggcagggtgtgtggccatgtgcaaatcgcgttttgaccacctcgaaaaaaaatcttgtttcgtaatagtgcacttgacttatgtaattatatactttattaattctgagagtcactgacatctagcagaaataatgcagaactacatgctagctagttccagtagtagcttgattgatttcattctcttcttggtggacgtttagggttatggcggtggttggctcctggcgtcgggtagtcattcacctccgcattcgtcgttgccgccaccatgtcctggacggacatttctctccccagtggacgtttagggttatggcgaggattggctcttagcgctggatagtcattcacctccacgtccgtcgccgctgccaccatatccctgcatggacatacacaaagccatgttcagaatcactatcaccaacattactaattgtttcagaatttagccttcagaaagtacatattcattttagaattggtttgtaaaggtggctatgaactgtctacgagattttgtagtaacatgccaacaaattaatttaaatcttacgggaattcagaaattgaaggacatgagaaagattaactacatctgcatagatgtttcgagatgacgggtgttgttgttggctgctcaagtgcacgattcctgcaagaacgcatcgacacgcaaattataattatcaactagtcaaaacacatatcaagaattccaggagatctatgacgacgaagctttacccgacacgggcaccgaggagacgagtagtgggaggagcaataggcaggacatagccaggacggcggcgagatcacgaggcctcatttccattgcgcggcacatgcaggaggtagcaaccgaggcagccaagaatggccgcgagaaaaaagagctcgtggctactacttcgtttcacaatgtaagactttctagtattgtccatattcatatagatgttagtgaatcgagacacatctatatgaatgtgggtaatgctagaaagtcttccattgtgaaacagagggagtatttgttttttttgggtgtgtgtgatctgtgtcggaggagacgatgatgtatggatggatggcactgggatgggtagttgactcgtagtgttgggagaaagctacccatcggacgtccgatgaaaaaaaaacggatggtcaaatattgcagttggccaacaagtcaaacattagttatatatggtgaaacaaaaaaatcagcaactgaaacatttaaatattttatgaaacatggtgaagatgcacgttgaaacaggtcgctgtcacatatgaaacagcaagtattaacggatacatgtgtttttctttcaacaaaatataatcatgcaatatcttgttgtaaagatttaattaaaacgaatacaatggtgcgatcggatcatagattggataaataatttaagagaaaaattattttgaagtttgctaaaatacatgcatgtgtgcatggatgagatggagagaaagtagtagcagttagtttcaaaaaatttatgaaaggaaaaggctatacgtactaactttttcttactaaattcttactaatactgatgtgtcatgctatgagtgcatctagatttttttataacttctatctacttaaatcaaacggttgaaatgattgttagtaaaagtttagtcagaaaaatttagtacgtgtagcattgctctttatgaaacacacggaagacgcacattgaaacatatcactatcacgcatgaaacatttagttttaacggtttgaaacacatgtttttcttttgacataatataattatatgatatcttgttgtaaatatttaattgcaacgaatacaatagtgtgattggttcgtagattggataagtaatttagaagaaaaaatatttaaagagaggaggaaagaatgaaaagaaatagctaggcatacatgttacagtgatagggttcgtccgatccatcaggccgctgatttgcagcatttttagtgtggtagatgaggcgtccgatatttctgtttcgtcggacgtgcgatataaagcgttttccatagtgttgctgtcgctaccttggggagggggggtacttatcaaacgttggatgaatcatttacttatccgcgttcatttgtgatctgtacccctcctctccacctatatttagctacacatcacgagtaatccttatccatttgatcatgtttagtataaaattagctattatatcaaggagttacttatctgtaatgataactcttctcttatgctgggccaccattttattatgttaatacaaatatatcaacgttggattaaggagttacttatttgcattcattagtcatctctacccctcctctccacctatgtttaggttgagtaatctttacccatttgatcatgttagtacaaaataaactgttggatcaaagagtatctgcatttatttgtcgtctcttaacttgagccatttgattatcttagtgcaaaaacatcaaccattggatcaaggagtaacttatcctcattcattaggtatccctacccctcttctatgcctttatatagatacacatcatgagtcatactatgtcatttgatagtataaaattatcaaccactggacaaaggagtagcttatcctcatttatttttagtaatttctagcccttctctccacatttaattagatttacatcatgagtgaatcaaaactaatttgattatgctagtatgaaattatcaaccattggataaatgagttgcatgtctgtatttactagccatctcttatcctaagccatttgattatgttagtctgaaacaatcaaccatttgattaatgagttacttacccgtactcattagtcatctctatccctattctccacctttaacaaatatacatcatgattatgctaagtcaatttatcatgtcagtataaaacaatcaatcgtgatcaaggagttacttatctgcattccttattcgtcccttcctctcctctctaccttcaataaaacctgtagagtaacacctcctcatgacctatatagttgtgacgaatataagcacatgcacgaagccatgtcatgaacaatcctaagccatttgattatgttagtatgaaattatcaaatgttagatcaaggagttacttatctgcattcgttattaatctctacccattctctccacctttaattggctacagttattaacaatcctaacccatttgatcatgttagtttcaaattatcaaccccgtccgctgccacgggaacagccgctgacactgccctaccccgctgtcgacgccactgatgtcgtcttgcaccgagaggggaagggggagggggaatcgctcgcctccgcctccaagaggagcagcatcgccttgtcgcccacctccacctcctcggttgggtaatactgtttttttaaaacctgcatgtgtctttttagtagtgttcacatttaaccagatacacataatgggtagtcctaagccatttgattgtgttagtataaaattatcaactgttatatcaaggtattacttatccacatttattagtcacctcttcctctcctctatgcctttaataaatacctatatggcaccgccacctcatgacctatatagttgtgaccaaaaataatgcagacctcgtcgtggccggcctctgccctccctcgccaacaccaatgatggtgtgttgcgttggcttctcccaaaagaagacgctgaagaggacgactccgacgttgggatgtcgatgatgacgtccttggtggaattgcattgtgaatttgtcaaatctttttaaaatttgttatggtggaattgcatcatgaatttgtgaattggaggatattaggatttggaatttcatctttttacactagaaatccttaggtgagtgacttaagtgtgccgcccgcgaaaatcaatttttttaggcaggtcttttagcgtgcccgccttttaaactcgtcgattttcatgagcctttgagggtaggccacagcgaaaaaaacatgtttcgtagacaatttataaattctaggagttgccaatacatagcagagataatatgaaactacaagcaagctaattggagcaacagcttgattgataaagtatttttgagtcatatctatgaaagtatttttcaacgttaaatgtgcatgcatagctctttagcctcaaacaccattgcaggcaggcaaagaaacacacagctaggatgtacattttgttagaaatagaagctttctttgatcttagtcaattacatcaaaataatacaattgtgcttggagtattctcgatctcggtataactaggatgtacacaaccaagacacacatgaaccagtttaaaagaaagaaagtaaaaaaagtattaaggaccatcaattttaaaactagaccgtcacatatgtttctaggtaaaatactcattgatcacctactccaagtgtagacattctgtaataaccaaatcccagcccagcttatatagtataacctggatgtacatgtgattttacttcgtttagtcttattttcttcattctttgttgcctcagcttcatgacgacaacctgtaatacaacctatttcttgtcctaattaacgctggcacgaatggatatacttaaagcaatcaatgattggttttctcgagtggtacaggatttattcacgcactgttagttactccttgaagcaacaacattctctcagtcaagttatgatcgtgattgacatatgtcgttaggcttagttaaggcttaaccaatgcatgacggctttggaagctactaagatctgccttaaaaaaaacaaattctagctacaaacctctatacgtatatatctagattcgaagttaggattataattttttttacaaagaggataagatattgtacttgatgacatgttggcattgcttcaaccgaatatctgctaggagtaccatgttttacaacaatggcttccatcggatggcctattcagccaaagaaaaaggcaaaatttaaattttcaaacttaattttaacattgattttgtgatattttcaacgtagtttctttttcagcattggcttttacgtcaccgagaacacatatataaaagttttacctacaaattcatttttattctctaataagccgttttggcttattacgaaaaaagccaaacgatgaggcccacagacagtgccacagattatgaaacttttttgggtgttggggcaaagagaagttatactgagttgtatgtatcatccagttcaatataaactataaaaacttagctcataaaaaagacaaacaattcacttatactttaatataagggtgcgttcttttctaagtagctagtggtagattttcggctgcactttttcacgaacgtaagataaaccattggcgcatgattaataggtattagttattacaaacttgaaaaattaatttagttacttctatatacaatttttttttacaaaacatatcatttaatcgtttgagaaacatgctaaaaaattacggtttggggttgatgaaaagaactcagtctaggtacattatcgactttgttgcccatgtcactcttgtttccgtggtcttggctggttgctcccaagtcaaaataatgcagcttaaagaatttgcagatatactttaatctgaagaaaagaaatactttaatttgacaaccggtttcaacgcttcgatgcaaaaactgcgtcatttggctcgtcatcttccaatcttggagatagtactgcacatcaggacattgatcataaagtcaatcacatgacaagttgctcggtaccgggtagtcaatctttttcatgtagaagtatatattacgagaataaaagctatacactttaggaaataaactaaaaatcagaaattaaaaccttcaacctttttagattctcaccagctagctactactcactttatactttgtatgctaagttctagagagcaatttacaatggcaacttactcgttcttcttcgtgaacacacttccagaattactaaacgttgtgtttcatgtaaaagtttctacacaaaaaggcttttctaaaatcaaataattctatttttaagtttataggaaccgattaattatgcattaatagattattttattataagtgccgccagttagctgagccaaaatgctcgttcgaacgggcccttggaatctacagctttcaagcaggtccatactccatagtactatgtggctagtgggctatagtggccagtgccaggagcttaaatccaagcgagagcagccattggcaaaggctaatcaaagcttctaatagtctgctgagggaatcatatgaaccatgtcactgtcggactgtcatctacaacgttaaaataagtgcagtcgtgggtattcgtgtctaacgtttgaccgtctatcttatttaaaaaattatgaaaaattaaaaacaaatagtcatgcttagagtattattcatgttttatcatctaataacaataaaagtaatactcataaaaaaatttcaaataagataaacggttaaacgttggacatgaacagtgtaaaagtgcacttattttgggactgaaggaggaaagagtcctataaaaaccaatctaggattagatgtaatgttttctattacaataaatctggttaaaagcctgtttaaattcattatactagaaaatatctcttattatcttaatttgattttttataggacaaaggaagtatgttgttggagattccattgaaacttcatatgatctcgagctggtctagtgatcttgacctggttagtcacgagtggtcgactgatagttgctgccactgttcatggacagaagaactactgatgagatttctagtactatgttgttttttttctcaaattaattcagtgtgctgctgctgctaaagtctgaaatttattcagttgaccctccacaccgatcactaaacagcacattgatgctgcagtgcagtttggccagtcaccactacagttcaggtcaaaaccacacgcgcacgcacacacaagttctctgcactaacagcagtcatgtcaataatctccatgtgattacaatttacaactcattcctgcattaaatttgactacgtcgactgccagatattttgtcaatggagatatcatccaaattaacaaatgtccaatgctgtcatcgcaagctagtgcagtgtgagttgggcggcacaagcaagcaaacaacgagcagtttagacattctgaagcgtttgcataatgacaagatttgatttcgttgtttgttctcaagtgatgtaagaactagaaaacttttaagattcctctaaagaaaaagagaacttttactatcgctgtgatgattcaacaagatttgacatgcgtaaagttaggtattcctttcgtctcaaaatataaaaaaaattaattgaataggatacgttctagtactacaaatctagagctatttataagatatgtctcatcaaaccaaaatatcttatattttagaacaaagggagtaattagagaaactataagagcatgtacaatagtagactataagccagctataaacatattttaagaagataaaagagaagagataagagcagcgggctacagatttgtagccagctgcagcatggactccaagatacatgtgtgtatgataggtgggatcagacattaattatgtagcacatacttaaagataactatggtatgaattgactattaaattaactatatatgatttggagcccataatcggctatactattaatactattaaacttgctctaatatacagtttaatctggcggtaatgcatgcatgcaagaaaaagtgatgagccatatgtgcgcaggtgattgatttggcgtcggttccaaacacatttaaaagcaagtttaatagtatagctaactactgactcaaaattatctgatatagtcaatttaatagctaattcatataatagttatctataaatatatactatattattaatatttggtctcacatgtcatacacatattgcgttttggagtccatgctgtagctggctataaatttatagctcgctgcttatctctcttctttcatctccttaatatgtgtttatagctagtttataatctgctattgtacctgctctaaaaacatgattgtggggttatgtgtagtataataagcatctgcgtgtgaaagttaaattaaaaaaagtatgatcaatctattggaaattgtgtcgatagccaactattatatgtatgatctcttggtcacctgtaatatgacgtaacgcttttaattgttgacagttatgtattttatacactggacccttttgatttggaggaaaaacatagaaattttaagataacttttatcctatagaaaagatttcaaagaatggctttgaatcaaaggattgaatcatatccaatcctttgaaattcctattgaatagataattctacagagatttttgtagaaaacttagcaagagctcaaaactcttagaaaatttcctttgagtttatctttctcatatgatttttttcctacggtacaatcacatggtatttcctgtattttaaattatttgttttacacttctatttctgttagaataatgggtttttcctattaattcgttttcttgttcctactatttaaattggccctaatctctttttttaaaaggaaaattgactctaatctcttactggcgtactactccgtcccagaaaaataaattatagctacgaacctgggcacatatatgttcaagttcgtaactaggattgttttttagactgagagatagttattcaagttcgtagctaggattaggattgtattttttagatagaggggtagtgctgctgctaatagcattattacgttacccagaaaggttaattattactacgtgctttgatcatgattgttttttgtggcagtaagaaaatttcttgtctttgaattcgagtttagtggatgcatgtctgcatattgcggctattgccgtactactcggctactcctgctttcagatcgatttaatgtttggctgagtataaagtttaaattttggttaaaattagagatgatgtgactgaaaagttatgtgtatatgatagattgatttaatgaaaaatgattaaagtttggatctaaactttaaatctaaacagcctgtacagtggccgtggaccaactgaacgtacggcgacaagtggcatggctcactagaaaaagaaaattcgctgtcagcttcactccggatcggacggccacgcctccagtccacgacttttttgatcgcacgtgttagcttttaaaactactctagctcgggtcgcacgtgtgaatggaagctgtttcgttcttttgacctcatcgattttgtggagcaacagtacacgcacgatggaaaacgcacgtcgtttagcgagcgtgtctattgacaacccattttaagagcgagccacggagcaaagagcgtgttcttaatactctggttgagtttatttgttcacgtttttcacttacttctctcgtttttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtagtgagatacggaaaccccaattttgtggggggggggggggggggggccccccttcngcggatggcaagatggggagacggcgtccgtgagagcaacgatacgggcagcgtgaaagagcgccgaccgccgctacttgatggtgcgggaccaactcgcgaaggcgtgatttgtgaaggtgagaaagcgccaaacgggcgtgcggcgtgtgatgtgttgcgtaatttgtggaatagcgtcaaaagtcaaaactactggaacgagaatagagattggtggcggcggcgacaaactcacgggattgattttacggcccgtttggttggagggagtttttaagaggaattggaattagagggatgaggctattaagtattttgtttggttgggagacatggaaattttggtgggattgggatggggaattaaggaagaaactccctccttttcaatacctgggtaggggcaggtaattgggagggaatttctcctttactttgtctaagcaaatctcagccatccgtttttattaatgagctaatctccaactaaactccctatcagtttctatcacatctaccaaacaagacattgggattaaaaatcaaattcccatcttaatctcatcataaattccctcgtgtaaactcctaatccccttccctcaagttaccaaacaagtcttagggttggcttctctttactgatctgtatatatatatattgggctatatgggcctaaatttgattatgggctgtatgccatattttagatccctatattccggggccccgtgggtcacccgcgggtgagcctgtggccccgcccccacccccgcatagttccggtgccccgtccccgcagccccgcgggttgaaatttcgccccgtccccgtccccgtaggggtgggtacccggcgggtccccgcccccaacgggaaaattgccatccctaggttctacagctacagctttttagaatctgaatgaaaatctagattgtttgagggaggatttgataactagtgcttctagaaaaatcttcagctactaaaagcttccccaaacaggctctatgtccgttctttctagtacttcatagaactagtaatttacccgtgctaatgctacggtgtaataatattttgattaataaattatattattaaatttcatgttagtcaaattacatttctagaatcagtctcaaatgttaatttaagacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacgagtgcgcaggtgtggcggtggccggccgtcgacggcgacgcttcatattgaagactactagcaccgtggatgctcgccggccgttttgcccctcagcttgtctgctggcaaagtcgtagactaaacagatggagtagtaaactaaatcacgtctactatttatttttttcctacttaaatattaattaaaattttaagtttgatcgaatctatagaaatgaaatgagtatagctcaactagattacttgtgatggaaacagctcatctgagctcaaatcatagaattgacatatatacttgtatttacggctaattatattttcagtgataggcgacttacccatcgacagataggcactcgtggtgacttcgttaatctcaggatatgccgaccaagtcttctatcgacacccatagtgacttcgtctcatcaacctcaaaatatatcggtctagtcttctattgacgcccgtggtgacttcatcgatctagagatatgctggtccagtcttctggaggtgctcataggagtgggtgtgtgcacgttttgagcgcatgcatttattctgtgtttctcaaaaaatatagtacacgaaacaaatatattatcaaaatatattaaatgttaatgtgtttctagaaaagttatagaaaaatataaaaaaaaattttgacacaaaataaatatattataaaaatatattaaatgttagttttaataaaactaatttggcgttattgaccttgctaacttttttttaataaatttggtcaaagtgaaaacaatttgactacgaaaaaaaagttagtaccaaatatacgcacttcaactcaaatataaacagaccctagtaggaagatgctctctcagatgatgtaataaaaacgaagagctattacaaaatgggaaaaaagatggttaagcatctcgcagaagaaaatgaaaaaaaaaagcctaagcaaagcagattaggatgggccacgggcccacggaccatacgcataggattcaacctgacggcccacatgccgatggatcgggcccatataggcctgttcctaacttccccaatcttaagcccggcccactcgtgagctctcccccgtctcataagaaaccctcgcggagcacacgctgctcccccctctccctcccgcgccgccgccgccgccgccaccgccgcatcgccgctgccgacggctgcgctccgaaggtatcgcgtcgaaatgctcttcgtctcgcctctaccaccgccgcagatagttcttgcagcgtctatgcctctgctgccctttacatttccctcgagcgactagaagaattagggcgggttggtcgttgcggcggtcctaggctagattcgagaagaagaagaagaaatgccggagatccttgagcttgtaaatggggatggtttcttcttcttctctcttatagttgatcttgacacggtgtagtgcggtgtatatacatctgttgctactcctttggaggcaggattccggttttcttgagtatgtgacaccgtggtgattccgtttgatttgatttaccatggctagctgcgcttctttgatagattctggattatttgcctagatgcgtgtgaaagcaccggtactgaggcgctatggccattgtgatggccgtagcagcctattcttttgtgtgctatatgaaccagggaacccgctttgcaggggagatttgtcccatgtttcttctgccagtagtcgcccgacagttcacccctttctggggttctggattacctgtagtgtagtgcgatgtatatacatcggttgctactcctttggaggaaggattccagttttgtggagtatgtagttattctgtttggtctgatttatcatgactagctgcgcttctttgatagattctagatttgttagatgcgagggaaagcaccggtactgaggcgatatagctattgtgatggcgtagtagcctattcttgtgtgtgctatatgaaccagggaacccgctttgcagggaaggtttgtctcatgtttcttctgccagtagtcacccgacagttcacccctttctgggtttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggaccagggtagtatccttgcagcaggagctaagctaagttgattatgcttctactgcctgtagaatccctacatttttaatagttaaaatttgagatgattaccctgtctgtgtattgtcgatatcttgatgtaggtttttaatgttccatgattacctctgcacaattttgttttctggattctagtcctgattcctttttcttttgatgttggaaatttggcagaattctgtgaggatttaagctgagaagatggtgctgaagtaagttcctgtgtatattttgttgtttcaatatgattgtagattgttttagtgcccttttatcctgtgcatgctctaggctatgtagttttttggttaatggtagtaaaaggttaatagcaatgatttaccaatgagtactatttcatatttggaaggtatttcaactattacttttatttttatcctacaggacagagctttgccgttttagtggccagaagatatatccagggaagggcattcgctttattcgtgctgattcacaggtcaggctgttcatcgaatgattgctttaatgtcaggatatttctctgcttagaaggttgttgtaaacgtattggtatattgtacaggtcttcctttttgcaaactcaaaatgcaagcgctacttccacaaccgcctgaagcctgcaaagcttacctggacagccatgtacaggaagcagcacaagaaggtattgtatctagatttaggcgggcgttttctcacctatatgcacatactctaactggatgacctttaacccttttttttttgttcactgaccgttgctttcttaaatttgttgggttgagccgaatgcttaaaatttgtaatgttgtattgtgcttgaaatgctaagttaattgtttcttaagctatcaaacctggattccagtaaatgtctgtttgtatgattaagtgtgaccgtctacattcaagattgcggttttttttactgtgcaaacatcatgttgattcttcaaataagcgccttgcagtgtttgcgtgcagataaaaatattgtatgtttgggtactttggttatgtctgtgccatgtagttctctttgtcagcttatgctcaattccttgtatatatgtacagttagtcatgctatgtattgcttccgatcagataaattctgtttacaccctttcccaacaatctgcattttaggatatccatgctgaagctgtcaagaagaggcgccgcaccaccaagaagccatactctaggtcaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtctgctcctagtgaactctctgttcatattcatgcataatcccctattgcatcttgtgtatgcataatcctccgatatacatttcgatgatgctaaaggactaaattcatctgagcttatgcattgtgcagtgagatcaaggaacgcatcaagaagaccaaggatgaaaagaaggcgaagaaggctgaggtaaccaagtcccagaagtcgcagtcgaagggtgccgccccgaggggttccaagggcccgaagattggtggtggtggtggaaagcgctgaagatttcttgatccccaggaaagggtcgcctggttctcgccggctgtctaaatcgtatctcatcaaaagctaccctgtagaacctctgttaaattagcactactgccaaaatgttttaacatcgccactggagataatgtcatgaagtttgaaatgctatgtgggaaaaatgtttttctttggttgtgttactattacgagatttgacttggcttaatgtttctgagcaaagtttgatgctgcttggcattttaatcctcttgtgttttgttcggtaaagagcattggtgttcatgtatcatgatctgaatgctcgttctgaattgacggccctagaaatcccatcgtattatattctctacagaaatataggcttttgaaatcctgttagtagcgttaaaagcgaatttgacttttaaagtttcaccattttttgcgaacgggtagcaggaaagctaaagtacgttcccttcaaacaggctagactttgtagtgtccgagtggatttatttctctttccttatttacttgaaaaaatattcatgtgttgcaacgggtaaatgctattttaattttattattgtttacggtttagttagataaaattcactgtgggaagtcgtttggatatttttttcaggaaatcatgagctacaattaggttcgtatttcatctcatgctagcatgcgagtttttttaaagatttcttatacgactcctattatacttccaaaaggaaaacaatcttaaaatctaactcaaacacgcatctgtatttccaaaaacgaacgaacttaaaacctgactcagatacggatgacgtaccaaaataccagtaaaaacatctttaagttttaatttttataatagtagatatttctctttctttatccaggatttttgctatatgtatgagacttgatttcgtatttgatgtattaagtattgggtatcccatattcagggcattaacagcatgcatcatataagttaattttagggcattaacagtatgcatcttagtataagttaattttttttttttggtcttgcttaaaaaatagtaaatactatctttattccataaaatcaactactgactatgtatttaggttaagatatacaatcaaaaattggtttttatgggatggaagaagcatgttttagacttcagatggaggaagtactccctccattccaaaatatgcaggttcttgaatggatggaacacatcacaatagtacaaatctggatgtcttaagaatttaaatgtctattcaaatttacagtagtaagatgcgtcacatccattctaaaaccctttattttgggatgaaggaagtattacttaacatattactaactgtattacgatggaccatgctactctgcattagagacgttgtaaggcagaggatcaacatgattactataaattatgggagttggcagccatccgatcaagggcataaggcctatatatctcaggccgagtttagctctaaatttaattttttcttcaaacttctaacttttccatcacatcaaaactttcctacacatataaacttctaacttttctatcacatcattccaatttcaaccaaacttccaattttgacgtgaactaaacacatcattactacactaaataaaagtgtgctacaattttcatgttattgtagataccataaatcgacggtattcattacattgatccactgttatactcacatacttcctctatctcataaaaaaccaatttagtactggatgtccagatttgtagataggatgtgtcacatccaatatgttagttttttatggacggagggagtactccctccattaaaaaaaatcaatcttaactataaatatagacacacgtgttcaaattcatagttggaccataattttcatggagaaaatgaacatttggccacgttcaaaacacggtttcgctagaatgccaccccaaaaacacggttcgataaaatgccaatacgaagcgtgcatctgttgtcactttgccattttcaccattttattcatttccaaaaagattttggctcctccgctgggtaataagacggaactgccccttatcaccctacggcgttgatattcttccccatcccctttcttcccccactctctctctccccttcggcatggcggtggtggcagtgcgagcggtgtgtttcgacaaagggagtggcgcagggacgaagcagcttcgagcagagacgcggagctcgctgaagatacatgcgcggggatgagctagagcgccatgaccactgcgagcttggcgcaccctttagcgagctcgagctcgagctctactcgtgtggaggtggaggtcatgggcgatgtttttgtcagtagcgacgacatcgcacggaacctcatcattgactatggctctggcaagatcgcgctcaccgccgcgtgcatccacttccgtatccctagcgctgccctcaactcccccttccaccactgcgtcgcttcggtcctcccaacaattgctttgctgtcactaccaccgaagaagaagccacttccgccgctgtcaccgacggcggttgctaagaggagcccacaaccccctcagcctttcgtgcttcggccagtgcggcggtgtggcccctcctagccaacggagggaggcgcaagaagcagccggcggcggtgagggcgtgaggcctttttttttttttttagaaatgctcgatcccctttcacttgcgagatgaagaaaaggcaagccggaggggtattttcgtctgatcaccacgtgaacagcaaaaaaaacatttcggaaatcatgaaaaggcgaaaatggcaatgcgacgagtagcgcgcgctcgagattagtattatatcgaattacgttttgaggatgacataatagcgaaatccagttttaaagatagctaaacgtttattttctcatttttcatgggacggaaggcgtaaacaataaacctctacaataatgcccaggattcggatctcattggatgtgagaagagagagacagcgagcaaagcgaagtgaactgactgtgaagtgaccgcacttcggctgcattaactgcatcgtctcggctaggctagggctaaacacgtccagagaccaaaacgagtcgactcgtcgtcgtcgtcgacactcgagaggcacctgcactactccactcagctcacacgcaaaacgtccgcttcgtctcgtctccctcctctcaaaccgcctcgtctctcgcgccctcctcctctcctctcctcctctcctctcactcgctcactcgctcgccgacgctgcccgaggcggaggcggcggcggcggcggcgaagaggccgtagcccgcttcgctcggcggatcgcgcgcgcgaaccgggcggtggaggaagggggagggggagggagaggggcggagagcgccatcgccgaccaggtgagcgctttgattcccctccttttccccctctatttctgaccctccggctcgcacgtgtctccccctcccacccaccatctccggtgtggccggccggcagatggtcggcggcgacgacgacggtagtgtagtgctgcgggtacctacgcttccccgaatttaaattttgtaacctaattttggtgttgattttagggttctcaccatagtttatttccaacggttttccctgaggagaaaggagaagacttggaatatacagtacgtaaaacaagctgaacgcctgaactagtacatgattaattagatattaactattttaaatttgaaaaatatattaatataatttcttaaagcaacttttctatagtaaatatttttcaaacacgcactgtttagcagctcgggaaatgcgcgcgcgaaaaacgaaggaacccttctccctatctgccactcttacaaaagaacacagcaaaacatttcattgctaagaacagatataaaagttttacccacaaattattttgagtctattcaacacgctgcattcatttcattagctgcatatatatttgtgtactattgctacaatgatcaacagaattagcagtgctatacgttttgccccctttcgaagtccaaaatttggcgctcttctgcctcccaggaacccctcctcgcttgattgcttcgacaactttaagcagtgatcattggaatataactccactgtgaatggtgcgagatggttactagttttttgtcagtaagagatgcatgattactcctgtcctgcccctgaatcagggttgcattgtaacaacggacatataaacgcaaattgaatttcctagtaaagtgctaaaggcagggatgtgtttgccaatgaattttctttgcaaatggtctagagtttggattttaataatgcgacgagttttgtaattccaacttgaattgatctcgtttttacaaacaagactattgaaaaagttagggatatgctacttatgatttgattaatcaattaatctgggggagctatttaaataatgatgggactaatattgtccagctgtgctctcagcttcaccctactctcatgctgccttgtagatcatgagcacaatggctgacagcgtatttggagaaagggacagcagtaatctcgagattcttcaacgaagtcatatgaacagcaattagttgactaggcaaagcatctttctgagtaaatcacgtcttgttagggtacttcagttgtctttcccagatctcttgtaaaattctttcctcaagtcctgcagatttgcatgctcaaggacaaggacctacacattatgtggtggttcatgcaaaaaagaaaaatcaagtttttctataatatctacacatatactcaacagtttgactgtatacattttttctattatagaataagacagcattggctgcagagggttcaaatgagaaagctgcggtagatgcaaatgaagtttcattgcctctttctaatctaagcaacactcgacaacattctgatagagaaaacaacatgcctggaaaacatggcaacgatggcatgtcaaaagacatgggacgtgctactagattgaagagactgcaaacgccaatcaacttatttgaagatgaatgcgttttctgccattcatttagaacacctcctcaggtgaaccatgatctattaaccagaggttatgttttgaggtcttcttaaccatttctgacactaaaggtcctcacttttcctatttcagtttcatggtccaatggcgcattatcaaaagggaaagcttgtgtccagtgacaatggcagtccatgcccaacagatatcatttatgttcataagaaatgcctggagtggtaagttcctaaatatatttcaactcttgatgcttattcaccacaatttagatttatcatcatgcgcttccaatgcaggtttaagatacaaggatgctggacaatttttatttttatttgttgagatctggacccttgtataattttttagtttaataccttattggtttgctttataagacaaccattccatttgtttaattatgtccaaatattagtcagtatgatatatagttttagtggcatgcaagaattaccattttgattcctatttcaaagtaaattcacatgatatttttttttagccattaaacagcctattcaatgtttgagacgtgctaagtctaaccatacctaataaaaataaccagtggctggagtggtattaaagtgggtagttgaggggtgatggtgcgttctacatccccctccctccatcccccatcataattttgttgtttgcatgatatattcttctgcaaaaagttgatttgtttgcacatgtgtatgtgtagatggttgattgatctcatgtagtaatttttcaattttctagatttggagacaattcttatttttagtatatttagctttacattataaactatatttacttcttccagtgcaacagttggcactagctagttactctcaaaggactatttcttgggtaaattgtttgtctttccctacttttttcttttgcgaagggccccgcaagtattttacgaaggtgataccattgtgaacttggagttggaaataaaacgtgccgcgaaattgaagtgcaaaagatgcaagcttcctggagcagctcttgggtgttattatacaaagtgcaataggagctatcatgttccatgtgcaatgatgactttgaattgccgctgggatgttgtaagctcttgagaatattgtgtaatcgatccttttgtttgtgatattcgtcaccactctaatagtctaatgttctaagctccgagatgctaattttcattttgcaggataacggttgtgttatgtgccctgaacatgcaacgatgccactaccatgtgataagataagctcgccaagaaatgagagtggcaattcttcttccttccctcagaggtttttccatgaataagaaattgttattcaatcttattgctttcttggaaggttatacaaaggctctggtatttgattaatcattgatccttcatttgtatttttctccttgattctgtgttccagccaatcgtcaattgaacaaagcgattccgctgattgcgaatgggaatatcctataatagatcaatggaacacatcaagttctttgtctcaagggtatatgacctttattcacctgccttttgagttactttgtaatcattttatgaattaactaatacggagtaaatacctacaacattctcttttgccttttgttgttccagacaaagttcacccaaagaaggaatttctgctgttcctaaaagggaaatagatcaacttaacacttcatgttctttcttttctgaggggtacacaatcttttctaacctttcttgttagatgtctttaaggttcctgattctttgatcaattgtagtcttgcattccataaatttgtgttgtatttaatcattgcagccaatacttggacaaagaaggaatttccactgacgaatacaggaaagaaaagcaaacagatcacctttacacagaaagagattgcccctcggatctgtgggttttgcttggttcagctttaagtgaatccgagaaggtaggataagtgagaagtagcaaacattactctttttttgtggtgaacaagtatacggacaaacaatgctgaatcctacttcatggataattcaacatagtggatgatttgctacatttatgaagttaactcttccattccagcttttgtggtaaacatgatttatgtttttcaagcaggattccttgcaagagtttgcgtcttggacagatgcaactgtggtcaacgagtggactgaaaatgtgacccatgttatcgttggaaaaagtgctggtagtgcatggagccgatcttatgaggtcctgatggctcgactgtttggaaaatgggttgtcacggttggatgtcagtattgagctatcttctctacagttctctatttcttttaggaccccaatttgagtattctttcctttacgnttatattgttggatataccctaagatccctaaggccattcaaggtttatcataaatctgcagagtattatctattcctaagctgaagtgcttcgccttgctctttttgggattatggattgcttggtaaagtttattccaagtccagaagcttcctttgagttaagatttagccatgactcacgtgcatcaattggtggaaacaagaaaagaagaaatcaagcttctgaaggggtacatatacatcgctggctataagattagacttattttatgtagtgaaaactatcgtaggctgtcacttgtataagcttaggaatttgatttgcaaatctttcccagtaatattttcttacaggcctagctacaactgggtacaacaatgcataaaaatactttttacatatcgctgttcaaagtcaaggtgtatatatctagtgcataactccatatattccacctgctttgtgttgcaacttacgacatttcattctttagagcaaattttctgccgcaacaatctccatgatgataatgcgatgctttcaggcacagaagttgttctcgggactgaacttttgcctcagtgcctacataaaccctgacgacagacaacacatacagagcctgattgcagctgctggagggcagatactggagacaaacggcggctcgcatttgctgcgtgaaaacctggagaaagttgctgtgaagccatgctacttcgtctacgacgggggcgctccaagggatttcacccaaggattgcttgatgatctccctaaggagatggaagagggcagagagtatgctgcctgtggagctcaggtgatcagccatttgagggtgtttgatgccattgcggcttatgatgcacagattctcagccacaaggatcacttcaccccggatgtgtaatggcgcaagctgtgactgtacatggtaaagcatatatccatggctagttgttggcaatttgtaggtgcttttggagcagtgcccttcagatcaaatctttggcactgtaggacagtaatgctgttgtatatatataaaccattcgatgtttactgacacatctggttagcctgatattcacctactaagagcaggtacaatagtggattattagccggttgtaaacattttaatgagataaaagatgagagaagagcagcgggctacagatctgtagccagctgcagcgcgaactctaagacgcaatgtgtgtatgacaggtgggaccatatattaatagtatagcaagcaactattgtataaattggctattagattggctataaatgaattggagttaggtcctctttgtttaggcttataagccagcttataagtcgaaaagtctaagtcaaaacaaacaagtagcttttttttatttggcttttttgaagccataagccactctaacactattaagccaaaagataggttggagaagcttttttggcttttatgagatagatgtatgactccaccactaaacttaggacattaaa

SEQ ID NO: 71559 - DNA, 8514 bp, Oryza sativa
ccctcggggagacagagggaggggtggccatgtcaccctcgggcccgacccccccgagggggtcaggccacgtgggtgaccgcggctgcccaagcttctagtcacgatacccccggtcccatgtcaccgacagtactaaatgggtaaagattggataaagtatatggggtatttgtgaggtattattagaaaacttcgtgtggttttgatggacctgttttatgtgttgaaaatatgaatggttatagggtgtgtttgcaagtgcaggatgggaactcatccctcctgcacgcaaaacggagcggctttttaacacatgattaattaaatattagctaatttttttaaaaaaaatggattaatttgatttttttaagcaactttcatatagaaattttttgcaaaaaacacaccgtttaatagtttaaaaacgtgcgcgcgaaaaacgagggagaggggttgggaacatgggtttgcaaacacaaccatagtattggcgattccttttcgtttgagtaaattttacaaaactacaggtattttgaccaaattatcacaaaactacagatttaaggagttgtatcataaaactacacatttagcatcaaatttatcacaaaactgcagattttaggttaagtatcacaaaaatacatatttaatattgaacttatcacaaaactataacttttggagtttaaatccctagcaccattgttatggtggagctataaacattattactttgtgattaaattggttctaaacctttagttttatgataatttagtaactaaacgtgtagttttgtaacacttcatctttaatatgtagttttgtgctaaatttggtgctaaatgtgtaattttgtgatataattccttaaatatgtagttttgtgatagtttggttataatatctgtagttttatgaaatttactcttttcgttttcactgcaatttggaatgatggaattgactagatccggcattaccgatgggctgccgaacgctgtgatgcggttgatcttgagcgatccgggacgccacaagcaccgatgggttctgggagttcatacggctggtgcagcagtgtgtcaatagcagccgggatgtgcgcccaaccatggtcgccgtcgagaggaggatcgaagacatcctgaactcggttgtcaggtcatccaccaccgggttcatgactgccggaggcgacacacccagcaacgagccaaatcgtgaagataacggaaacgagccaaatcccagcaacgagatcgccagggactagtagtacgtacagcagtggtgatttgtcatataggtgtatatcggctgttttcgcatctcaaggcctcaagcagtgtgtgcaatctggagtagtatataaatatgtaaaatgttcatttcgatatactgtcaaatgcgtgtaaattaaccaatgctaaaacaacacactgtgactaaatttactgagttggatgatgaggatgattatgttgcgtgcacacctgatcaggaggacatataatataggccatttgggccgtcttggacaccaccgtttgatttgtatgaagttgggccgaactatgcaagcccagaggcgctgcctctgtgccacggcccacgggcatcgctggatggtcaagcaggtgatcggtggagcgccaatggcggcggcgagacacacagcgcggcgcgcgcgcgaacgtgcggacgcgcgcgccccggccacggccgccgcgctcgtttcctggcctcccgcgcccgctacaaatggcggccccggcgtcccctcctcactccgaagcttcccggttgacgacctctccggtctcccccctcaccccaccgcaacccgggacgtcttccatggccgacggcgccgccggcccccgctactaaaccaccctacccaccccctccaaactcccacacattacatccttcaaagagagcatcacacacacacacacaccagcctagcgatcacatttccacgatgacgacgacgacgcgagtggcggccgccgccgccggcgtgctgctggtggcggcggcgctggccggcgtggcgcgcggcgaggacccgtacgtgttcttcgagtggaaggtgacgtacggcaccaagaccctcctggacgcgccgcagaaggtgatcctgatcaacggcgagttcccgggcccgcggatcaactgctcgtccaacaacaacatcgtggtgaacgtgttcaaccagctggacgagccgctgctcttcacctggaacgggatgcagcaccgcaagaactcgtggcaggacggcctcgccgggacgcagtgccccatcgcgccgggcaccaactacacgtacaagtggcagcccaaggaccagatcggcagcttcttctacttcccgtcgctggggatgcaccgcgccgccggcggctacggcgggatcagcgtcgtcagccgcctgctcatcccggtcccgttcgacccgccggccgacgaccacatggtgctcatcggcgagctggtacaccaagaaccacgccgccatggccaagatgctcgacgccggcaagagcttcggccgcccgcacggggtggtcatcaacggcaagtccggcaaggccgccgccgacccgcccatgttcaccgtcgaggccggcaagacgtaccggctccgcgtctgcaacgtcggcatcaaggcgtcgctcaacttccgcatccagggccacgacatgaagctggtggagatggagggctcccacacggtgcaggacatgtacgactccctcgacgtccacgtcggccactgcctctccgtcctcgtcgacgccgaccagaagcccggcgactactacgcggtggcgtccacgcggttcatccacgaggccaagtcggtgtcagccgtcatccgctacgccggctcgagcacgccgccgtcgccggccgtgccggagccgccggcgggatgggcgtggtcgatcaaccagtggaggtcgttccggtggaacctgacggcgagcgccgcccgccccaacccgcaggggtcctaccactacggccagatcaacatcacgcgcaccatcaggctcatggtctcccggggccacatcgacggcaagctcaagtacggcttcaatggcgtctcccacgtcgacgccgagacgccgctcaagctcgccgagtacttcaacgtcaccgacggcgtcttcaggtacaaccagatgaccgacgtgccgcccgccgtcaatggccccctccacgtcgtccccaacgtcatcaccgccgagttccgcaccttcatcgagatcatcttcgagaaccccgagaagagcatggactccgtccacctcgacggctacgccttcttcgccgtcgggtacgtacatacatcgccccccattactactacctccattaaccttttattaaagataggcttggccattcattttatttttaaaaaattatataagtatcatctattttattgtaatttgatttatcgtcaagtgtgctttaaacataatttgattttttttatatttgcataaaaaattgaatattatgaatgatgtatatgatctgatactactgttaactaacttactgatgcgcataataataaaattttttaataagacgaatgatataaaaaaagttttttaaattacctccatttataatatacgatgttttttttacttttaacattcgtttataatatatgttttttcacaaacgtttgagttttgaccatttattttatttaaaaataattatgcagttatcatctattttattgtaattttattgtaatttgattattgtcgagtgtactttaaatacgatttgatttttctatatttacataaaatttttaaataagataaatgatggatacgatctgatgctaccgttgactgactgactgatggcgcaggatggggccggggaagtggtcggcggaggagaggaagacgtacaacctgctggacggggtgagccggcactcggtccaggtgtacccgaggtcgtggacggcgatcatgctgacgttcgacaacgccgggatgtggaacgtgaggtccaacatctgggagaggcactacctcggcgagcagctctacatcagcgtcgtctcgccggcgaggtcgctccgggacgagtacaacatgccggagaacgccctccgctgcggcaaggtcgtcggcctgccgctgccgccgtcctacctcccggcctaattcatcgatcgatgcatatatgtactgaacccgatgacattcttctcttgttcttgacattttttgtgatcttttgcttaatctggcgaaataatcaacttaatttgggctcgtgcttattgcatgtccccgcgaaaagaagaacaaaagaggagtggaaactgaaacgtacgtcctatgaagaagctgagcgccgtcgtcgtcagctggatgtaatttcgatatgccctctaaaaaccattgtaatggtggagttatattatacatatgatttcatcgctcacatatatatatatatatatatatatatatatatatatatatatatatactagctactgatgagttaaaaaaaccccatttttttttcaagtgtgattaatttatcattatttgtcagtcgatgtttttttcaatcttacgaattacgtttgaaatcgaatgacctgtagctcaagccctacccatctacacgatgggagtgtttaagatgccggaacatttctgtaatgattagtaaatgatattcgctttatccaaaaagtgttaagcatatttcatatttatagttttgatgtgctaaatttattgtcaacgagaacctaagcaaccatcttaatatataatttattggtttgttacattggggacgagttaattacttcttgattttggtgacaaaaagaaatgtgccttatatttttgttaacaaccaaatttggtaatatcggcatcggaaaagaagattagatcgaagtggagtcgaaggcggagatcgatttgagaacagagcaagaatcggctggagtccagatcggctacgattaggatcggctgggtctgagtcggactaggtaagccgatgcagccgattccgacaatacgacttggtgtatgacatcgggttgaattgaggtgcttcaagataattgccgcacatggatagagtcctgagaaggcaattgtatctattaattaaaatattttatgtaatttccttaaagatatgtttgggtaaaagtctgtcgcaaagacttatggtatcttagattttgttagagataagagtcgtgtccgatatggacatagtttgtaattttcgggtataaatagaccccgaaccccatgtaatcaattaacacacacgttcaatacaatttcggcgcatcgccacccttttgcttttgttttatttcgacgagttcttactttcgggttgagctgcatcggtttcgatcttcaacaagaggtaaaacttgttatgacggcttgcgttctcgggattagtgcttacatctttatgatactctaatcttgtttatgtaattcatcgagttatcatatatcttacataatctctagcaatatcaccatctaacccacaatcggctaacatctgttaacagagggtagccgattaggttagatatcgacgttggtttagattatataagatatctaccactctatgaaacttcagcggcttgattgtctagatattgttcttcttttcatacttaatgctgtatcagttgagtttgatctattaagtcatgcttagaatatcaatctctagcctgccttctggttaccgattagggtagtatcggagtttcagccgatcttatctaatttaactatatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctttgtatctatttcttgttgattgcaggatcaaatcaactggcacgctaacacacccgaaggcgagctttggacctgcactggagttaagcagatctcccaggcctcgtgtttttcgtcaacacgcttttggcacgcccggtgggacagattaggagtcagataagcaattttcttcatggccgagaaactaccgccatcaccgtcctcggctagcccaggatttgttaaagaaaaaatccaaaagttatgtttcacggacgttgatgaagggaacattgtgaccatcaatccagaaaagttcacacctgatcaaaagaaagattttgacgcgatgatgcagcaaggtgttcgcaaataaaaccgtagcctccttgttagaccgacatgtcattcttttccccggcttgctgagtacgttaagtactcacccttgccccttataataatctatagagtttgaagatgaagacgtcgacctgacagctgaggagtatctccaggagcaagttgagtatgaagacttctagatgttttgtgcctagccccaagcctcgcctgtggaataagttagttgcctaagttctttgcctagtgcgtagtcgcttagttctccgcgctgttcgcttctgtgccgtcgattttatggttctctgtaatgctgtgttgctcatatgtgggcctgtccatgatggcaacgtttgtaaggactactacccagtgatgtaataaagcaatttactttgattccacatttattctgtgtataccagctagtgtatcctgggactggtactatatcacaggtaatgcataacaccccggtgtgagtttgctgtgtttatggctaacaaatgtcggggcgttacagtgaaatgaaaatttttttatgtcacatcggacgtttgactggatgtcgaaaggggttttcggacacgaatgaaaaaactaatttcataactcgcctggaaaccgcgagatgaatcttttgagcctaattaatccgtcattagtacatgtgaattactgtagcacttatgcctaatcatggtctaattaggttcaaagattcgtctcgcgatttgcatgcaaactgtgcaattattttttctttttatctatatttaatgctccatatatatgtccaaagattcgatatgatgtttttacgaaaagtttttttggaactaaacaggcccaaagaaaacacatgcgatgatagtgagggaaatatatataccttcctcactgcctcgctgacattcgtcgtcgcatctggatcgcgaaagtaggtccacccacgagcagccatagtgttgagttcatcgatgtatctctcccagtcaatggcagaacaatggcaatgcatacgcttgaactcttcatcagtaaagtctgcatatccgttagggccataagggatcgtccttggctctagtgcgttaaccttgtctgcccacagggtggcctccttgaatacttcgtagcggcgagccttctcctcctcagtgctgtatgaacggccatactccttcatcaagtcatggaacctggccttcatggtcgcctcatcgaccttcacctcctgcttcttaatggcttcttggtagtctctcgcctccttagcaaatgcctcatcgtccgggagagtcttcccatgttcgacgtaattgagatagctagaccacaggatcttgccatctttgtccacgaaccctgcctcgattgctgcttccttgctcaggtaaggctccttgccggcgtcctgggcagctggtaacttcttcgtgacttcctccttatcctcctccctagctacaggttatgtacagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatactttaaatatttctaaatttttctataaactttatcaaacttgttaagtttgactaggaaaaaattactaacaaacaatgagaaatcttggccttttcaggattcagattggatgacatatggtaggcatgtcacaaggtgacatagctcagatctcagccctccaaaacaaatt

SEQ ID NO: 71560 - DNA, 3614 bp, Oryza sativa
gaccatccattatttcttccaaatctttctgttctttccaggggatggtcctaattcatttgcgcaccagctagaaatgaatcaccaatattatatagaaaattagttcaaatatagtggctacttttgttgtgctcaactgcttttgcaatataataccatataagtttagcagttaggtacttaagggcaaaagatctatttacaacttatttgcttttagcagataactcacaaaatttgtcaattggcaagcatatatagctagacttcctttctatatataagttacaaccacttgggctgttttctccaggattacaacagttacacacactttaagattgaatggagcatcagctgaaaataactgcaaatggtaaggtctcttgtgtcatatattaacagttcttacaaagagtctgtttaaatttatttatcgttttagctttgtagcaatcacttgttctccataattcaactaactatatattaaaattgtggtccatatatagctacaaatcatttagacgatggcagcatcttagtaatttatagagtaaatttcacaaaactataggtatttgcacaatccatcataaaactacagatttaagaacatgcctccagagccgtctctagaaatctggggtccagaatgaaatgtaaatggggcccttaaattgtgaaaatttcatgtataaataagcacatattttgtgtcaactatataattttaatgtgtttttacaatatttaaaatacatcacataaatattaatactaaaagagagtaaaggtagtactgacctcatattctattaaaaagcatcacccgtctagtgttttttgaaatgaaatcattaattatatcatcataattaagataattatccaaggcatcattttcaacacccaaatcatacttattatttctagaagacatgccgatgagaggaaataaatgtcttcctgttttataaacaaaagaaaagacaatcacattactttggtccaataatcaatctaatcggccattcaaaacactgtgatttaatttgaatgtaaatgcatacggatatatatctatcccagtcaatgaatagttgcaacgaggagaatatataaacgtagttgaatggattgataggcccgtagatgcagctagctatgcaactagagaaagcacacgacttcagaaaagaaaagaaaatgctatgagtagaaatggccttgtgaatgatgattcgagcctttgaggagattggattgaggattcaaggatgaggaaatgaggatggcgactcgacgaggagggagagccacagaggccgcacagccagcccccagaaggtagccgctagggctcgagctgctcagtgctcgcctcgccgccactcatcgctgcggccgtggggcatgcttggcggacagtggatcgatggtgttgcctgcgatacccacacgttgctcgatcatttgtctgctgagtgcctacgtctcaccgcatcagcagtcgcgacttgcaacctcacatcgttgtctcaattgtcgacctcgcaggcgcatcagcatcagttggaaattggactcacgagtcacgacggctcaacacacgctagcggcaagggaaatgacacctttgaccttctgtccctttgctcctctctcactttgtaggaggccaggcatgcatgtggccaacaccgaggtcgaggccacaaaaaatcgagggccctgtgcagccgccacgtttactcatggccatcgacaaccctgcttgtctcacaaaactacatatttagtatctatgttattccaaaactagctttacctgtttgatgcaccaacagctgatgtgtgggacctacctgcagacataggaggcttgaagatgcgcagttgttgattgccacactagaacttctttgaatgaaaaagctggttttagaggtagaaatatgaaggaatacatgcatacatagtacgattggaaggtttccatggaggaactgaagaaaaaagaattaacaagaagggttccatgcataatttgggatttttgatgtggcaatcaacaatgatgcatgttgaaacttcttggactgcagtggtcacacatgtcaggtgaccgtgaatctaacgggtaaagttaaaacttgcagtagttttgtgataatgaatatactaaatctatagttttgtaactctatagttttgtaactgtagttctatgatatattatgtagagtgcatgtggttttgtaaaattaatttactctaatttatatatgcattaaaatttactctaattatattaacatatgcatggctggagcatggagaaagggtcaaaggaaatttccttgtatacaataaattattattgttagttactgatgataacactatcacttgtcccttcttttaattttggctttgtttatcataaaaatgcacatctaagctgaggctggtaatcattaggctactctttttcagatatgattatagaggttttatatatgacatctctataggctaattaatagggttgtagctaacctagctagccttaaagccattaaggtagttagttacaagcgtgcacttgctaaaacccaaaaatatttccaagttggtaatttgttaatcattctttaacatgagttgcatgcatcattgtgtttgtacttgctacacgagaaaaagctggtcttgaaagcgatcgggaagctacaggccggccgcaagcatgtactaattaaatccctactccattagaagatcattttctaaagcaaagctccaacacttcttgtctctagaggctccatccatcgatccaagtagtttcatcttcctgttgtaaggtttcatatagcacttttaaataatacggaagatgcacaaacatatcgctatgcgcacgcacacatccacgagtgcatcctatatatatcttagcatgcacttaaaatatttaatataaaccaatgacaaacccatagttaatattaatttttttttggaaacacggaccacatatataatatttataaacagtaagatttaaatcttatatttacatttacgattacacgagtataccactgattcctcctctcgtgtgtaagcttactactatactacactaggacactaggagatactacctccgtcccagaaagatcacagttttgcaccatttttgtccaacgtttgaccctccgttttatttgaaatttttttattattagtatttttcttgttattagatgataaaacataaatagtactttatatgcgactaacttttaaaaatttgtttataaatttttcaaataaaacggacggtcaaacgttggacgcggaaacgtacaactgcacttaaaatgggatggaggtagtactacataatcctgaactgttaaaaattagttaccaacactacgtacgtgatatgaagttatcttgagccaaatctcaattgcttttataggggctgttatataaagatctaagtgatgtcaaattaatggttctcatcaaaccattagagattagttggttattatgtaagtagtacgtagtgtgctaattaacaacaggat

SEQ ID NO: 71561 - DNA, 7136 bp, Oryza sativa
aggatgtcacatggcggtttaggagtatttatagcaagcttagtgaatttttagtatataataatagaagataatagattatattcagtttgttcgtcaattaaacttgaggcgggccgtactttggtgaaattgctgatggacgactaatcgcgcgccggatcaacctattagcatttttagcccacgtttttagtcttttctattttttgtaatttgtgtcatgggtaatttagctacagaagttgggttgtggagcacgcacgctttctaaacggttaaacgatgtattttttgtaaaaagtttttatacgaaagttgcttagaaaaatcatattgctccatttttgaaaaaaaattagctaataattaattaatcacgtgttaatggaccgcttcgttttccgtgcgcactgtgctgttgggaaatagctccagcaaacacaccctggctgtgttctttgctcctagttcccaacccctctctatcgtattccgcgcatacgattttcaaattgctaaacaatacttttttgtaaaaagtttctatacgaaacttgcttaaaaaaatcataatgatctattttttttaaaaaaaataagtaatacttaattattcacgtgctaataggctgctccgtttttcgtgtgaaggagtttggttcccaaccatccgaaacgaacacagactaaactcagctccacctttttaggttattttatgaggtgctctactcaaccccgctcgtattctagatgaagctagagtgagcttgagctcagcttgagaagagatggaaatatgccaaacatatccttattgggctgattcgattcaatgggtcaaatcgggcccttttctttttttaacagattgcacttatttcagtccatacatataaagtttacgtatacaagatttaaatatatatacatggtgtacgtacatatacacttatatctatgggtctgttcggattgatatcaaataaaccttaccaaattttggcattgtcaaatttttagtaaaattggcaacattgccaaattttgataggattaggttaataatgttgccaaaattctatatacattaccaatatttaataacaaactacatataaccacgtaactatcaattttaccaaataatagtatggtataaaatgccatcaatctgaatgggccctatgtgtatatattcttagtatgtaaacaagcgtacttatgcatgctacaacgtcgagacgtgtgagcaataatatagcgcattagtccactgctagctccaattcatctatagccaatcttataaccaatctattatattattaaaggaatagaaaaagttgcctccacgttcgctctcacggtctagaaattttcacattaatcggagaaaaaaaaagcagagtccatatagaaatacaatttagaaatagctgaaattcggaattaaaaaataagaaatattagaagaggagactacattccatatagaaatacaatttagaaatagttgaaattcggaaataaaaaataagaaatattagaagaggagattagagtccatatagaaatacaattaggaaataattgaaattcgaaattaaaaataaggaatattagaagtagagtatagagtccatatagaaatacaattagaaaataactgaaattaggaattcaaaaataaggaatattagaagtagagtatagagtccatatagaaatacaattaggaaataactgaaattcggaattaaaaaaaagaaatattagaaaataaggaatattagaggtagaatatagtctatatagaaatacaattaggaaataattaaaattcggaattaaaaataaggaatattagaagtagagtatagagtccatatagaaatacaattaggaaataatagaaatttagaattaaaaataaggaatattagaagtatagtatagagtccatatagaaatacaattaagaaaaaaatagaaatccagaattaaaaaataagaaatattagaagtagagtatagagtccatataggaatttaaaattaatctaaaatttggaataaacataataaaattaaagtagagtttagaatccatataaaaatacaatttacaaatggaagaagagcctaaagtccatatagaaatacaatttacagataacgaaaattcagaattaaaaaaaaagaaatattgaaagacgagtctagaatccatataggtatataatttacaaataactaaaatttgatattaaaaataattaataactaacacgtatatataatacaatataaatattacacattagtagtttcgtaaagttagtataaaatttaaaattatattgtcattttaatatatttgaataatacattgagaaaacatatatgttattacatgagagaaaatataatgatgctagctgcgcaatctgcgcgggctaccatgctagatcatataatagttgcttattatactattaatatatggtcccatacatacattgcgtcttggagtccgcgttgcagctagctacagatctgtagtctaatgctcttatctctcatattttatctcactaaaatatgtttacagctggctaatagtaacgtggacccttagaattggataaaattttagatagtcgcttgtcaaactgctaaatgataggttttgtatgaaactttctatataaaaattgctctaaaatatcaaattaatctatttttcaaatttataataattaaaactcaattaattatacttaataccatcgcattttacgtaatagacttgatcttcaatcttaaataacaccaccgaagtctctgacaagaagacccgtgctccccgccggccgccggtggacggagctctgtgtcaaccggagctcgagctgctttccatcaccggacatgatgaaagccttgatctgttgccggcaacgtagtttctctgccggccaacgcgacggcgcgacatcccctaatcactctcaatccattctgtggtaaggtagggcaaccgcaggtgattggagaggcaccctcaaaatctcaatccacccgccggcgtacatctccgctaccacctgctgcgcgtggcgtgatggctccaagctagctttccccgccgcgcccgcctgaggatccacaccacctgctcggctgtcacggctcgccccacatcgcgcgcaggatgttcgacgaattgcctgacccggacaacgtctcgccgttacgcgtcgttgaccagactgcgcctgcttcccccggcatgtgcacgcccacgccgtgcagctcgggcttttgctacagcacgttcgtcgggagtgctctgcagctctggtgcgcatgtcccggcggcgcagggtcagacaggcgctcggtatctctcttcttcctctgttagatgtcttgccgttacatgattcgtcttgtgctgatttctgttggatgcttatgctaaacagggaaatttacacggagagacatgttgcaatatcactgaacataccgggtggagatcatttctgttctatattgttggagggcgcccaggaattctttgattcattcagattttaccatcaggttgcacagatttggtttctggttcattataataagcaataaagcaacaagatgacccaaaggatgaattctttgcatctcccatctctccacaggtaccaccttttggctccatttgcttgtcttctttggcctaactggtttcctccacagctgcatagctctgtcagattatgtgataagaccaattgcatgtcacttgaagccggttatgactccacaatgcaacattgttgcaagcgttggactatgtgataagacatattgcatagcctactattaatgaatgggtttgggccaattatgaatgctaatagtccgccatttggaaggcttcaacctggttagccggccggccagtcagacagctaccccgctgtcttgcaaaattatggctagcagttctcccaagcatcagcagtggcagcaatgagctctcatcgccttctattcacacagcttcacctctacaacttgctgttgctcatccatgttcaccatgctacctcactcaacttcagatttgacttctccgagcctggttcgtactgtacccctggttcagagatcgcctgtgctggcgatgcctacccctacgcccatacgattgagctgacaaagaccgacatcagcgacagaaacctctgcagcatcggccgcgtgtggtatgcacggccggtgccgctctggaacaacaccaccggtgaggtggccagcttcaggaccaccttctccttccaaatcaagccggccaacctggacgtcagtgctgacggtatggccttcttcctcggccattacccgtcaggcatccctcatcgcagctatggcggaaacctcggcctcttcaatggcagcaacaacaagaacgcaacgggcaccgctaggatcgtggcagtcgagtttgacacctacatgaacaaggaatgggagaaggatggcaaccatgtcgggatcgatgttaactccatcgtctctgtcgcggcaacctcaccggacaagaacttagcaagcggcaccaccatgactgccgatatcagctacgacagcagtgcagagatactggcagtcaccttctggatcaacggaacctcctaccatgtcagtgccagcgttgatatgagaagatgcttgcctgaggtggtcgctgttggtttctctgcttctaccggaagctccattgaagtacaccgggtgctgtcatggtcattcaactccaccctaacatggatgaattcttcagtaatgccaccaggagcagcacctgtgcccccagaaactatcagctctgaaccaataatgtcaccaggagcagcacctgtgcgcacagaaactttgagctcccaatcacaaggtaaattacatggtataatagctatttcagttgcagtatcctttgtgctggtatgtgctttcatgggttttcttctacgacgtcgattagtatggaagaaatcaaatgaaatctctgatggagattgtcagattgaacttgatgaaattttttattcaaaaaaggaacttgatgaaattaagtttgcaaaaggtgttggccccaaaaggtatcattacagtgaactagctgctgcgacgggtaactttgcagaggagaagaagctaggaagagggggttttggtcatgtttaccagggcttcctgaaaactgatgatcaggaacggcttgtggccataaaaaagttctcaccagactcatctgctcaggggaggaaggagtttgaggctgagatcaaaatcataagtcggctgaggcatcggaaccttgtccaattaataggatggtgtgacagttgcatgggactcctgattgtttatgagctcgtatcagaaggtagtcttgacaagcatatatataaaaatgcgaggttgctaacatgggccgaaaggtacaatatctaactcatcttttgctgaatatgtttgcttttttcaatttagaacttcttggagaacagagataagagttgtactcatggatgtcagacttgcagtctaatggtaactcatggataacaaacttgcagtctcatggtaattcttggatgtcacacttgcagtgtaatgatatgttctttttaaagaaatcatacaacgagtccaatgaaaaaaaatagaaatcgtaataaatttttaaaattcgttattaatagaagacatatccttttgagtatcttactggataagtttggtgattaataaggtgtgcttctagatagagccactggcccacaatcagggcaattcacaggatagcccaatagattgcagaataaaaatgctgctcacatctacttgaaaattgattaactaattaaataccagcagccctttgtacttcgattgtgaagttgatatatagttttcttctaatcacaaggctatgaaggttaggccaggactcagtcctaatcaggtgtttatttttgctatggtatatctatccaactataacacaggactagctaaattttcaggtagatttgagtcaattaaggaactaaaattaagaccacattgcgtcttcagttggtttcttagaggttcagctgtgtataatctttagggataattttatcatccttgagaagatacctagaggcacaatattttctaatgaaaaatttggtacttcgaggtactaagtactttcaggtaccaaaaattttagtgtaaaatttagatacctcaaggtactttctgaaggactgtaaaaattctctttctttagaggttcagctgtgtagtttcctagaaaaatataaagaacatcattaaaatttagtatttagcatgtagaattcaaatccatccacattcaccagaagttagttttttgagttagtctccggtcctcgggaggtactagtctcttggtgaaaatagctacaaacaatcctctcttgccatccatatcattttcactacgatagtctttcatcaacaggtacaagatcatcattggccttggctctgcactccactaccttcaccaagagtgggagcagtgcgtcgtccacggcgacatcaagccaagcaacatcatgctcgactcctcctacaacaccaagcttggggactttggcctggcgaggctcgtcgaccatggcgccaagtcacggacaaccaaggtcgtgctcgggaccgccgggtacatcgacccagagctcgtcaacacgcgcaggccaagcactgagtccgacgtctacagcttcggcatcgtcctcctcgagatcgtctccggccgtcgccccgtggaggaaccggacgacagcgacgagctcttcgtgctgtcgagatgggtgtgggacctctacagcaagaacgccgtcgtggaggcggtggacgagaggctcaggtgcagcgacgatggcgacgacgagctgcagatggagcgcgtgctcgccgtcgggctgtggtgcgcgcaccctgaccggagcgaacggccgtccatggcgcaggctatgcacgccctgcagtcggaggaggcaaggttgccggctctt

SEQ ID NO: 71562 - DNA, 964 bp, Oryza sativa
tgagtatatagtaggcggtacaaatactcatataagaaaccgtgttgaaatatctctgtagctttggagaaggggcaaacataacatttcatgaaaattaaaaaagttataaaatcatattttgaagtcagcttatatgaaaactctataagtatatttgcaaagaaaaaattcaattggaaggatgggttattagaaaattccaaaacaatgcagcgctgaaaaaaaaatgaaagtaggaataatgcttgtcaagaaaaaattacaccccagtgtgccctattggaacatatgacatgtctcatgtaaaattgtttgaagtgcatgtcacttcgtcacacacaaataaattgaaataatactttatgatcaaagcagaaaagagaataacacagtacgtatagctagagatactaagggttggattctttggaatagcacatatgtattgttaatcggtatggactacacagatcaaccgagaatggaactatgcaggttacaactcagaagtacctgtggctttaatcctctcaggcaaccatggtttcagtgtcactgaaacaccctgcaaacaacgctaacctatgaaatcaatgttccattaaatattaaacaatagtagcagatatagaaatgactatagcacaagaaaaatgttagctaacatacatagggccagcactgattttaaaaatgtagtaattgcggtctagtaaagttcacaaatactgaaatcttcaatcgaaccaaataaatatttgttcgctagatgtacaacataatctgtgattactgccttgacttatagacccaatattgacccaatgtattggttacaatatgattcgtagaataatggagcttcctccagataggaggctaaaagacctgcaccatgaaatcatatcattaccttaatatcggcacaattatctgtctatactgagccgtaaagaccctg

SEQ ID NO: 71563 - DNA, 10557 bp, Oryza sativa
  unsure (1)..(10557): unsure at all n locations
gttcatggatggataattttgtcgttatacttgttcgagcggagcatcctctatccctatttttatcagtttatatgcattgaaaatttagggggctgctataaaaaaaatcccattcagacggatgaaaccggttacgtatgaggtcctaaccggtatcaggtgatttctatcaggttacctattagacgatatcctaccagataccaggcaatttcgataccaagaaatcacttgatatcgattaggtattaggggatgatatattagaggtattaggatctgttatttaatcggtcaaagtaacctgaaaatttatcaggtatcaggtattaggatctgatgtacgggatgccgttacgtagcattcctgaaaatttattagaggtcaaagtaaaatggaaatcatgaacgtgttcaggtgaaagtcaggaattttacatttgcggatggatgagcctgatggaatggatgagaaagtgcaatttgtttttgggtgaatagctaatttagtccttcaagtttcaacgaaggcttaatttggtccttcacgtttcattttatccacatagctcctccaaatatttgttttggcttgaaatcattcttgggcccacttaatatgccatatggctatttctagtcaatatttctattagaaaatgtcccttctgcccttaatttgtatacaactatatactagataagagaaaaccaagatgaataaacaacattgcatatgtacttcccattattttaacatgtgcacgtaaacttaagcaattgctatctcatacactttctagtacatattttattttcgttttacataatttaatatgcattatctataaaaaaattcaagcatacaatttttctcttatatatgtgaatgatgagggggtataagtgtcatttatcaagagaattgtcggttcaaggataagtttgaactaaaatgaaaacttgaaggattaatatggatagattgaaacatcaaggactaaaccaagccttaggtgaaacttggaggactactttggctattcaccctttgtttttcatctcgtgaaataccaatagcacaacattttttcagacaatatgtacaactgccctgtcagatcgcgtttacgacgacatagacggtaaggaaaaacgccacagcattcaagaaccagaacaagtacagaactaacaggtaaacccccaccgaccggaaacgccgcccgatgcgccgacgcgtccacccactgtcttctccggcgagggcacgaggcaacagaagcagtgtggtgaaggtcggcgctggcacggcccagacgaagctgagcgcgaccaagaaggcgaacggcagcacgaagatgctccacaggatgtacttggtggtcgtgctgtccagcccggagacgacggcggccatgaacgccaggatcatgctcatcagcgccatccagaggaagatgagggacatgcatatccacgccgtgcttgagcgtgccgcccccctgccgtaggtgaggagcatggtggcgatcacggaggacgccatggccacggtgtcgagcaccaggaaggcgttgtaaggcgtcgtcgcgcggaggttcgccacgccgtcggagttgtaccctcctggcacgttgaacatggcggtcagggcgatggtggcgatcagcacggcgacgatgccaaggttcttggtcgttttctcgttccattccttaacatttttgctgctccattgggatatgcaatcttgtcgttgcgccccgaaccgagctccattggctgacagtctgagcaaaaaaccaatctgacagtgaaaagaaaccaatttttagttcgatgcaatcatgaacaaagctagctacgactagtttcgaatcgagagtactaccatgtgcaagaaaccggttgtgtttgatgcgaggtcgaatggtgtttgcccttcgttgttaacaatgttcagtttgatgtttctgctctccaaaattgcgagacgcgggttcccggccttcaccgcgtagtgcatgggtgtgttccctttcttgtcttgctcattgaaaagctcagcaagagatggatcgccaaggatgtatgacactacaggttcatggcctctctcgatggccagatggagaatgtttctgccctcgttgtcgacaagctcggcagagtctgggcattctttcagcatgtcttggatgacatcaagatgacccatcttcgctgcgacatgaagaggtgtcaatccttctttgtctgggatgtacatagccgatggcatcgactgaatcaacatgctgatgatctctcggacgccatcagacgccgcgtagtgcagcggagtgctttccgattcatcgggttccttggccagattcgagttccatgacaataactcgcgtgtgatttctacatgagactgaaaattagctctgcaacaacattttcttggaaaaagtttcgtgtctctgaattctgaatagctgaagaactaagtgaagttttcagtaggtcaacggctcacctacgctctgaagaacagctgcgtgcaaagcgttctgcctcttggggccagacgcagacgcgtgcttccactggacgatggctttcacggcgccaatcgaccgcccgacgacggcgaggtacagcggcgacattccgaagttgttcacaccgcaagacaaggccggagcggccaccatcaggaccttcaccaccgccacgcgcccgtgccgtgccgccacgtgcaatgccgtgtcgcccgcgctgttcttcgtcaccagtagcccgggagcgccggatccatgcatctgagctagcctgatgagaagggacaccatgtcgcgcctccccgccctcgcggcgtggtgcaacgccgtctccgacttggtggtctctttcggcagcagcgccgccaccgccgccgcggccgtgtcgtcgccatcgcagagcttcctcacaagcccaatcttcccttgactggccgccaagtgaagaacggtgttcagccctgcggtggtctcgtccaggacgcactggccgtcatgccttcttccttgttcctctgtcaataaaatagtcaaattaatgtagacgattaatttcagattcgtagattgcactctgcaaattgggatgcaactcgatacatgaatgtacctgctgccgttccactgggtgaaacaagaagttcctggagcttgtctacagatccagagaaggcggcgcgatacagctctgggcacatcaacctgcgtcccgcattctgctgctccggctgggtggctgctgctccggcatggacggggtcttctacgggaagttgcagcagagggagttggaacgccgtgtcagccggtgagttcctcgcacgacgtaacgcggctctcaggtcatcgtcgccgagctcgtcggcctttctcaaagcttgctcgatttgctcggcaaattgaacaccagcaacatgatccatctctctcgtatggtggaaattacaaatgttagccaggctcttcaattcgatcgcttgatattggtattactgtcgcgtttaggcgtttaattaacaatcagcgccttgtaaggttacttggcaggtcaactcgaaagtagtcgctacattgtcatcgctcgcttgatcttctgtttttcagtattttacagaacacaacactgaagtatgtgcgcgcacaataaccccaatgaacacatactctcactggaaccattttcgagaagagaacttttatgttgtttgcattccaaaaaggtaaagatccaacggttctcaatcataggaaccatgttaaaagtatttaagtattgatataggtacttaggtactaagggtaaaattataattttgctagtagagtgaaaatggtataattatttcctaaattataataggtaccgcataggtacgaccgcacgtgttaacatctatatggtgtcagcgttgtgtgtttttatttgcgccattttctcttttgcgtggtttacgttgtattcaagttaagtcatttatcggcactaatatcaatcaaatattgtctcctgttcaaacgctcgaccatgccaaaagcttcttcttcgaccgtgcctcctgtggctgcacccgtttaaactctagaagaacaacataagaggagatcttgttttagtcccttatgcaaggaatttgtgaactacataaataactaatcaactgcataaataagcaaagggtaacttacgaatacgcttgcctagccatcgatcggccgatcccgtctcctccaacccttaaccataccggcgcttctccctctgtctccctccggtgaacaggttcaaaccctagaacacacaagaagcaaagggagagaataaaggagacgcgagtgttacgttctaatcgatcgctaaagatctctaaatcaatggagtatcctgatttacctttttctctacaatgatatcgagatctactatgatataccgatcattggttggaggtattcaattcacgtaaaaaaaactcatgttttactagctaattactcaattgccatcatgttacaattattttgttccctaccttgcccttcacttgatcaatggtatagattattctatctccaagtacctctaagtacctcgcaaacaccgtaaaagaaactgggccgatatggcttgagattcaaaaattcaccatgtacgtctcactatcaagaagcacatggcataccattgaacaaattaattatccttaaatgtgaacacccatgttaagtttttttctcgataactcatttcttaataactagatgatgcaccgcactttgctgtgggatatatgttagataatggagaaatgatgaaacgatttggattaaaatattatcaaaatgatttgagaatgatgatctagcatatgtatgtttagttttagaaatgaagtaaattgtagatataattactatatgcttgcatgttgagctttgtgtgtttaatgggttgatgtggcatgcttgcatgtagaatttaggagtgctaataaatactatacttgcatgttgaacttagttatttagtgggcattagctttatagaaagaagagattaatgatatttcttctcttaaatcaaagggattgtattattatttggctgcccattgatcgcatgcatgattttccataatcctttttaatggagagcctttttaatatagagtgactaggggatgggatcccgtcataggtgtgggtttactttaatgaccaagctcccatgtcccaccaagctgatctcccgcatgcgaagcactaggactccctcggcttcttgtttcattggttgtagcaacaacagggaaaggagggaggaatcaaggagacaaagggagaagagataggaggtgctagcagcatgtggcttgccggttgatcatgcaagacatgcatatacctcgtcccccgctttgacacttggtacctggcttcccggactttggaacctctaggtaccagctgatacctaggtatcaaactacatacacctaggtactagagcctggtacctgggtaccaagcttgatacctatgggtatcaaccatgatacttacaggtatcggcctgatatatgcggatacatgtgggtgatgtcaaagttcaacaagtactagctaagtatgttgcacccatgatgtacttgcagacaacactggtgagcaacacggtggtgacatcctccagatcccgaatctcctttgccatagggttgaccttggagagcatgtcctttgggtcctgcatgatctcctgcttgctggtgtccccctcggctaccacaatagttgcggccacggggggtggcgtagtcagcgaagctcttgatgccaacccgacaacgatcatcccgagcagattttcatggcaaagagggatggaaagttcatgatggaggggtggtccttagggggtgaattggaggaggaggtgaagaaggaaggtacagggggccaaaccatggagggagcactgtagcaaggtgctggttggtggtggggatgagaggagtgggaagagaggataagacaagagtggagaagaaaaaggggatggggagactcagttctattaaccatcccatccacgcaatgccgtagtctagtttttctgtttttaataacaatacatcaaaatgatataattactcaaacatcattcttgcgctctacatagttaggatgcatacaacctatgattataaaaaagaacgacatgacatcaaatatcatgccgacaaaattcatgcagttgtcatccctacccgttttcctcttccttggttctcacagtgatcccgagtccagatctagcaccaacacttgtgcctgcccttgctgtctccattcttcccgccaccaccgcctcctcctccttcagtatatcagcagcctcttcaaaagctctgaccaccatttcccgtagcacctctccttcatcatctctaaccgctaatgccaccagatccgcttttgcagtccccgcccatgcctcctagctaaatgatatgccttgaacgcagccactacccatcctactaccctcccccactcatgtagtttcatcggtgtcatagcctgctcgtatctacctcccacagtcggtcctccaccaccccagccttccctcacttcatactacccctcccactgccacaaactccaaaaagcttaatctggctggagctggtgacaagggctccatgaggaattcgacgtttttgtgtagtcatcctcaccatctctcttcctcatgcttaactggaggtaaaagacgatttcttgaccttagatttgtttatccaataacgttcattattgtgaatcaagatttggaatatgaaagctgcattattatttcagatttaactgtcagttttagaactcgttcataatttgcttgtataatgcctacatgctgccctaaagttgaaatataattaggataaaacctatccttctaaaaaaatatcttatatctgtatatctattgatatgttattctttattatattatttagatagttcaaattcaagccaccatgttcatgctaaagacctaataatcacagtgttaattgcaggacaacatttacaccattacatcattgtatgtctagattataacggtgtagattgctcaatatagttatatgcacaatacaattttatctcttaaaaatccaagggttatataacaaatataattctttaaataaaacatatctattatgcaatgaacaatattgtaactatatatgaacataaagtaggggttttatatgaaatccacatataatttcattaatttaggctccgtgcaaaattgtgagtaaatctgctagttattatattattgtgatggaacaaaaaaggccaccatatccggtttagaggctgacaaatttccacaataatcaaagaaaaaatagaaacaattgcactcactactacaaaaaccattttcgcagacgtgaggtcttttttttccaggcaggtatggtcctcggagccaaatggccgcctacaaaaatgtaaaccggggtagagctcgcctagaaaaatggtttttgcccgcctgcaaaaagcatttttctagtagtgactgttagattgatgtgcgtcgagattataatggtgaagattagtcaacatatattcatataaatacaaattgtatttgtattaacggaaccaagctaggttgatgcaaagtacaattgcatttaagaaaacaaaagtaagagttgtatgcgaaatccatctagctacgtgcaaagtttctagagtctaggatgccatactatgagcagggatgccacacaacaacagtttgtttagactatagtgctcattataagaagttctctaagtctaaattttgatttcaggttggaatgtcctatactggtcagagtttctgtttttctagtgaacttgattcactgattgctctttgttggaagtgatcagaatatggacgaattgtcggaatgtctgatccattgagcaatccgttatttcaaggaactcagttctctgttggggttgaaattttcgactggaaacttcggatgttgcatcggaatatctgacatcccaaacaatctgatattgcaaggacgtcgactctctagttgaggcagcatccaatctgtcctactagtcggaatatccgatggtccaaaatataattccaatttaccatgaaactcaagtctctgtttggttcgaattctgaaatcagtgtttatgatggcaacatcagaatatccgactagttatttttcaaagaaattggattgtgttctagctgttggggacctgacatatggatcggaatacctgacctcacaattggaatatccgaggtgggatgaaatattcttctcaacaggcgaatttggggtttcctatttaaatccaccccctagcctcttattggttaagccattcatttcattcagatattccatggcttgtatattagaggcttgtgcaagagtgccatgtatctttagatcatattcttactctctcaaatccctcttgatctccatgatttggatctttgagtgtggatatggttttgaggacctagtgttgcgtgcattctctcgattattgagcaccatggtttggttcaagagtttacgacttctagatgttgacgacttctagatggctacaagttgctaccaagccaacaatatgaaaaggttggatcttgctagtgtggatgcaacctagaggatatggttagaaaagaaccgagtcgttatgagctcctcaacagagacgtagaaccccctcaaggttttgaactccggaaaatacatcgttagccctaatctcagggaaattatttgcctttttcactctcctcactttactacttgttgtcattgttagctagttattgaatgtgcatcattactatgatttgggttgctccagttgttttaggttattggcttggttgttgcgttctttgtcatgtcaaaagattagaagatccatctgtttcgttcatatccgatagctatcaaatatctgatctagaacggaatatatgaccagccttcgttttactatttcacactaagttttaaagagtctctctatgtttcaagcgatccattcaagaagtaaatcaaatttgattaatttaaaaactagcttcgttcaaatcacgtaggaaaattcgtcgattaccataaaatcaatcaatcaatcaatcaatcaatcaatcaatctatctatctatctatctatctatctatctatctatctatctatctatctatccatccatccatccatctatccatccatccatccatccatccatccatctatctatctatgtttatagtccattaaacttcttacaaatgcttctatattgtcacgtgacttctaagatgttacatgacactcaaataaattaanaaggaaattgaaaaaggcgaannnacccatatcgtagttgattctcattaaatttggtggacccattatttacaactattacacttatcttgaataaaaaaagtcaagtaccaaaccaggccctgcctacgcttgtatgtaggtcatacatccaccctctcttcgctcaatttcttactcctctttaccacctattccttatatattatgttttacaagcaaaatacccatgctttatggataaaagaaaatatgtaataatatgctatggagatgtttgcttaattgaacacataatattcactagtttcaatcaaacattagactattatataatattagaaaacataaggcattaacctccaaaagtacaaaagtagtggtggtggcagaaccaccacaatcagtgtcttttctagtattatagattcgttagaaagcaaaattatgttaataaatttagcaaatatgacatctataccacatccgcttatgtgtttagattatttatgactaaatttacttaaagaccaaatttcactatagttcgattttgaaaacaaatatgtcacttttggacttttgcatgacattcaaacaattattaaaaacatgaagaatttatcatcgtgcataacttcacaataattaaattggatctacaatcacaaaatgagcctaactatgagtaatactcccaaagtatattagttagaaagtaaaatttgttctagaaaaaaagattaagtaactatgatatctaaatcatacaattttttatccacttatgtctttagattatttatgactaaatttatatttaaagaaccatattcaatataaatatactttgaatagagatatgtcacttttgggatatgttttttgactttttcatgctattcgaatcattacaaaattatgaaaaaaagatataggatttattactgtatataactgcaaaatatttaaattagatatacaataatagaactgaaataaaactaactattactcatgttataaaatattacttcccccattctga

SEQ ID NO: 71564 - DNA, 693 bp, Oryza sativa
  unsure (1)..(693): unsure at all n locations
agccgttcgcgatgctacggatgatccgnctnnnnnnnnnnnnnnnnnnnnnnnnnnnnnnnnnnnnnnnnnnctttactttgccagccgaattcgggattgaccaagccgatgttgacgaacttactattcaccttcacaggataatcacggttaaagcatccggccaaatgatgaacaagcgcggagatggttgaattttgggtagcatcgtcaattatagtgtactattattaccaaggaacataattgaaatcatcattcagacagcttattaccattgtaggccagtatggttttttaatatcccagtccaattagaatttagcctgtgtggcttataagagttgtgtgctcatgtttagtaccaccttgagttatgtgctcatgtttagtaccaccttgagttatgtgctcatgtttagtaccaccttactagtttaacaaggttggaaccaacttataagacatcttccttccaatcatatcacttctaggttaacccttttacacgaagcgaggacgaaagtataagtaggttcgtaggcccgtccattggttgcgctcagagcctgtaagtggagtggtatccgtccattggttgggctcagagccgaccctcgcagtatgtttagtgggctcagagccgacccttgcagtatgtttagtacacatttctcaaatccaactttt

SEQ ID NO: 71565 - DNA, 21442 bp, Oryza sativa
gctccggagccaggttttgatcatgaacagcacaaagccgccgttgcctctgtctgcagcggcactcaccatatcggtgctgacgccgtcgtggatgatgctgctgttgctctgagagggaaatgacgccgaggaagtcctctagcttcggctgtaggacgagcgccgacaagaaatagatggggtgatggggattggggtcggccggtcggggatggattggggaatcgatggaggattggggagaagaagaagggcaaaactgtcattttgtatgatttctctctcatcaattgggtggatattatattttaatgtgttcagtgtcctgcagcaaattaccacattttttaagtgtcctcgggcaaattcaaagtctttgcggtgtcccacagctaattacacattttttgagtgtcctgtagcaaattttgtcttaaaatatatacacgtgaattatatgtcccaaaattatgtggttggacttatatgtgaattgaaggcccgaaatttaactaaaaaaattttagtttccaattaagtaggtaattttttttataaaatttgtgaatagagatttgtatctatatagaaactacagtcccgtaactcgcatgttcattttcgggatccctagcatgggttcacgtaggatccaggccgtgttcgtgttcgtgcgcacgcgtcagacgaccccggggttcgctatagtggtgtacgcagatatctcttcctagttcatggtgcccgaccgaggcaatctgaaaccatgcaccataatggcatcagatatatagagatgtgaactgtctcccatagagccacgatatagccaggtacgtaccttgtcctagcttctacctatgaattgtttggctaatcggttgtgcacatgcatgccggtttaaatgcctgtaaatgtggtatgttttaattttgtgctaaacttaagggatggtagcgatgtatatttggttcagtgggtatcaacactatatgtgatacattcgactttaagtttggcatatacaaatttaaacggaacaaaagtaattgtaaatagtacactgagttgttccactgttaatatatgtttgtggagttatatattataaatcatatattatcaaagtttattaaaaaagcatataacaatttagaagatgaaagggcatcatcctcggggaaaagaaaccatttcccccttctatatccttctaaaagaaagaactgaagcgaggggaatatattgtatcaacaagatctgcgcgaaatatgtatgcatgtgttgtttgtgagctataagtaaccatgcatcgacatgttcctcttgctccttgtattatcgttggtcggatatggcggtatcaaacactcgagctgtattgctcttgctatcggcgtggccatacctaatacagctttgttatgcttctactctctcttacaatttctcggatccacaaagcttcacctcaggggatctacattttgaaggtgatgcatacctcggcgacacctcggtcgtcctggccaagaagggcaccggcgaagtcaacccaaaggccggacgaatactgtacaagcaaccgtgccatctctggagcaacaccaccggcgaggtaacgagcttcaccaccaccttctccttcctcatgaacggcggacagggcgggctggcattcttcctcacgtcctacctgccgatggtcgccggcgccggccagaacgcgccagcaggcggcggcgatcagcaaacggtcgccgtggagttcgacacccatggaatcctgggtggagcccgaccatgtctacgcacaactcgtcggagaagaaagcttacaaggtcgtcgctggcgaccttgccaacggtgaatcgaagattgtgcggataaactacatcaatacatcgaacgttctcgctgtcacgcttggtgatctcaagacgagcacttctctcatactcaacacaagcgttgacttgaggctgtttctgccgcaagaagttaccatgggtttctcggctaccactgccacagccacaggctcttcacaactcgtgtcccgtgaggtgctctggtggtcattcagcacatacctgacagaaggtaatctgccggcactgaaatccactcctcttttatctggtatgactaagtactcgaattaataagggttaattggatttatgccactgtaaatatgacaattagaaaaatatcactactattcacgatataggctgggtgtcactggaattttgataaattagatccataccactccgtcgcgttttccatcctttcccgttagtttcctaactccgtgccgccgtgagggctgagaccgagactgatcaacaattgctgaatatctgaaatcaaaaaccaaaaacgatgtacaactagctaatcgcaacatgtaaagatggatttgtgaaagtaattaatcaatcaagaggtgcagtgtgtcactgatgcgacggcggcgtcctcgaccgaccgtccagtttcagcggcagaactccggcgttcgacagccgccccgccgtcggcttgaacccgaccacgccgcacagcgccgccggcatacgcacagaccctgcaaaagcgcggcagcgtcggtcacagtgcatgcgcaagatcgaagagatcgagaccgagcgtgtatgacggtttatttacctccgccgtcgacgccgagcgcgacggggcagaggccggcgcagacggcagcggcggagccgctggatgagccgccggagacacggccggggttgtgggggttcctggtggagccgtggtgcgggttgttgccgctggtgaggagcgggtcggtggcgaggagtggaggatgacgccggccggcaactccgccgccggcctcagtggcggagctggacagaaaatcgaagggggccagccggcttttgacagttcaaaaaattagcaatttctcttttttttcatgcattggcaatacataaaagcgaatagtttgcaaaagtcgacgacaaagatcagctacagatgttagattttgaaatttaggattggtgggtacatcaagttcatagtgacgtaattgatatctcaaattggctctcttgttctaaaaaatcagcaggatagaactttgaagctagagagcacactttgtcaatgttgaatgaactgaatgaatcacttggatccaaagatatacacaaagtgagaacctttgttgcttgttcactgaatctgctatgatatatggaggtaataaaaaattttgtttttattgggaggggccatggccccagccagccccccctcagttccgccactggccggcctttatgccctcggcttcatggaaagagtgggaaagacagaaaacgtgacggggtggcatgatccaattttttaaaatttcagtagcatccaaccgatatgacgaatagtagtggctttttttaatctgccatatttatagtggcatggatccagataacccaattaataatagttgtgataaagatctcatatagatccactcattttgttgaaagaattctctatactgcatggaacatttggaatcaacgaaatgctctcatttttcagaatgtaccaccttcgtttgtttcctagaaagctctctttaagattgatctttctcttttagtctttagattaaaagtttctgagagacaagctttatctcagtggataaacattttgtaaattatttgtattccttcttcccctacagtgtttcccctcaaaataatagtcgtgacgttgcattggattcaactaaatttatggatttggatttgctataaatgtggcgttgcattggattcaactaaacttatcaatttggatttgctataaatgtggccagttttttctacgaaaattagtatattttttggccataggatatatatgtgctagcgcgtatagcagaaaaaatgtgcaaaccgcggtggctgggagtggaatcaatccatgctattctaggttgtagtgatagcatctaaccaattgagcatggtagcattgttgataagttaattcttctatttatattactacgtaaatacattgaaattacatatataatttagaaacttacatcgtaaatacactaaaattatatatgtaatttagggacttatagtgtaatatatattgtctttttttcatgaaaaatatggcggcataaatagtctccaaaaaaaattatcatgtacttcaaaattatcataaattgggttaaatatggagtactctctctgttcatgtcacgcccggaatttctatccaaaattccaaacgcttatatgtgtgtaaaccctcgtccaggaatcagccgaggtacacaataacaaattgataatagagtacaattattactctaattaataagcgaataaaatatcattacagaggtagatagttcctctcaatcaataaagatctaagcagtggaaaaataaaataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaatatttgagaatttaataaaacggttaagtattaattaaacaatattaatccaacgctatacaacataccctgttgcataggcccaaccattctgaacaaccatcccggctgcacagttctatctccaaaccaggaatataccattccaaaccaggagctaaacagattattaccaattatagcatcttctattatggtgagaagggtgagactaatcatgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcacaacacaatccactgcagtgcacttttcctggatcataatcacccccttataaacaaggcatggactccccagcgacccccgtggacttatctccgccacttctcagtctggtgctccgcaatgaaccatgctatacaaaagataaagccgttgcccatgctggcttgtggttagcacggttaatgtttcacaaccgaaactcgtgaaccggtccttaattgtcatgagcacgaccatcaaaaccatgtgctcacaacccaccattatcaggttttagttggcacattaattaactaaccaatcacgattgaccatcgtgagctatcattaagccatcattaactaacagtgagtcaagagttatcccaatagtgagctaatgtttctaagcagggctaagcaattatatctaatatctagttgaaccaatatatataaagctcaactagtcaagttatattaacccaaggtatcaaggaataaagtaatcaagaacaaaagggctataacaaacaacaggttaattccacccaatgacattcgaaaataaatgcaatagttgaatagaaacagtagctttaaataggatcaacatgctcaaagggttgtttgggatctgtgtgacttgccttgctggccttggaactcttcaaattcttctcctgtgaaaacggactctccggaaacgtcggaatctaagcagaaagaagcaaaatcaccaaaacagcacataaacaagcatgaacagtacatgtggatatttttaacatgtagatctcaattttagaaaaatttagagacttgaaccaactaaatccgagtaagatgaattagttatgaatttttgaagattaaatcggattaaaacacttatatagattttaattgaattatgacgcaataatgaattatttttgaaaaggaaaaagggatttattgcgtcagcaactagggtttcggtggaccgggcgcacgggcgatggttcacgcgaacggacagccgagatcaacttgatccaaaacggacggccgagatccatcggtccacgaccggctcacgggagagggcgacgatgacgtcggcgatgacgtcaccaccggcggtggctcggacggctcggacggcgcacgctcgccggcgaacggcggcacttcggcacgaacggagagcaccaatgggtagcggacggcgcggcgaactcaccggtgaccaaaggagcggcggaggaggaacggacggcaccggcggcgaggaggaaacggcggaggagatcgggtcgacggcggcgacggtgctccggcgatcttcggtgacggcgaagcggcggacgaggacggcgacgacttggtgatcccgacggtggacttcccgagcgacgacgacggctggaacggtggcggcgcgcggctggagcgacggcggcgacggcggctcgaggtctcacggcgctagggcgattccgacgacgagaggcgaaggcgagggtggcggcgggtagaggagacaccggggagccttttaaaggggctaggaggcagcggcgaaggcctacggctgccggcgacgagaaggaaaggtcgggcttcggaggaaagaggccgatccgaatcgaactcgattccacgaacttccaaaacgatttagccgatgtttccaaaagggaaaaggtagaggagatcccgaggatcatttcccctctatcaattcggccggaaacggaaaggatcgatcgaatttggaagggaacggcggcggcgcgaaactagggtttcgggcggcggccgaccggaggaagacgacgaccctgacaagcgggacccacctgtcagcgacagcgagggcgcgcgcgcgggcggcggactgggccggctgggccgaggagagagagaagggttttgggccgactttcggcccaaagccaaaagaagactttttaaaacctttttcaatttaaattatttatgaaatgcaattctatttattaaaaatacttccttagctcaaataaatctcagaaaaatctaggaattatagaattaagcaaagtatttaatgaaattttatctagcaccattttatattggaatttattatttaaaattagatcttctcttctaggcttttaaaataaattctaaaaattccaattaaacatcaatttatatatttgaattctcagggtgtgacagttcacctataaaaaatgtgaactttgttgaaacaccattgaaacatttcattttcatggatgaaatatcaagcttcaagccactaaaacatcacaaatatgcaagaaaaatcgaaggttgatatgaaacaccatcaaatggagtatccattgcaattcttcaacgcaacccaaagaaacatccgaaatatattagctgaaacataaaaagatcacaaaaatgtaccggtctcttactccttgcgaccatcttcattggcgctgccacccctccaccgtcgttcgccacctcgccagctctctatctccgctgtgagcatttgcatgtaagagagatgagagataaagaaggacacgggataggtggaatgaggtgttaggaggagcccgatattttttttccatcgggcgctcggataggtaacgttttcgacattttccttcacgagccaaataggtgtatatatagatggccataagacccgctcggcacggcctgacccaggcacgggctaggcacggcccgaggccatcgggccaacatggcacagtcgacacttcgggccatgccgtgccggcccacgggctgcactttaggcccaggcacggcccactagtagttgggccgtgccgagccaacctgaaggcacgggcggcccatcacgtcttctttaaaataagtctattccctctcctctttgggctgtgacatatatgtagctaaaataaggagagatactacagatggaattccgttgactgacgggatagattacacaaatctgatgatcgtaattacgtgggtggacatacatgcactagacaagaaaaacgtggtctcgcttctcttcttaggcagcatatgtgcatgcattttttttctagaaaaagaggaaaaagaaagaagaaaaaggatacttgagagagaaaaaacatagcactgaccaaacaaagctactggtacctactcgtatcaggtatattgccaatacctgctagctacacatatcatcactgatacgtgatacttacatatagcatcgttattaactagtactacctccgtcccaaaataaatatagttttacactatttatctccaacgtttgatcattcgtcttatttaaaaatttttttatgattactatttttattgttattagatgataaaacatgaatagtattttatgtgtgactaatttttttaaaaaaaaattaaaattttttaaataagacggacagtcaaacattggacacgaattaccacggctgcactttttttagaatggaggtagtaccaacatgtatcatcaccgatacagatacttgtgtgttaagcatcatgattgatacctgcaagtatcaggtatcatcgttgataccttaatgtatcatcattgatacctcaatgtatcatcgtcagtaccaataagtatcattatgtagtatctggtacttataagtatcatcaccgcggcaacatatcctatgcacacaggccctcatgtgtacacacgtgcataccaactaaaaaatgtcacaaaaaaatctagaaaaaatcatacacatactttcaattgtattacacctagggttaaaatattaacgttaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtataaattttcctagaattttttgtgataatttttagttggtgtacacggtgtgtacacgcgaggacctgtgtgcataggatacgctcctcatcaccgatacttgtatgtatcaggtaccattgccgatacttgctagctacacatatagcatctttattaactaataccagcatgtatcaggtaccattgatgataactgtagatattattgtcgataccaagcagttatcatcacgtactatcatcgctgacaccaaagatatcatatagtatgggtaatatagatgttcgtgtatcatactagagttgatatcactgtacacgtaaataaaaattctaccagctaagtgtttcatcttaatacatatgattaacttaaataggattagaaaaacaaatgttcctaatatgatcattctagcagcctaactactagactggttcacgtgtggcctaaagtcatagacacagacgtggccaccactcataacgtaacttgctggataggtctaggctctaaagctctagcaccgtctatataggacaatatatagagtgtagtactagtaatagtcaacggatttgtgggccctagttggttgattgactgactaggcacaaatctcgacgctcagtgtgggcagttgtgcgcagcaccttgacttgggcagcgtctaatttattttattaactatcccattacacaacggtatcccgtgctgtacattttctctaaaataagtctattttacattcctactttttggagcatgctatataatatgtctatttttctccctatactttgtgccgtgccttacatatggttgaaaataagtctgttttgcacccttaaacttcgtgccgggccgtgccggcccagcgtgctgaggtagcaccccacacacggcattgctgttgggctgggccggcccaaatcactgggccatcgggcctcgggccatatggccatctataggtgtataggctgacttgtgtaatggccctgaaggcctggatgctgccctctttcttttttttttttcccaatcctcttccaatcagggaaacctagctgattgatgcctctactgagatttgggagcgtcgtccggtagccctgcggccctgccatcgggctggggccggcagagcaaaacgctcgatgcctcatatgtcaagacttgaaaaatcaggaaataaaattaccaaaaataaaaaaaacagtgcttattaagtcatttggctttcttttattttaacatatccttgtatatcgttcttaacaagggacgagccaactactaattatagtctcccctatgattgcttatttgatcgacatgtttatatccttatttttctctaagtaggtgcatgtgtcttcagatcggaaatgctactaggcgagggcgatcgattccccccctcctccctctccttctctccacctggttttcttttttgtcaccgtattattttcctattttagtaaatttatgtacctaaagtttatgcacctcaagtttacacatctaaagtttagagaccaaaagtttataagtcaaaagtttatatatccgattcaaatttgaatttgaattcaaatattatatatatatatatatatatatatatatatattatttctatatatctaaagtttatacacctaaagtttatatatccgattcaaatttgaatttgaattcaaatatttttcatatatagtatttctatgcatctaaagtttatagacccgattcaaatttgaatttgaattatatccgatttaattttgaatttgaattcaaatattttataaatatagcatttctatacatctaaagtttatacacctaaagtttatcgatccaaaatttataagtcaaaaatttacatacccgattcaaatttgaatttgaattcaaattttttatacataaatttttctaactttttggttttttaaaatttttttatggtgtactgtaataggaagagaagaaagggaggaggaagggaagaagtgggaggagtgcctataggggggggcggatccgatcgctaggcgatcgcctgttaggccccccctcttcagatgttatatgactgtgagctacattcgttagtcccgctcgatctatggttctttgtacgtacgtattcacgtattatattgtgttacccaatggatattgccttcatgtagtacatatttttgtaattgcaatgtggtttctttatggatttccttggattggatatattggaacacccgtagtcagctatccaatccaacaaactgtgtcctgtgaccatatgggagtgggaatcgaactaacaacctgtgtcctgtgagatgtaatcttgtggtactagtcatctgaccgagcattgatgaagacaaaaaatagacaagttacacctatatttgttttttactaacaaaaaactgccaaccttttttagatgatggaataaaatccggcctttgctcaacgtgctacaaccaattattacataaattcgctcgaaagcgaccacacaccaaagagttcacataaacacatcaaaatttaatgaaatgcaagcacacaaactaataaacaccaacacaagataaaaaaacataatttattgaatcctttttgtgaatttccacctgaaattggcagagagctacatgaccgtagacttaaagtctccaacatacattctctattagcttgatgtcgtcatcacacctttggtgaatatgtaatggaatgaatatgtcgctagttttcatctttttgagtgagtgctaggggatgctggaaaaaaatgtattccttacagcagcaattgcaaatgtttgagaaggcgtcaattatctatctgttttgttttttctgtttgaaacgtatcaacgatctatctatttattttgactaaatagaaagcttctatttatgtgatcaggtcaaaccctgttcaaaagactaattaaataaaaatttgagcagtctttatgtttttttttctcttttcggtttgttattttttcactttcaggatgtgcttttgactcctccgctgtctttgctagcaggtactccggctgatacagctaagaagtccaacaaatcactggtgattggaattgttgttgggaacttgggactgtgctacttatagtgacgatgctcattgcagcttcactttgccgtttaagtagatggattacgtcgaggcctccacccatgccccttggagaatattgtgcaggcggtctttggccaagttatgggaatgtaggcatgggcactggagaatatggttttgcgtcgccttcacagactccgttttctttcgaagtattatcggaagcgacgaataatttctccgaggaacggttgctccgtgaggaaggtcagtttagtgcattctacaagggggacctgacacatttaggcatctctgtagctgctgctgtgaaatggctgaaaataaagtcaggacaggcctttgcggtggagaactacgtgaaggagtttgcaaccatcagcctagcgatcagacatcgcaacattgtgccgttcctaggttggtccagcgagcaagataatctatgcctggtatataaatatgtaaagaactggagcctccacgatcatctctacagtccaggaagacttcttacatggcctacgaggtaagaaaaatttagagtgcttttctgaatgaggttttgtatcgaactatctcacggtacatatcctaaagcatgaaaagaactactttagaattgaagttaattaaataaaaagggaatagatagagtccaaaattaaattgagcaatttttatgtcccattagagatacattattttcagtctcagttttatttgtgggtatcttaatactaatgcaaagggaccacctatatatttgtcagtaatgtataatttcctccaacctaattctacctaccttttgattttaggaatgaaatataagcatccacaactaaataagagggctaaacacgagtaatgttcttaatcgtagttttaggctgatgttctccctgtgttcgtattccaggtacaagatagtatttgccataggctccggccttaagcacctccatcaggacgtccgccccacattcccgcacggcaacatcaaaccaagcaatgtgttgctggacgaagagatgaacgcaaagctcggcgatttcgggctgcctcggcacttctttcagtacgatggtgaaaccgcctctagctcatatcgacaaatgccggtcagctctcgaggatacgtggaacctgggttactccacacggatcaggcaaccacctcgtcggacgtctacagcttcggagttgtgctgctggagattgcgtgcggtcagccgcctattatcctccagcaagaccaggctgaagcaaatagccttgttaaattcgtctgggagtgccacaaaaagggttcgataattgaagcagcggacaagcggctgaatggcgagttcaaccgggagcagatggagcgcgtgttgcgggttgggctcttgtgtgctcgccgaggcagcagccagcgcctatccatgggcgacgcaatgatgttgttagagggggttggattttgatccctgcagaagatatccactcgttatttgcatgtcactaaaattgttatgaaaaaaattaaaaatatttgaaaagatgtattaatatacaatcactctgaaaacatgcaagttgaaattcaatttctacatctcgtaaaaaaaattgactatgaataaatagctgtagtttaatttgttttttcattgtgagagtcggagtttgcatgtttgtagagtgatgtatcacataacaatacatatttttatttttttcataattatttaagtgacatgcaaacaacaaggaaacattccctcataaaacaaaatagtttcccttcttaaagtttgtcgtccctgtgcccaaccttccgccaaggattccgattccggtgccaacagctgcagatcatgaacggtgcacatcgcctgcaggtcgtacatcaccattgtaggatcgaacacaagtaaccaagcctaccagagggggggaggtgaatggtagggaaaaccaaaaacccaaaaccgtttagcggaaataaaagttaccctcaaatcgatggaaatctcgacgtagtcctgtcgccgctgatcggaccgctcgcacgccgtcggtctaaccgccgccttgtcgccggttgaaccgcctgcctgccgcgggtgtgaccgccgtactcaatgaaacacaaatcgaagaactctcaaagtagatgacaactttattgcttctctctgtgtttacaaagtgcaacaacaacactccttacaaaaatcttgactaaactcgaaaccctaactaaactatcaactcaattgctctcaaagcgataccgggaagcctcacgctccctctctatttataccaaaaaaacctcctactcaaagtaggagaacaactcctagtcacactaggactctatccaaatcacaatctcctaaagcctgcagcctcacaaccaactacagtcaatccgtgtcctagccaacccgacatggacacatgtccgtctcatacgaagtcccggtcggcctcggtctcctaccatggcgtcgctcctgccttggactcaccgagccaaaacacatgtatatgtatacatgcatccatgtactgccaactactgcagtacacttgcatgcatcgatcaataccacacatatgcatgctacagtaccacgtgtactatagcaccatgtactcttcctcaatttctcactccaatctccttcgcaaacaccagcacttgcacgcacacctcgtgaagcccgttgtgaagatctcttccacacgatgtccatccaccgtgtgacatctcgtatccaacttcgtcacccggtatccttgaccgtctggacctcaactcctccctgagtttagtcccgatcctcaccgttgaccgaagttgtcctccaagaatcctgactctagtcaccttctcacatggtattccaaccgcactagacctctgctcctccccgagcattgtcccggtcctcaccactgaccaaggctgacctcaagtcacatgcacacaatcagacaaaacaaccgtttctgggcatagatattacaacctgacccacattagtcacacgcactcacaccaacatccacacatactctcaaatcaattctttgattaaatcatttgcagagccaattgttcatcacaaatattaatcatgacaatgatttcacaaccatcagcaagctagcttacgacttcggtgtgttcaagtcgcatcgttataaggaaagatcaatatgtgaagacagggaggtatagctcgatctatatatcatcgattggtaaagactgatttcttattgtatcaagttaatcttgtttggagtccaagttgcatttagatacatacactagaacggataccctcatctcaaacaggcggtaagccccgtctcaatcgggcacggcgtccgtaacagtctagaagtcactgatatgaaaaataatctcaatcaggcaaacggccgtcactgatgaacctatctcaatcgggccctaattgaagcccgtcaccgatagctttgactcagactaccagtcaaactatagcctgtcacatatgacctatctcaatcgggccacaaatagagcccgtcacagatgactactaacctcaatcgggcttaaactagagcacgtcacaaatgatactcatctcaatcgggtctaaactatagcccgtcacagatgactgtcatctcaatcgggcattaactacggcccatcacagatgaccatcatctcaatcaggcattaagttatggcccgtcacagatgagtataatccacaaaataaaaactttgttttttggctagcctcaggcctttgctagccatgctcgctgcaaaaatgacagaaacacagatatccaatatccccagctccctagcatcacccattcatatatatgcattcacatacacaaccatcaatatatttcacacaaccacattcacagaacatccattttgatctcatatttcacatctatttaaatatttatcatattgcacatgcaaaaccaagttaattggatcaaatatttatttagcaagtattaacataaacataagaaatatataaataaatataaaaatcacagttacataatcaatgttcatcattgcctaaacataaaagttcaacaatgttcatcattttagtttaagccgaaacattcctttgggattaattatttcgcggaggatgaagccggctatctcctcgcgaatctcctcaaagctggtaggcagagacttggtaattttgccctacattgtcatagatcgagattagttgatcgatcatatatatgtacttcgatgtagttagttagtctatcacaattgagaccaccgacctcaaaccctgtcaaagtcttcaccttttctttgtacagaaggcgcatgttgtggcacacatggaatccgcactggtcacctatttgttgcttcaccgggaagtcttttttgtggatgaggatgtgatgtcttgtcttcctgaggcctcctctttgcacgtattgggcccacacttcatctatcgctagttgaattggggtccaatcatatgcgttcttatcaattctggagttcaggtagtgacatgtactccacttaggtgttatgaccagaaggatccaatggtcactacggcattaatatagtgaaagttaatcagtactgaaggaacgtgtcatgctgttgtgtatatttagggaacacacttaccattgattataggtgcacataatgcactccttgtctcagtgggactacaaggtgtcgtagatgtagttgaccattccttgacggtcattctcgagatttgtgacagtgaccacttgtggatcaaggaaggcagcttccggtgcattctcctgacactattgccaatttaacctacacgcaagataaacgatcttgtaagcgagttaaaccgattgttattaccaaattgagttgggcgacaatacttacaaggagtagcacttaaggaggcttgtatccaccgctcggagccagtagaggtcgaatagatccttaaagtcgaccacgatataatttgttggaccaagaaatggatttccatcgtgctctccaaggatatcagtagctttgtttggtctcctggcgttagatttctccatgtagtatacgtgaaggtccttgcaagcggtgcccattgcagcaagcacgtcatctccaaccaatggcatgcctagttagaactcctgtggagcgacgtatttcttcttgacctctttgcccttagtcttttcctgccccttgcccagatctagcttccttggagctagaagcgaggcctgcacctttcctcctcctcctctcccctttgcatgggtttatcgagagtaattctctgaggggaagagtgtgccttcctgctcttcttcatcggtgggggttcatgaatcgccttgctgtcggcctccgttcggtcctcccaaaaatccgtgtcgtacttcaattgcacatcataagattgtgcatgacgatcttgagcaggaggggctgaaggagaagaggagggtctctttggcggacgaccgcctggttcaatggttggcctcgctgtaacccttatctcaatgaggtccttgggccattggatgaaggtaccacgggcatttcctagtgataggacctcgtcgttcggtggatactttagtgggaacagctcgtattcgggcttcaccgagttgacttgaacttttgcacagtcgcccctaagttgcgctccatgcactcttgtctctggggtcggcttgtacgcaagtccctcggctgctggaaccgtgaaggtcggcatcaccctaactgtgagtgtgcagctcgttggttcctgcgatagattcatcaatttttagaacattatataacatatggattcgttaagcctttcatgtattgtggacgaaacttttaccgttatgtggtcgacggcgctgtcgaccaatgttggattttccgccacctcagttgatgcgcaattgctgcgcttttgggtgggacttcctaactcttcgtcgcagcagcaacagcggcctgtgggttatgttgctcttctcggatctcttgcctaatcttggccctcatcgactcgagcttttcattgaattcagatgccagctccgctctgatcgacgccgggatcttggctttaaggcgtgcatctttctccgccttgttggaagtccgcttcttggactgccacgcgtagtctggaaatccaaacttctagggaatggaggacccaatgccccgtgtccttccacggtgttccttgttgcccaacgctttcgtgaggaggtcgtcctcgcgtctttgagagcaggcctcttgcgaggcttgttgctcggcaaccatctccttatgcattacaatttagttgggttaaataaactgcatgataggaaacaatgtgatcatctattttgactagacacttactatagcttcgtacactcgttgatcttctggatttggcatgaaaattgtgccattagcattcttctggtatctagccctggcccagttcctagcccgagggtgtgggatatcggcaaacacccgcggcgtgttcgattcctcctcttcttcatcctcctgctgccattcctcttccttaccggcatatccggcggtgccaagctagtgtggatactggttcaaggtctggagcatcgaaatgcctcgcttcttgctctggactcggtggtcgacttctttgcgtggaattcgtcccagacccatttcgtgatacaaggaaatttctctgttggatcgggattcgccgggttgaagacgaactcgccgactagcttactcttaaagttcttccaagcattgcccataaccttaaaagcagcctgcctgataaggtactcgtgctcctcaggataatcaaaactctccttgaatgttagccaagcactgtccttctctgcggccggcacttgcttgatgtcatcctatagaatattgaatttctgcctccctatgaccccgcagatagacctaaatcggctcaacattttcctaggacttgtcggcaagcctatttggttcactgcagttatgcggtaccgttccttagggattttgttccctgtcctaggagtacgtgcccttaaggacccactagttgttgtcgacattggttctccttactgagatattgtctattttttttcaaaatagcgagaatacgcgatttagtgcttcaatggctaagaattcaaatttcaaaaatcacttagtcacataaataaattaaattgcacatctcacagatctaacaaactgaattgaatatcacataaaaataaattaaacatatcatcaatcactaaaatcagctattcatccacatgacacattcatctattcatccacattcatctaatcatctattcatccacattcatctatgcatacacattcatctatttatccacattcatctaatcatctattcttccacattcatctattcatacacattcatctattcatccacattcatctatccatctattcatcactaaaatcattcatgcaccacattcatctattcatcattcatgcgcgatggaggactcacctgggggtcggcaccgggctcggtggaggcggtggcctcgggctcggcgagggaggacgacggcggcgaaggaggagttggcggcggcctcgatggcggcggcgctgggctccgtagagggtgtcaccggggtcggtggcggctgcgccgagctcggtgaaggtggcggcaggctcggtgaaggcggtgtcgggcgtcggagaggaggatgcgacgacaacgaggaaggacgtcgccgggctcggtgggggtcggcggcggcggtccgaatggaggacgaaggaggagaggcgggcagcgacaacgaggaaggccgacgccggttggtgtggaggctcggtggcggcgacggcgggcttggcgagggaggatgacggcggcgctagggttctgaggaggcgggaaactgtagcgggacttagaaaaattttcgatccgatatgaaaaaccctagttatagtaaagtgatttgtcatctcaaacgagaattaccatagagcccgacacagatgagtcatcggtgacgggctctatactaatgcccgattgagatgacattcaggctcgtcacggatgactcatctgtgacgggccctacggtaatgcccgattgagatagattagtctctatcgggctataactaacgcccgtcaccgatgactatttttctatttttccatttgaagtatttatatctgtgagtgcaatatatataactgttgtataaatgatttcaaatggaaatatggtcaacaacaaagttgtagagcttaccaagatctacaacttttattttggtcatttttctacataacttttttcccaacagtttgaaattgaatttgaatatataacaaatttaagcagcatttgtaaatactaaatgatttcaaatggaaaagtcatcaacaaaaaagttgtagagcttatcaagatctacaacttttgttttggtcatttttctatataactatattcccaacagtttgaaattcaatttgaatatatgacaaatttaaacaacatttgtaaatactaaatgatttaaaatggaaaattcataaacaacaaagttgtacaactcatcaagatctatcacttttgttttggtcactacttcatctgatagtaacactgtttagaaaattgacacatcagtattgatgttcataaaccagatgagagaaatgtgatttttgtgaataatattactatcactttgtcggatgaaaaaatgaccaaaacaaaagttgtagatcttgatgagttgtacaactttgctgtttatgacttttccatttgaaatcatttagtatttacaaatgttgtttaaatttgtcatatattcaaattgaattttaaactattggggaaaagttatacagaaaagtgaccgaaacaaaagttgtagatcttgatgagttgtacaactttgctgttgatgacttttccatttgaaatcatttactatttacagatgatgtttaaatttgtcatatattcaaattcaatttcaaactgttggaaaaaaatgaccaaaataaaagttgtagatcttgaaaggctctacaactttgttgttgaccatatttccatttgaaatcatttactat

SEQ ID NO: 71566 - DNA, 801 bp, Oryza sativa
  unsure (1)..(801): unsure at all n locations
cagcgggtcaacggcaagcacggtccttttcttagccacttctcataggttgattccccatttggccccaaatccaggtcagtgtcagatccaggtcaatgtcaactttttttttaattattcaggtttgttgcatcatgagtctatctgattgagtttaataacacctgcagatttttcttgttcatccgaacggatatttggaacataggttttaaacgcatgtgcttctagagtcatcatctgtagatgcgggtaaagcgaagaaccggacagagcatctaatcacatatgggtcacagggtacaggggaatgagttgtttggggttcacatttaaattgttgatgacctgtattctcatgattcactttcaagttcagttgagcagtctctgtcttgcttgttttttagtgctcgctgtgattattttcttcatactcagcattcttttttttcttcttttgagaactctcaggttaatttggtttccttccattgttaacgtaaatgccatttgcatcctatcttagtaggatttgagaaccattcctcgaaaaaaataggaattacatatttgagttccttctgttgttaaatggcatccctcttcggtctngttngggtttgtgggggtcgggnttcttggggtctggggngcggcgctgcggggcgtgcggagtcagcngtgcctgcgtgnngaagaaacgtcannaagaaggaggcggaggagngattgaggagcgaacggggcgaggtannnagaatgaagctagcgnacccggagggaaggcctggccgt

SEQ ID NO: 71567 - DNA, 6612 bp, Oryza sativa
  unsure (1)..(6612): unsure at all n locations
cctttgcttcctccactcaaatctagagcctatcttgtgagattgagagattagattagagtgtaggagtgttttggagatggcttgaagattaggtttaattgagcactttggatatcttgtgggctgtcacttggacttattactcttggagatcttctcttagactgttaggtgtcgcccgtgagcttccaaagatcttgtggatgtcccgggaaagtttgtgaaggttttcctcacctccgcaaggaaatgatgtaagtgagtaaagattcttgtgctgagttttcagaagttgtcctaggtagagcaacttgcacttgtggtcttttctagaatgaattgtgagttggatcttggtggtcactcaattctagaaaatgacctagaagtgttgagttgaaggctgtggactccttatgggatctttgcataagtgatgcaaggggttaatcgagacccggctctttgagcacccaatggagagtaggatccgtgtgatccgaacttcgggaaaaaatcgcctttgtctctcttgtgcatgatctgtgtttgaatctgctggtatcttgagatctacatcttgtgcaactctgtgcctgatcatctctagctaggacctgttttacttcccctaatttcgcttttctctgttgcccggaagttcctggctcaagaacttcggaagttccgggctactcatcctgcccggaagttccagtgtttatcaccaggaggttccgggccctgtcaatttaaccgctgcaattgttgacaaaatttcaggaaagcctattcaccccccctctaggctacatctctgcacattcaattggtatcagagcaaggtgctcttgattcaagcttcaccgctttgagtgatccacgatgtcggacttagggggaaaggacagggaaattggaaataaagatggagcgagcagcaagggaactccatcacccaagggagccactataccttttgattacagctaacttaccattccctctcacaatttcgtctctgtgccttccggacgtgctctcaatttgatgggacacattacgccgcttagaagcacaagatgaagttgcatctaatctctttgcatccaagtatttggaaagttgtttgtacacgaattgacgcacctcatgaggacatggagctcacttcagagcaagaacaactcatccaccgcaatgctcaagcttccaatgcaattctctcctccttgagtccggaggagttcaacaaggttgatggactagaggaggccaaggagatatgggatactttgcaattggctcatgtgggatctcccgctgttcgtgaggccaagattgaattattggaaggaaggctaggaagatttgtgatggatgacaaggagacaccacaagagatgtatgataggatgatgatcctcgtcaacaagattaaaggacttgggagtgaggacataacaaatcactttgttgtcaagagacttctccgtgcttttggtccaagaaatcccactcttgtatcaatgatacgggaaaggaaagacttcaagaggctcaccccaagtgacattcttggaagaattgtgtctcatgagatgcaataagaggaagcccgtgaagtgaggcaaatggtgaagaatgccgccatgatcaaaaatcaagaagttgctttgaaggcaaaacaagaagaacagtcaagttgtgaagaaagtgaagatgaataaatgacttttattgtcaaaagattcaatcactttcttcgcaagagtggctatggcaaagggaggaaggatgatgacaagggaaagaggcaatcaaagagagcgtgcttcaattgtggcgaatatggccatttcattgccgattgtcggagcgtgctcatgttgcggaggcacacatggtggaagtgtggtactccggcgatgaagaagatcccgaggtcaagcccaagcccaagtcaaaagacaaggttgaaggagaaggtggtgttgctaccgtcgccttcaagtcatcttcttcaagcaaggagcgtctcttcaacaacttgagtgatgacgacgacgactcctaccactactcttgcttcatggcccaaggctgcaaggtgatgactcaaaagccctctcaaacttctcttgatgttgattctagtgatgaggaaagtgataatgaatcagatggtgtgcttaagagctttagcaaacccgctatgcaacatttggctaagttaatgagagctttggatagtaaagaacaatcactcgaaaggcaagaagaattgcttactcttgagaagaaaagaaaccttgccttagaggagagcttagctaaagaatgtgctaaaaatgaacaacttgctaatgagcttaatttggctaatggttctttagctagccttagagatgtcaatgaaactcttcaagagaaatttgctagtttagacaaaagtcataaagatcttgaagttcaatttgacactctttggaatagcacctctcaaccaaatgtggtttccaattcttctaacccttctactagcaatggttgtgctaggtgttacaatattgatttgaactcttatgccactaatgttgatgctatgcaagctcttaagaaagagaatgaaaggtttggcactttggtgaaatatgggtgcatgaagacataccattcaaaagatgccctttacaagaccatcaccgctcatcctaacaaggatggacacgggcttgggttttcgggtggaagtcctgtgtctaagcgtgtgatggtaaatgggaaagaatgcttgatgtttgtgagagaaggtaaagctccacaagcaagtgaggtgactagtcttgtgagtagccagggacccggaacatccggacaaaccgggcgaaacttccgggtgggagtctatgtctctcaaaaattcccaccaggaagttccggccagtttgccaggaaattccgggccaatggccgtgcacaagacatgaccggaagttccgggcataatgccaggaggttccggtcagatggtcttcactatgattcatatgtaatttccaaaaattcagagggcaaagtggttgcttattttaatgggaattacaatgatgagtaccgcacttgtgtgtgggtgccaaaggctttggtaactaacatcaagggacccaaacttagacaagtttgggttcctaaatcctaagcttgatttcttttgtaggcatactcctccggtggttcaagttgggttgtggacagtggttgcaccaatcatatgactgtggagaggagtatgtttacaagtcttgatgaggagaacggaactcgtgagaatattgtgtttggagatgatggtaaaggaaaggtaattggtctaggtaaaattgccatctccaataatcaatctctctcatgttcttcttgtcaattcattaagctacaatttattatccgtttctcaattatgtaagttgggttacaattgctcgtttaccgatgaggatgtgaccgtctttagaagggatgactcctccgtagcattcaaaggcaagttaaagggtgatctctatcttgtcgatttcgatgtggatagagtgaatccggaagcttgtttgattgctaaatcctccatgggttggctatggcatcgtagactagcccatgttggaatgcagaatttggcaactcttctaaagggggaacacatcctcgggctcactaatgtcacatttgagaaaaatcgtgtgtgtagtgcttgccaagccgggaaacaagttgggaatccaaatcctatcaagaacatcatgactacaacacgccctcttgagcttctacatatggatttatttgggcccgttgcttacataagtattggaggtatcaagtatggttttgttattgttgatgatttttcccgcttcacttgggtgtattttctccatgacaagagtgaggctcaagatgtcttcaagcgcttcgctaagcaagcccaaaacctctatgatctcaccatcaagagggtgcgaagcgataatggaggagaattcaagaacactcaagtgnnnnattccttgatgaagtgggaatcaagcacgagttctccgccccctatgacccccctccccactcaaaatggcattgttgagaggaagaaccgaactcttattgaagccgcaagatcaatgcttgatgagtacaagacttcggatatcttttgggcggaggccgtgagtaccgcatatcatgccatcaaccgcttgtacctccacaagatcttaaagaaaacttcatatgagctcttgagtggtaagaaacctaatgtttcatattttcgtgtctttgggagcaaatgcttcattttaagtaagaggcctcgctcatctaagttctcacctaagatggatgagggattcttacttggctatgaatcaaatgcacatgcctatcgtgtcttcaacaagacctccggcattgttgaagtcactagggatatgacatttgatgaatctaatggctcccaaggagagcaagttgttgtacatgttgtaggtgatgtggatccaagtcaagctataggtactaaggctattggagacatacgaccagtcgagacacaggatgaccaagaagatagggatcaaccttcgtcatcgacatccaatagccctacagtgagtcaagtgttagttgacccggaagttccggaaccacagatggtcggaacctctggacctctccaggccaggaagttccgggtccatctgccaggaagttccgggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaaccaggggtgaagatgcacttggtgatccggattgggtgatggctatgtaagaggagttgaataacttcactcgcaaccaagtatggacgttggtggagagacccgaccaaaatgtcatcggcaccaagtggatcttccacaagcaagatgaacatggagtggttgtaaggaacaaagcccggttagttgcgcaagggttcacccaagtcgagggtctcgattttggtgaaaccttcgcacccgttgctcgctttgagtcaatccgaatccttttagcctatgccgctcaccatgatttcaagttattccaaatggatgtcaagagtgcttttctcaatggatctatctcggagttggtctatgtggagcaaccaccggggttcgaggatccaaagttaccaaaccatgtgtacaagctccacaagacgctctacgggctcaaacaagccccaagagcttggtatgaatgtctccgagattttcttttgaaaaatggttttgaaattgggaaggcggatactactctcttcactaaaaaatctaagagtgatttattcatatgccaaatttatgtcgatgacataatatttggttctactaattcctctttttgtgaagaatttagtagtatcatgactaaaaggttcgagatgtctatgatgggcgagttgaccttcttcctcgggctacaagtgaagcaagcacaagagggcactttcatctctcaaaccaagtacgtgaaggacattctcaagaagtttgggatggaagatgccaaacccatcaagactcctatgcctactaatggccacctagacctcgatgataatggtaaatgtgtggaccaaaaggtatatcgctccatgataggatccttgctttacttatgtgcatctcgtcccgatatcatgcttagtgtatgcatgagtgctcgctttcaagcggagcctaaagagtgccatttgattgccgtcaagagaattctaagatatttagttcttactcctaatcttggcttgtgatatcctaagggttgtgactttgagcttttgggctattccgattcggattacgccgggtgtaaggttgatagaaaaagcagaaccgggacttgccaatttcttgggcggtcccttgtttcttggtcctccaagaagcaaaattccattccattatccatcgctaaagctgaatatgtcgccgccggttcttgttgtgctcaactcctttggatgaaacaaaccctaaaagacttcggctacaacttcaccaaaatcccactcctatgtgacaatgagagtgccatcaaaatagccaataatcccgttcaacactctcgaaccaaacacatagatattcgccaccagtttttgagagatcatcagaccaaagaagacatatgccttacacatgtgagaaccgagagccaattagccgacattttcaccaagcctttagatgagaaaagattttgcgagcttaggagtgagctcaatatcttagattctcgcaacattaggtgatgggtggttggctaatttatagtcaaacatgtatcactaaaatgtaaattaaaaaaaaattgagcttttgt

SEQ ID NO: 71568 - DNA, 675 bp, Oryza sativa
  unsure (1)..(675): unsure at all n locations
ggcgaattcgagctcggtacccatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaagtataccctgaggggactcactttatgattccatggtttgagaggccaatcatttatgatgtccgtgctcgtcccaatcttgtgagccttcttcacctagcacttgccttgtgttccggcagcggagacttccagttcgcctatcatgggttcaccggcaccaacctcacgctcgacggcaacgccaccgtcatgccagatgggatccttgtgctgaccagccgcaagaccaacctaaaaggccatgcgttcttccccgcgcctctgcagttccgcacatcgcctgatggcacagctcggtccttctcggcccccttcgtgttcgccatcatctccgactacaccgatttctgtgcccacggtatggccttcatcgtgtccccgaccaagaacttcaccaccgcactgtcggttgggtacctggcccttctaacgtncagaacaacgcaacacgaccaac

SEQ ID NO: 71569 - DNA, 14711 bp, Oryza sativa
cacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggagatggaggggttcctgcagaagctgaaggggctggacgcgtaccccaaggtgaacgaggacttctacaagcggacgctctccggcggcgtcgtcacggtcgtcgcctccgtcgtcatgctgctgctgttcgtctccgagacccgtaagtgtgtgtgcgcgaagcagccgccgccgcgcggatgttgtgtgctgttcgcgtactctcccatccgtggccgtaatggctcgatgtggtttggaattcgaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaggaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaaatttaagtacttaaatatttttattgtcaataccttattttttacatgaggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttctggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaaaatatatgtatggcaaataatgttgaagattgcaagataattaatatagtctatatagaggtagtatctcttaagaagccactattactggaagtccctgagaaatgattttattcctcagtcccatatctgccttgtttctctccactaaccaattagaacaacaaaaatggcctactcctgacgtagtggcataccgtatagttagatgcctgttgcgcgtatactctagcctttctatactagtatacttgtgtctagtgacaagctagtgtggcacacctctctttcatgcttttgctttgcaaggcagggctcatttatgagtgaaaagagtgaggcgacgtcatttctcctactatttactggaacttccgccctactgatttgttttccttgggcatgacagtgcaccagagaagattttgtggaaagagttaaaactcaacaaggtgaaggttgtaatgtacatggctttttagatgtcagcaaagttgcagggaacttacactttgctccaggcaaaggattttatgagtcaaatataaatgtgcctgagctgtcggcacttgagcatggtttcaacgtaagtaggtccaataaatgttccttttccttaaaagtgtttttattcagtgtttctgatatgtttgtgtataattttaccagatcacacacaaaataaataaactgtcttttgggacagaattccctggtgttgttaatccacttgatgggtacgtccatagctctagctcattgagcatataattatagccttgcacttattctcctagttatatatttcttttttcaatttttatctttgtaccctcatgtcctaacaaatttcatgaacgtcagtgctcagtggacacaaccagcatcagatgggacataccaatacttcataaaagtgagctcttgttatccatgtttacgtgcttacatttgtatcagttgtttctgctacaaaccatcatttgaaaagaaacttactgggttttgcttaaccaggttgttcctacaatttacactgatctaagagggcgcaagattcattccaaccaagttagtgaagtttattgaatcatgtttatactttatattttttttccaagcctagtgatcttattgttacttgcattcacagttctcagtaacagagcattttagagatgggaatattcgccccaaaccccagcctggagtatttttcttctatgatttctcacccataaaggtagtaacaatggagagaaattcgtatgtagtcatgttcatttttctctttttatgattctatcttagcttgctctactcatcttctcaacctgtggatatgtgttgccaagctcatctgttgaatggctggctgtgttggtgtgaccattcttgctgcacatgcagaatgctccaaattcaccatctgttattattcagtactatttaattactttggacacaagagaagtctacaatacctttgtttcacctttatctattctgacactgcaggaccaaactggaatttgtaggctttaggtcatggagagtttctaaagttagttattatactagtcagtagctaaaagaatcagttcattgatgagatatatctgttaggagtatcctagcataaaatttggtattatccttttattatttttattatttgctgaatggctccaaaaatgtctgcatatgcatcgtaacactttgaatacaaaattgacagtgcatgtctatactcattcaaaagcctctagtggtggtggcagggaatttgccaccccactattgctttttgcagtttttacaaattgtcccctgatatttttctaatattgtggaatagttcaatatttggttcaaacaagtgaatagcagataatgaaataaacaaacaattgatactaagatatttgataaaatatatatttttcttacatattatgatattgtttttcttctgcccatagcaaagcttgggcattttgctagtactcaaaagtcaaaacttatacatgtggataacatacagtttcgtatcaatataacgattaactaattctcatattctcttatcagattgaaaggtactccttttaagttttaactctttagttctgtgacccactaaaatcttagttctccaccttatgtttttgcaggtaatatttacagaagaaaatagttccctgctccactatctgacgaacctatgtgctatagtgggaggtattagcattacctctattttattctcaaactgattaatcttttttattctattgtagtgaatgagtgttatctcttcagtcttcactaacaaattcttataattcttatacatttcaccgaaaactccaatgcttatttgacaaagtttataattagtttgttactatttgcctaagtgatgaaccgttgaaggaattggctctgtttatctatgtgcctgtgtataagtaatgtagcaaacctagtatggatgcaagtcactaaacttttgtctgccttgtatcctcaggggttttcaccgtctccggcatcattgactcgttcatatatcacgggcagaaggcactcaagaaaaaaatggagctaggcaagtacagatgatttacctgaaacatggactggccctcatgttccccaagttcccaagttccgtggcttgtaaaggatccattgcttaagacctgaagacgttgctttgctggaaggttttgctaaggccatcagaattgacgatattgcacattagttgatcaaaaactcgtttacatgtaaaaaaagacaatatcatagcgttgggcctgggggagtgctttgatgtctcagtgagactctttttgagtggccaaaactggcgaaatgagatggatagattaaatcaattttaccactgcgtgtgccatctaacactgtttgacgttttctgtatttcttttcaggaagaactagaacttacattttttttgttctttttttttgcttcatctgagtgcattagtagagatataacccatttcttgtaacttcagggtgttcaaagagacaatttgatcattttcgtgtcacgtccttctgccatcgtttgacgcttgcaatttattcaggaagaactagaaattgcagttttgcttctctgtgagcattagtagagatacaaaccatttttaaatagtatatatatattgtggttatttgccaagttgttcgatatacaaaggatttgaatctctaatcaacgagtgagttgacctagttcctattaaactacatacttgatcagatacgtcacgattaattaactatcatgttcttagtttaagtaagaagatagaattagggagtatattacgattaaattattgttaatctgattcaccttgtactttcatcaggtcatatgcacaatccaaatctctagagttcaatggataagaagaacaaatcagaactcgcatcgactgatctgcacatgaaccctcatcagaatggtcaatgaagagattgcgtggccacgaggttacaacataatatttatcatataaagatttcactgcaattggtgaatctttagtaatttgatccataggcgaagtttctcctataatctccagctttcttcatggaactgcagtttgctgctgatatacaggagagtaaaaccaacttaatctaccaaggcaagtgcctgtaaaagaaaaaaaaagatgtcttaaacaaaaagtacattgaatgaagggtaacaaagcaattgtagagtgatgtgagtttgtcttttaggtttgtttttcaggaagctacgaatttagtcctaagataaacttttgatcctttgggagccctttcctaggttgggttaccctacagaatggtctaaattctaggctgtttgaaccaaccttctgctggaaagcagctttctggaagctcaaagatttgcataaataatttttttttcaggaagttcatgcttgctgctttctacatgtactatttggttcaaaatgatatttactttaaaaacaatgcaatgatttgctttgttttatactcaattttaatttacggaaaatcacaaaagaaacaaagggggcaaacggtaaactaaactgcaacccaaaaggacacccaccattctatgatttgacccaagaacatttcagttatagttagctggggacttttttttttcagaattgaaatttaagtgcttctgcatacgcatctgggtaactgggttgttttggcaagaaatttagtggcaatgtggtagctaatttgttaatccaaaattatcatgaacttcatctctactttgtcttgtgactaaccattgctggtcaaagatggaaatacatgcagttccaacttccaagtttcatgtggtcagtagtgaggacttacatggaagaaacctctcaacttccaaagctcaagttgatgtatggtggtgtttggttggaggaactaaagtggggctaaactttagtccctctcacaaaagcataagtctctatggtagggacttatgtttttgtgagagggactaaatttagtccctagttcccaaacaccccctatatttcaccattaatctgcataaactaaatcgcactctgagcataccagatcaatcatacaccagctatttgttttattttcgaagaacctcttaatccatcagtccatacatgcaaatcactattagcaaatttaatagcccatgagaaaaaaaatttgcaacttgaagtgcattaattgtataagtagttaacgcgcaaatgtacaatgtataagtagttaacatgctctagagttgagacagcaaacatggacattatccaaagattccccatactcccaatcgttcttagcttagtattcgaaagtacaaatgccagctaagttcaaatgcaaataatgtagaaggaattactttagaggcccaccttatgagtgaccctatgaaagatctgaaactttaaaatctcttaattattcatagcaagaatgagcaaattgttgctgttgtgtccaataatggatgtcctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaatgaacacgcaaatcaaaaatataatggcagctgatatcctgcagaaattgtcagcatcagattggtcgttttcatttcacaatcccaaaatgaatgtcatgtacatggaagaagaatctggccgtctctttttcaaggctaacagcaacctccgtgtatggaaacttcttccaaccattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaagagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatcatcttgaggaaatgcgagaggatgttcctcggcttcggcgaggacaggttaagcgcgtcctcagcttcgccgtcgaccgtcacgacgcggtcgatcttgacatagacatcatggacgaggggcacgagcccgtagaaccgcttcgacacggcggagcaccggccgagcgagcgcacatcctcgacattgttgaggatcaccagcacaagcgagtccggcagccggtcgaattggtcggcctccagcaccgggtcggcatggattcgagccattggaaaccacccgaaatggagaaatggatcaaacgccctccccccctcccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctacctcagacaccgcgccaccaccaaatcaaccgcgagggccaacctttcgccgcccacacgcgtccggatccgacgccgacgagcaaccgtacggtaccgaaatcgcgaaatcgggagaagggtcgcgccgttttctcaccggaatcgagagtccccccctccacgcgcagctcctctccgaccagccggagatgccgaaagagcttcgatcttggaggccggtgggggcgaatcggacgggattagggtttagggagaggggaattggggatgagatgttcttgttcttgcctctccttttctttcgttttcgcgaagaagaagaagagagtttccctgggcgaagtgcttctctttcttctctttttttttttttctcgtcacaccactcgacgcggctctcctttaatatcgtctcgccgccgttaaggtgacggcctccggcgccgtcagttccacgtcagcagtagatgcgaacaagcgttcagtaaatttttcacttaactgcacgttcaccaccatacatgcaacatcctactctcgggacccgaataaatcacagaaataaaaaaaccgaagaagcatgaaaaatatagaattatgttaggaatgcctctttaaaacatatgattgtaaaacaaaagaaaacacaaaaaatgaccgtataaaagacacatgaattttaaggagagacagagactcaaataaaacttttcatgaggttttccctcatgttaaatttcctctaaaagttacatggaatgagacatattctataagaattttatggggttcatttatttgtttcaaatggctatatgggaaaaaaatcctatagaaatacaattcctacatatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccgggctgggttttcactggccatccaccacctaccaatataccacagatgcaccattgctccactgccaactaaacctccgccgccgcgtgggcacaccgcaccagtgccccccgccggccagtctccacatgcagctacctcactgggctccacctccattggcttcgcctcccgttgcgcatccatcgtgcgccagccgtccttgacgccgccggccacactgcaaggctaccggccgcaacactctaccggcattggccagccacagcccccggccctcgtcgttgccctctgccgcaggcgcggcctcctgcccctccaccgccgtcacggcctccgcacctccatctccagcacctccgcgctgtcgcgcccgccgctgctagccgcaccctccgtcaccgacgccctgttaacagtgaaatttggtaagcccaaatttaccatcggcttagagtcagtatcggcttcaaagttttagaatcagccgatgggagtcaagtcgccgcgatgtcgtgttcttggtggagtcggatcaatcaaatgaatcttatccagaagagaccgagttcaaagagaatgcacatggcaagttatctattaattatgaatagtttgttagtttccttttatctttagaaaagtgtgtttagtgtcctataaggactttatcttttccttctatctttaagaaagttgctttcttgtctgacaaggacttgtatcaacccataggtataaatatgtacacccggggtctatgtaatctatcctcacgatcaatacaattcggtgcatcgccaccttttaccttttctactttattttatcgaccggcaggacttggcacctgacgtggggctacatcgttgttcgatctccggcgaagggataagtccaatgttccgtcggcccaggcaattgtctcatctacatcggcgtcgttcaaggctgcatcagtatattcgacctcttggattgctctggtttggatgatatatttgcctacctatttatcatatgtctatgttaatctagtcttagcatatcaatttagctctatcggctgcttctcgttttagggtttctgccggtatcggctaaatcgcgttgctatattagattagcttagacatctaccacactgaaaactcaatcaacggcttgattgtctagatattatttttcttttcatacttagtgttgcatcagttaagtttgatctactaagtcgtgtttagaactataatctatagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagccgatgtgtgctttaaccttcagatcgatgcttatttatcatatcattgctagccgattggtttctactggattatatttctatattatatcatcataagccagttgcctttatatcattatctacattggacatatagccgattgcttaaaccttatcgctatcggatggtatcagcatcggctattatcggctatcggctggaactactccgttggcttgtcagccgatctgctgttttgatctactatttgcatatcttgt

SEQ ID NO: 71570 - DNA, 29116 bp, Oryza sativa
gaggagttggcggaaagggaggattacctgtgtcgactttgatggagatttgcggccgcccatccttgagcgtttactttggtgagaaggttgagaggtgaaaagaccaagaattgcggctaggcataggggttcaaccccttttatggaacaaaaccgcatctatcccttgttgccataggcacataagttcaatcccatatttaccccctaatctctttgacatgtgggcccataacccacatgccattgtgagattaaggggcaaataagaggatatgcaaacttttaggggtgaataaggaatttatcgaaaggggctaagcatacaaaattgagtaaattccttatttgcccttgaaagttgatttcgtccctttttgcccttgcaaaattgccctccaatccattgaccacctttctcaacttcccttctttatttgcctattgatacatcaaaatacatttttgctctagtgaatgcccttctttctcatctttattgttccttttgccaccatggcaacacttaatcctcattttcattatcagttcaccggtgatatcttgtatcccgtcatgtcaaaaaaaatatcttgtatcccacctcttggttggttgtaccctcatcaattggcacctcctcctcacctcctcaatcctgacctaccactccactattggcaacatcttcctccattctcacgcagtcacacagtcacagtttttctgattttctcattaggaaaaatattcttcagcatattcgcagaatgaatgagactcttaaagatatagtcttagctggttacgaactttgtaaggattgtggttttagtaatccttgttgcctcttaatctctactacttagaggtggagtcgtccgtctgccctccccctcatgacgcacagcacgagtcactacctccccaagaaaaccataaaaaacaaatggtaaaaaataccagttgtatcccatgctttaggttagacccacaccccaccatcgtatggtcagttgcaatgaacggacatattactagttaaaagcgactattggctgtcacctggcagtattctcctaaaaaatgcactatctacatgtgtttttaggtatttggttgatttagatggttgtgtatacaacttataaaactgtggatagttatatgttggttttttaactatagatctttagtatatttgtttgacatatgttggaacatgtgatcacattgctcgttatattgcaaataggcactatgtcatgcatggcaaactaatgaactgttgatggaaaaattctagaaaaagtaatagagatccataatgagagtaggtgaattacaaccagtccgaaaacccaaatgagggtgagtgcaagcaagtttaaaagtggtactttagaatatgtgactaaaattcaacctaatttgacaggcgaaaattatacttagtagttgatcactagaaggcaaaacaaaagtgctaatgcttacaaaataatttgaaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacacaggcctactataactggagactagaactcacaacccatggaagtctaggattaacattttgtgagtagctttataataagctggtgttccaactagcctcaagaggccacgtatttatggaccttccatgtataatcctgaatagtagaattagctatgtgatactaaaccaataacatgtttggatgagcttgagatgcaaactcgaaatttccaaaagtgacttccaaaattaggtggtgggtcagcaagaaacaatgaaatttcatcagaataacacatgctcttttttcactcataggtattgcaacatactgaacaaaaataaggaaaagggactggaaattaccatattaaacgtaagcattcaaacattactctggtggatcaaattttatcaacaataagccacttgtaatttgtagtctcttgtatagatatacacaaatgggtacaaagctcattctttggctatatttagaatgcacattccaaatcctataatgacttgtatcatgtgaaaatcctacaaaactcagttgtcaggcccttactatagttagcacctttatgaaggtaagccacagatataaagttttctttggttagtttgaacaaatcctaccctatattcacactacgaactgagaagaaaatttccacccaataaaaatattttaggttcttctccctcattcaactatacaatgggtctgtttggcacagctccagctccagctccacctcttctggagctggagctcagccaaacagtttcagctccaacaaaaatgggagcggagctgggtggagctctctctcacaaaatgaactagagaggtggagctgggtttaggcagctccataactccactccagacccaactcctggagctaaatttaggagttggagctctaccaaactggcccaatatcagcacatcatctcatgcacacctataatctctcccattgatttcttgatcagatgcattgaccaaatatgaaggctacttgaggaagcaaatctatggtaggtcaccattcttttgtaaccaatttctaacatcaccttggttgcttagttttggggttgatttatttaagtcaaccaagtaaagaaagattttctatgtaattgcttctcccacaggcaccaattttgagcagtaagaacaaaagcatgaccatccatgtgcagataggttttagtttagtgtagttcaaatctcattcattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaggtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttggtttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagtttaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatacagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacgatgcacgactggaaactattcccctgggccgggacgaacacgccgtcggctgcgaatcgagatgacacaagatccatccgccggtgagcagcggcgcggccaccgacctaatctgagttttggcgatggcgagaccgagagttagcggcgggaggcgaggatctctctgtcgcggtggagacggggacgaggggtttgtgcttgtgcccttcgtccctgtgaacgaatcttgatgcactccgtgtaaggtggtaaggctctgtttgcgaagcttcaccttatctcgtaaaatctgaagctcttccaaataatcccactttttttttaattctaagaagttagttatagaatatggaaaatgaattagagagctgtttgggaagctttcatcacataatctcccactccctaaaccgtctatattttcacccatattctaagaatctttactcgtagaatctagaaaataaactagaaatctaaaactgaatctaaaaggctggctaccaaccagtagattttcagaatcttaaactactccaaacaaaacctagaaatcggatgctgagaaatctagcttttctaagccggctacatccagctatttcttacaatcttaaactccagacagatcctaaggctaagagaggtgcaaaaaaaaacaccaacctaccgtatgaatatttttgaaatattgagctaagattaacgaagttacgagctggtagctcgctattgataagtacttcctccgttctacaatgtaagtcatcctagcatttaccacattcatattgatattaatgaatctagatagatatatatgtctagatttattaacatcaatataaatatgggaaatgctaaaatgatttacaccgtgaaacggagggagtaccaaactgaaggaatgggctagtaaatcttgaaattaatgaagttaccatgtgactatcaattgataggtctcactaaaagagcgggttcgactagaaaaaacttgattagttaagttacgctcacttaaaaaaaccaaacattttcttgtaatgttaaatttaactagttctaatcatgaagtgtacgacctacatcttatttacggtattgttaaaacagattatttaaatatgttcctagaaaaatctccaactgtttgtaaggtcacttatttttttattttaaaaaatatttctatatagttacatagataatttataacaatactccacttaatataaatatatattaaacatttttttcattttacaagaaccagcccaacttcccaaatggccctcatcaattcgacctgggccactcggacgtttccgatggactcgtcaagcccacactccccccaccgatcagacagtgggcccttcatgggcccacgccacgccctcctccactccgtctgacctgaccatcttccacccagcgttggtctcgtctgcagcctcgccttcacctcggcgggtagatctcgcgggcgcatcgcgtcgcggggcaaattcatcaccttcgtgaggcgcaaaaccctactgcccttgacccctcccgctcccctcagatctccccagggtccaccgatccaaggtgaggcggcttcgtgctcggtcggtgtgtgcgtgacgtgaggtttcttgttcttgattttggtttcttgagttttgaccatggtggatccggcggtgtgtggtggtgtgtggttgcagatggcgagcacgggggggaggtcgatggcgctgtcgctgctgctgttcgcggtgacgctgtcgctgctcgagatgtaccgggggaggttcgcctcgtcggagctcatgaccatcgccggcggattcgtcagctccctcctcttcctcttccttctcacggtgcgttgaatcgtccgctcccaaccctcctcttacgatcttataccccttaataagtttttaagttttgctcgtgatgccgttgtttgtccctctttctttttagctaatttgaagtgatagaatcacatgagtggtaaaattttcgttttattattaatttagacaaaccccgtagcaaatggagttgccaagatgttgtctctcgtagcttttgtcacatttgagtgattcagtctgtaggggataaacaccatagaagaaaacatagttttgctctgtgcagaagtgggtagtaacattgtgcttctctgaattgtaatatccgactaggcgcataagcgagatttcggcttagaggacctggaactagtttattcaggttcagttttccagatatccacagaagaatagcttctgaaatatcatacaccatctaatattaagttcactctctacacaagaagtcaaggatggcttctgaaagagaatagaacatttaattttaagctcacttggtactatgtaggctaagctatctgctagtatttccatgatgctatcataattcttgcaaagggcatgttaagtatggaacctggagcttcgaacttttaaccttttgagccaagataatagaactaaagggggttttggccaaaagcatgctaagccccaagagcatccagcagaactagcagccccaatgtccatactactagtcttatctgatggtcaaagaaagtatccttgaaatggggtacttatcccagctttctgctctgtaacaagagaacagtgcaagcagacccttaggaaggcaacaaaacttagcaaaaacaagcacataagacatagtgagcaggtggtatccacatttgattttcaccttttatggttgtattaaaagatcagtgagttttgcacttttttaactgtttcctctcaacattaatattagtatatgataatttgatatacttttgcagtttattggcaactatcaggaagctaatggagttaaaactggatggggtgcaggtatgtatagtcatacgatctcattcttgctgcttccccctgatttttatttcgactttctttaactgtctctttctttgcagttgttgtcgcggaacttactgcacttattgttgccggcactgtccatcgtgtttgcatcacaacatggtatgttatctttaagacactttactatttctttctacggacatttagaatttttctatatggtcccattaacacatccatagatctgagtgtttgctgtttgctaaataagaaaattcttggattatccagagatggtaatctcagacatactagtggagtatttgcttatgaactgttgctctgtttagatgggaggaaatgaaactaacaatttaggcaaaaacaagatactccactcctttgtttgcaaggagttaaaacttttttcatcctgttgaatgtgatatcattcaagatagtaatgtgtatttcacacaagtattttttacctatcttaagttgtatattgttaacactaatgctattggtaaatatggatttgtcacatgttgtaaaagctgtatttatgcaacaatgtcactggaaacgctatgcaatttgcagattacgctattcagaattatggcatatagaatgggttactagtagttctgttgaacctgtctatataaaatatcaaatcaattgcccttttatagcctattatgcttgcggtctaagtcccgccgctacttggcatttttttaagcaacttgacacattgtggataccctcataaccatgactttggagagttctatgacagtgagaaattgatactttggagagttctttgacagcgataaattcatattattaacctttggtcagtctgtgcacccgttgctgcagtccttgcgaatgtgttaatcaatttttatcaactttggctgcagcttcctgttttctgctggatttctctacgaggttgataagctctctggaatgattctcgcgaagagcgagtctaaagcgaggcggcactaggcttttgtaccatgtcatattttgtagatcaaatcaaaaactaatgttcacacccttcatggaactttcaacccagctagctttttcccccaggcatacgtataccatttgaattatgaattcctctagtgtgtttgcactgatgtcacagttcggcttttatgagttttatctaatgagaatggtgttgactaggtgatttcgatgtctttttgacagtctcctggtgacatcagttcatattttttgcaaagcaatgacacattttggcattttagacgtgccctgttgcaaacgttgaaaacattgtgaagtggtagctgtggttaagatctgaatttgtcaagcatgttgcttaacgttttatctccatcaactctggggttttcttgtttgcaaagcgcggcacgacaatgggaaatgtcaactagggacctctggaattattctatgggacggggtcatgtagtctgctttgagattggtgttgaaatcttccccgtggattatttatttatttatttttaccttttttatttaaaattttagaaataaaccattcaaaacttattttcaaatctaaaactgttggtcacgtggcaagggttttatcaatccagctagattgatttggcgagacaacagcccactttatagccattatgggagacgtagcagagttgttttgtcaagcagtgcgagatgacgtggttagaccaaaaaatttagatttgaaataagttttaggagcatttattttaaaaactacaaaaggttcgaaaataataagaattcacgtccatgcagggcgatgaaagcattacaaagccaaagctgattttaagttttaaaacttttttttagaactaattccgtgtgtttcttcgccgctttcattgtccaacctttccgtgatttagtgcaaaattattcctgagaattaagtaatttttaagaattgaaaaatcagctaagcatgcactcgtttgccgctttttgcatgaatctagtgaaagatcgcgattgacatgaacgtgcggcaatttgaccaaggctctccctttcccagccactctctttcaggtccacaacagtagcacaatgcaaaaaatcacgagcaaatcaaaactcgagataaggcatgacgaccccaattggcaacttgcccttttctgcaaacttcacaccgcgagcctgacgcggttgaagaagtatttattaaccctatttaattagggttaattgtgtccggccgacctatgagcacatgtggagtattaatgaaggtgtttctatgtttcgatccggaagttatttctgctaattttagattgacctaattttaagaggatgaaaggtactcacaacaactaaggtacaaatttaccacaaggattctcgtcgtaatcaagaagacataagagatcctagaatcatatactctctctctctctctctctctctctctctctctctctctctctttctgttctttggacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgttccggcggtgttgtgccagaccaacgcccaggacggtgagtgctcttgcctcgccgccggcgatcacctccgtttcttccatagatgattctaaagtcaggcaggatcttcttgcccggagaagaatcgcttggtttttgttgctggtgttgatgatcttcttcttgggcatgcatgcgtgcagctgcggcgctcgaggggctgaagagccaatggacgaactacccgttgagctggaactccggcgacccctgcggcggcggatgggacggcatcatgtgcaccaacggcagggtgacgacgctgtaagttacagccatctccttctcctcctaccaccaatatcatgtgatgggccttcctctgaaatcgtgccatggatgtctctggtttttgcaggaggctgtcaagcgtcagcctgcagggaacactgagcagcagcatcggccagctcggccagctcacgtacctgtaagcaccttcttctatcatcagttcatcacccagcttagcaaaagttcaaaacagcatgattttgcaggctatgaacttgggattttcgaaattttgttcatgcttctgtagcagttcagattgtgaattcaggcaatcaggctaggaacttctgattgaaccagtcaaggggcagattgtcagaacagtttgcttctagtttatgaactctgcttttttttttcttgaggcttagttcagctgaccagttcatgtttaccaatcttaagctttgactatttcggcaatgtgacatggattaggttcatttcttaccaaatgaaagaaacaaagatatgatgccaagttacaatagtaaatagatctggatgaaatatctgaagctttgactattttcgcaatgtgacatggattaggctcatttcttaccaaaagaaagaaacaagatactacacttgaagttaaattatcaatagcaaacgtacctggatgaaatgatccgtgacaaagttctggagtacaactaatttgtctaagaagaaatagtctagtagtagtagctgataacagaaacacttgcagggatctttccttcaacatcaatctcggtggtccgctgccagctgagattgggaaccttggggagcttacgacactgtatgcgccgcactgcccattgttgtcaacactactttttccaatcagaaataccaaactttcttactgatgtgcacaaatgctgtgtaattgtcaggatcttagctggttgcagcttcactggaaacattccaatagcaataggcaacctgcggaaacttgggttcttgtaagtggatatacctggtccacagtttcagatgataaaccctttttttcttttcttttgagtggattgacataatgaattcgtgccattctctatagggccttgaattcaaacaagtttagtggtggaataccgtcttcgattggcgtactcacaaacctcttatggctagacctggctgataatcaactcactggatctgtccccatctcaacatcaacatcaccaggcctggaccaacttgtcaaaacgcagcacttgtaagtaattttaatcttactttatggtattatcaattgagaaatatcagaatatgtaagtacttacaattgattgttttgctccaaacttcaaattgatgaacagccatttcaacaagaaccagttaactggaacgcttactggacttttcaactccaatatgactctcatacacatgtaagggatcgacaaattttcatgtctaatatgaataccgaatagatatatcttgctaacatctctccctatctcgtcagtttgtttgatagcaacaaattctcaggctcaatcccagctgaggttgggactgttagtacactcgaagttctgtaagtatcttgaaagttcacataggtggaactcatccttttattttctccaaaaaaaaaaatggtcatatctttgacttgcttttgtatctttgacagccgattggataggaatggttttacgggagcaatacctgctacaattggcagtttggtcaaactgaatgagctgtaagtgacatctgatcttaaaggaagagttatgacacttgaggcacctctcttgaaaatgttatcttctgcaggaacttagcaaacaacaagctaactggatcagtgccagatctcagcaacatgaccaacttgaatgttgtgtaagaaactaaccacccccatgcctcatcatccaatcatataatttgtctgcataactaaagattccactcttgaattgccagggatttgagcaacaacacatttgatccttcagtggcccccagctggttcacatctttaacatctcttgcttctgtgtgagttatccaaaacttttggaattttaaattttgtgtcgtcttgtgatgacaatttcatactcatctctatatgttttgatcactcagttcaatagtttctggaagtctttctggccaggtcccaaaggggctcttcacattgcccacactgcagcaagtgtaattttctggtaacttacaactcaacatataagctttaaaaaaaagtgtcttatctctgcctattttgtggccaatcggacagtgtgctgagcaacaaccaattcaacgggacacttgaaattacaggcaacatcagcagctcactgcagacagtaaatctcatggacaaccgaatagtttctaccgatactgcaagctacaagaaaactctactgtaagaacctgcaaactcaataagaaccaagaacaccatacaatcttcgtcttctctcctacctttcaccaacattgcctcacttctcatgccatatcctgtctgcagcctggcaggtaatccgttttgcgccgagcaagatcccaacaacagagccttctgcagcaggcagctacagaacgcgagcccatacagtaccagtatggaaaaatgcggctcagctcagtgcagtgatggtcagaacgtgaaccctgcaagctgcggctgtgctttctcatacaacggcaagatggttttcagggcacccttcttcgtcgacttggtgagcagtacgccgttccagctgctggagtcgaccatggcggcaaagctgaacctgctccctggctcggtcgctctctcagacatccacttcaacagtgacaactacctccaagttcaagtgaagctgttcccaacatccggggtgaccttcaacctgtcagaattgacaaggattggttcttctctcagtaaccagatttacaaaccaccagcaaattttggaccttatttcttcattgcagacccatatgcccccttggcaggtacttggatttcactgtgtcgagactcccactttatttgcactgaagtagttttagttttccctttgagaatgcagaggtatcaaaattacagcttaggaaataccacatttcgttatctgagggttggtatcttgaaagttttaattttttacttctaaattgcaattaatgagatgctaaaaggactctgctattttatgtcggagagtttagtatttgcacaaaagtactagtatatagtggtgtgaggattgctcactctgattttgtgtgtgccagttgctcttggtggcaaaaaatccaagatgagcacaggtgccatagctggaattgcagtagccggtggggtccttgttatcgccctcattttcatgtcattgtttgctctccgacagaagagaagggctaaggaactcaaggaaagagcagacccttttggtaaggatctaaaagctcataggtatcatgtcactgcaatgccaccaagcaatttgtcagggacacattaacagctacaagcagcagcatcctactgcatgctactactggaataaactgacaagatcaagaagttctgaaacaactgaacctgttttctgatccaaaattttcagcttcatgggctgctggccagaaggacagtggaggggctccacagctgaagggagcaaggttcttctcctttgacgagctcaagatctgcaccaacaacttctctgacaaccacgagatcgggtcaggaggctacgggaaggtgtacagagggattctcggtgacggaacccgtgtcgccatcaagcgtgcagaccgcaactcaatgcagggcgctgtggagttcaagaacgagatcgagctgctgtccagggtgcaccaccgcaacctggtcagcctcattggcttctgctacgagcaaggtgaacagatgctcgtctacgagtacatctccaatggcacactcagagagaacttgacgggtaaatccacatcccataattaacattgccatgaatctgattacacattttatttcgccatttcgtttgcattgctaaaatgattcttttatcaaatgttaactgaaaaggttttgatttgcaggaagtgggatgtacttggactggaagaagaggctgaggatcgcgcttggctcggccagagggcttgcctacctgcacgagctcgctgacccaccgatcatccaccgcgacatcaagtccaccaacatcctcctcgacaacaacctcaaggccaaggttgccgacttcgggctctccaagctcgtggccgacactgagaagggccatgtctccacccaagtcaagggaacactggtaaattcccctcactatccgctcatgccaatctcctgacagaactgaattttgagcctcacttcagtactcactaataaaaatctactaacatcttgagaaccaatcaaaatcgatatgcttaatttgaaatcaaacttgaagtaaatatggtaactaagcatgtacccattgcacttcaccttactaaccacttctcccaatctcaaaataaatcgataaaattcaccttactaaccacttcttccaatctcatgacaaattgataaaattcaccctactaaccacttctgcaagtctcctgacataactgaacttttaggttcgcttcagtaaaattcgacgaacatcttgaggaccaattgaaatagatatgcttaatttgatctgatagtataaagaaaacaatcaagattgaaacaaatggtaataaaatcgatgggatgtggctagggctacctggacccggagtactacatgacgcagcagctgtcggagaagagcgacgtgtacagcttcggggtggtgatgctggagctggtgagcgggaggcagccgatcgagaaggggcggtacgtggtgcgggaggtgcggctggccatcgacccggccgaccacgaccaccactacggcctccgcgggatcgtcgacccggccatccgcgacgccgcgcgcaccccggtgttccggcggttcgtgcagctggcgatgcggtgcgtcgacgagtcggcggcggcgcgcccggccatgggcgccgtggtgaaggagatcgaggccatgctgcagaacgagcccgacgacgccggcgccggggagggggacagctccgccgacccgtccgccaacgagttcgaccgccaccgcggcggtggcggcccgccggcgcacccctacagcgacgtggagatcagccggggatcgtacgccggcgatggcgcgtcggattacatgccctattttgaggtcaagcccaagtagtcatcattagattgtaaattgatgagggtgttgtttgtttcagtttttttttcctttgttctttctccttttcagcttgtgatgaattgtaaattttgtatgtgttgcgagttgcgacagattaatatatactgctacagattctttcaatttttcactgtaccaggtgcaattatacaaacagatcaattacgatacgaattttatatttggtgtttgaatctcgaagattaagatgaagataaaaattaagtgtttcacgtaaaacgaggtgattataatgtgtgattaattaagttttaattattataaacttgaaaaatagattaatctgatattttagaataactttcatatagaaagtttcagcataaaacgcacagtttagcagtttaaaaagcgtgttatttggattcgaacggcctcttagtaaagagtagattgtattagtagtacgagaacttgcaggtgggtacgatttagtgcaacaactcgaaaaatatgcagaccgatacatgaaattggcactcaagtgtattttggttaaaacgttgttacgtacatatgattcaacatattttgtttgttatattataatcataactactagattattggtcatgaatacaattgaatatgtttaactagtagaatcgctcggaaattatgttacaacaattcttatacacttagttttaacgatcattatatatttcggtttcaaatcgacaggatatttattattataagcaagcaaataaaatacatctagaccattattatttgataatcattatacttattagattattggcaacgactactgttttttttactatgtggcttaaaaggtgtggtgtctaatattattttttttagccagaatgcacatactagccaagttgttacacctaaatgatcattttttaagttgttacactagattgcacccacctatcaagtttatgtatcgtggacacaatttactctctagtaaatttcctaaaacccacctactatggttcaaatttcacaaaattccaactactatgatcctaaagtttcacaaataacactattgataatttgtattctaaagaaaaacattattgatcattttgattttaagctatcacaattattttgactttaagctatcatatattctggttttgtggttaaggaacataaaaaaaatctcactattaagttgagtgacctctgacgaacttattcttacatctatataggacgtcaaagggcccactaggcctcaccaagggtagtggcacgggcagaggacaaatttcataattaaaatgcccaatatggcaaattttgtggttagattaaggactccatcgaattattggcaatgttcaatcattcgaaaaccagcaattttcctcataaaataaagtaatactagtactaacctaatgaagccacgaaccttggttgcatcaatcaagctaacgacctaaatgattcgggcgccttccacacaagaaaaacacacatgtactgatgtacacaacatggagagggaaatggctacaacaacgcgcaagattaataaagcaacatattttgcctctgaaaggacggaaaagaattgaaaatattcattatttctaattttttttaactatatacacggttttagaagaattgtgaaaatatacgcgtcctgcgtgatgaaaacgtggaccgtgtgtttgacgtggcacgaaaatgcaagagcaacgatcgacgcgatcccgcggtgtgggcgcgtggaaccgcgtctgtcccgcatgccggttgagcggcaccgaatgcgggacggcatgcttgcatgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttgatagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggctccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacattcattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcagtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtactgaagatcccggctgcaaatcctgcaggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtaccgtgcgaaactggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagctagcgatgatcgctcccgcgtctgtcttcgtgcacgcctcacagaggacatggtacgtggctgctagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttatcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacctagttgtacacctctgccaaattggttgtcattatgccataccgagatctatcggtgtcgaataatagagaccacttctccttacgctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcattgtcaactcatccaacttgtcccacaactcattaaatttcttctcttggctctgtgcacatagcctcttaaagagctccataagatgcttgttcttgaattgcttgtagaaatttgcacccatgtgacgcatgcactaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatagtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgcccgaaagcgaacggccgtctgccacgtcattttcgccgccctctgggatggtgatttttaaaaatcgccctcccagagggcggtaggcgactacttccgtcaattttcaaaatggaaaactatttttgtaaaacttttaataaaaaaaattaaaaataaaaaaaattcccaacacgcgcgtcccccgcggctggttggtgggccggcccagtatatacagcgtcgcgtgggctctcgcaagccgtgggctctctctctctctctagtccgcttcttccctgagttcttcgtcttccccaacctcacgcgctctagcgcgcaatggcgaggacggggcggcgcggggcggcgccgccgttgctgctggcggcgacaacgccgacggggttctgcgagaccaatggagtggacggtgagttgatctctcagcactcactaccggcgaaaagcaaaaactgcttggctctcggctaatccttggagaaatattcttggggcagttgacgcgctgcggggtctgatgcagcaatggaggaactacccgtcgagctggaactccggcgacccctgcggcggcgggtgggacggcgtcatgtgcagcaacgggagggtgacatcgctgtaagagcccagctccttctgctgctaatcaccatatcacgcgagatcattagagttccggtcacatcatgacgaaattttttttataagttagaccttttaaaaatataattttattaagagaccacccggaaaaatattttcaaaactaaaccttttgactatgccaatagcagtggcgtggccaaacagagtggcggcaccaatggtcatggcatggcaagagctgccccatggcgatcgttgctgttgaaatcgtcaaccgggcgccaatgtggcagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaaaatagtacttgacgaagcttggggctcctcaccgggagaccgcacaagcccccctttgccggttcggccgggggcgctaggtgagtttcttcaccctcgatctgtggaatgttcgcgagagagcaaaacgcacgagacacgggcgatgtagacaggttcgggccgctgagaagcgtaataccctactcctgtgttctggtggatctgtgtgtgaaggagttacagagagtcggagagcaagagagttcaggctctagaacccctcttcctctttctctcctctacgagctcaggtattctcagagtcgtctcagagtcctccctccctttttcgttctccatcatcccttttcggtgggcaaggtcctccttttatatctcaaggggataccacatgcaccacttctacctactcttcttttgggtggggacccaccctatcttgaccaaaaacttggctcgcgccttcgcctggaagctaaatcacagcttgtccttgagtgaggcccagcgccgtcactcgcctccacttcgccggaagtagatgcagcgtgggagcacggttgtctgccgatgacgtgaccggcgtcagaccagtcacagaccggtcattcttgtccaccacgcgtcagtttagcatgccgcacatctgcccttcttcatacaatgacttccttgtaatggttgcgatgaagcctggcatgaatctggccgggactgacgtgccaactccaggagttagcacgccggctccggctagggacgagtgcctggaggctctcatcattccgacgggacggggcgaggcgtgtgacaggccgcctgttgccacctaacccgcgatctgaccggtgtcacacactgcgaccggtcacggaccggacgagcgcgcgctgcgctgcattaaatgcggcgtggcgcgctcgtccaagccgcaataaatgcagttaggtgagccccgctgtgctcacctaacccatacacgtggcgccaaaatcacagggggtcggggcgcccctgccctcggggccgaaacgggagcggcccgacccctcggggagacagagggaggggtggccatgtcaccctcgggcccgacccccccgagggggtcaggccacgtgggtgaccgcggctgcccaagcttctagtcacgatacccccggtcccatgtcaccgacagtactaaatgggtaaagattggataaagtatatggggtatttgtgaggtattattagaaaacttcgtgtggttttgatggacctgttttatgtgttgaaaatatgaatggttatagggtgtgtttgcaagtgcaggatgggaactcatccctcctgcacgcaaaacggagcggctttttaacacatgattaattaaatattagctaatttttttaaaaaaaatggattaatttgatttttttaagcaactttcatatagaaattttttgcaaaaaacacaccgtttaatagtttaaaaacgtgcgcgcgaaaaacgagggagaggggttgggaacatgggtttgcaaacacaaccatagtattggcgattccttttcgtttgagtaaattttacaaaactacaggtattttgaccaaattatcacaaaactacagattt

SEQ ID NO: 71571 - DNA, 7055 bp, Oryza sativa
atctcagagtcatcatcgtcatcatccgacccatacacataaggacacacatgattaaccttcttagagttcttcctagcttccgcaaatctctgttcatgcaattttaccttatgtataagatgtgacaaactatcaaagtcttcagatgagaatttctccttaatcggaccaatcatgtcctgaaaggctaaatcggctaattgagaatcagtcaaacttaagctgaagcacttattcctcatttccctgaatctctgaatatactcatgcacgggctcgttatgcctctgcttaatcgcggtcaagtcggataatttcatctcatgaactccgctatagaaatagctgtgaaattgtttctccaagtcgacccagctgtttattgacccatatggcaaggaagaaaaccaagtaaaagccgatccaggcaaggacaaccggaatagcctaactctcagagcgtctacagccgatgcctcaccacactgagctaaaaatcggctaatgtgttcataagttgacacaccatcttgtcccgaaaacttggagaaatcgggaactttaaatcggttaggaagaggaactcttttaaaccactcagggtaaggttgccgatacaagtttccagtgtcctttggtttaagcccaaactgttccctcatcacgtcagcaatcacatcggcccatggtcgttgctgagctgctccttgcgattgttgctgcgtcggctcgaactgattatactgaggagcgaactgaggttgagctagccctccttgctaatactggacttgtggggaagaaggtcgatactgataactcaaattgcccccttggtaattctggtaattcggctgaatattttgcaccaaatgctcgggcacaatctgaggcatcaccgtaccatctggctgcacatggtgagccaaatgctctggaacaatttgattcagggcgtgtccagccgattgattcatcaagccttgctgtggaatcggctggatagtttgctgtcctgatggtgtctgttgagtcggttgtgcgacctagcgtcttggcggcgtttgataaatcggctgttgttggactggatcaacaataggttgagggggtaaaaacatagcagcaacctggtcttgtgtcagccgatttgtcgcctacccactatgctgtggctgcttcctcatcaacaaccgaggattaatcagctgtcctggtgccgatgctgttggagcaggtaaaggagtcaatggcagtactgtcggctgagctaatggtgcaatgggaggaactgcttgagcagatggctgagtgccggtaatcaaaggccgataatttggaaagacgtctccctgcaaataaattgggcctgcagcctgatgctcggctattgatccgtcggctattgatttcatcaggtttgacaaagtgttaactaacaccccagactgattgatcaaagcgttgtgcacggcataatccactcgatcttgaaagttgttgaagaaatcctgtgctgtctcgccatcttgattaagatttcctccttgcagcccatgaacaccatcacattgaactccacgtaccccttgagagttgtcaccctgagtcttgtaagccgagtcatcggtagtacctttttgtcgcctggttgagccgattctgaggctttcttcccttctccttccttagaagtactagtctcaggctcatcaggaactatctttaccttgtatttctgaacaaatgttcccttgcgagtctgcatgaatgaatttaagaattgatcccgcgcttgttgcatcattgcttcaaaatccttcttatgatcaggtgtgaacttttctggatcaacagccactacatttccttcattgatttcccccaagcctagcctctggattttttccttaacagcccctgggctagccgaggatggtgaaggtggcagcttctcagccataagggaaattgtcttccgacttctaatcggtcccactgggcgtgccaagagcgtgttgacagaaaacacgaggcctgggagatctgcttaactacagtgcaggtccaaaactcgccttcgggtgtgtaagcgtaccagttgatttgatcctgtaatcaacaagaaatagagacaaagaaaccataattaatcctataaacgatagccgatcggctaggtgccgatgacatttcatttatttctgagccgatgtcatatatgtatcgatcggcattcatgaacaaataagaaggaactaaatctactcgatcggctgtagatattaatgatacatacttcctatatcgatatatacttaaatcaagtgattgggatagatcggacgccatgccgagacagtataaatcattagatcgaaatatatattaataatggaactatatacattcatagcatagccgatcagatagatctagcatgtatcggctaatactccgatactactctatattaagatattaaagcaagtagaatatatcaaacaaaagcctaatatacttaactgcaacaagatcttaatgtaaagggcggatttaacatgtcaatcatgcatatagaataaaagtagttaaatcaggtaagatcggctgaaaccctgatactactctaatcggcaaccagaaggcaggctagaggttgatattctaagcacgacttaatagatcaaactcaactgatgcagcattaagtataaaaagaagaacaatatctagacaatcaagccgctaaaagtttcatagagtggtggatattttatataatcaaaatcaacgtcacaatctaacctaatcggctgtactctaccgacagatgctagccgattgtaagttagataacgatattgctagagattatataagatatatgataactcgacggattacataaacaagattagtgtatcataatgatggaagcactaatcccgataacgcaaaccgccataacaagttttacctcttgttgaagatcgaaaccgatgtagctacacccgaaagcaagaactcgtcaaaataaaactaaagcaaaagggtggcgatgcgccgaaattgtattgaacgtgtgttgttgattacatgaggctcagggtctatttatacccgagaattacaagatatgtgtccataccggacatgactattatctctaacaaactctaagataccataagtctttacagcagacttttgcccaaacatatctctaaggaaataacatagaatatcctaattaatagatacaattgccttctcaggaatctatccttgcatggcaattaccatgaagcacattaacttaactcgatgatgtacgccgagtcgtattgttggaatcggttgtatcggctaaccccgtccgactcaaactctgccgatcttatcatagccgatttggatggcagccgattcttgctctgttttcacaacagtctccgtcttggattcctcttcgatctgatcttcatccccgatactgaggttaccaaatttggtcgttaacaccgccgccgccaccgccctcccctctcctcgtaggggccggatctgggaagtgaggggaggggagctgtgtccgccccaccgttgccccgtccgtgccgccgtcgtcgtccgtgctgccgtcgcctcgtccacgccgaagccgtcgctccccctcctgcagccagatctaggagcggggaggaagagagggggagccgccgccgccaccgtcgtcggcccgtccttgccgatgtcgccatccatgccgccgccgcgtccgccacgtttgtaccgctgccgtcgctgtcgctcctcctcctccgccggggagggagagagggggagccgccgtgccgctgtcgtcccctcctctggtcggattgggagggagagagggagggagggaggggaggggaggaggtgagccggtggggggtggagaggagaagagaactgttgagggggagagagagagagatagaaaaatgagtggcatggccggtggggaggacaagataaggatgacttaaagacttttttggggaggtacgatttttgcaggtggaccacataaggttccgcctgtaaaaatcatatttttccaggcggagcacttaagaggtccgcctggtattttcgcaggcggacctcttaagtggtccgcctggaaaaattgattttcacaggcggatgacgaaaatgcacctcggtttacatttttgtaggaggatatttggcttcgagggtcatacccgtctgcgaaaaaaatgacccaacatcggtaaaaatgccttttctagtagtgatgagaaactttttagggtacatgtatcctaggtatatacactggtggagaaaccatctttggtcggtcggccaaattccataatagtctggttctaataaaaaccgggactaaaaagcatctttagtcctagtttaaaggttgaggagtactttttgatctttagtcccggttgatagatcatttttagtcctggttcaaaaagttgtagggttcaagacagaccccaattatatttactcccggttagtataaacaaccgggattaaacagtaccccgaaccgcgcgccaccaactcagatattatccgcgcgcactcctctcgatctcctcccctctcatttctctttctctatcccttcctctcccccttcatccccttcctctcccctttcccctcccgttcctccccttcccctctctgagcggcggccgggcgagcggtagcgacagctgggcgggagcaacggcgcccggcgggagcggcggcggccggccgtctaggtgcggcaggcgggcgggcgggccgccaccgcgcgggctggcgtggcggccgaccaggcgggcgggcgcagcagccggccggccgagatggcacgaaggccgcgaggatggtggccgggaggccggcggcgccttactctctgctgccgatttttttttttgaatttgtgattcattggatttgatctgtgatgtatgtgatattggatctgatctgggagttgtgatgtatttcttttaggaattgtgatgtatttttttgtttgagattttgtgatgtgatgtattgtgatatgtgatgcatttctttccaatatgtgatgtatttctttccagatctgtgatgctatttgatttggggatgatttgggagtatgatcggggatatttagggagcagatcgatttgagaaaaaaaaaatcaaccgggactgctcccactatttttagtcccggttattttatccgggactaaagatacccatctttagtcccggattcgtagtcccggttatacaaccgggactatagggggtttcctatcaggagtaaagcccttttctccactagtgatatatgtttgatttcaagataaagtgggatataatgagatggtatcatcttgtctttgatcggaaggttgggataaaccttatttgaggacagaaaaggatggatgggacaataattgatgggattttcggataagagaaaagtcgtacacatgtacgtcatgcgtttcttcagcacatgacaagcaccccatccatcatcacgattgggctcaggggagtacgtacactaggagatgggtgtacagttgtaccctattttttttttcaaacaaatgtgatttaatatatttggtatatgtgtacccaaccggttaggcatcaaaacaatcatttgtaagtacaaaattatccttttcaaacaatattactacatccatcttaaaataagtgtaaacatgggtatccgtatccaacatttgaccgtccgtctaatttaaaaaattataaaaaaataaaaaaaattagtcacgcataaaatactattcatattttatcatctaataacaataaaagtactaatcatattttttttaaataagacgaacggtgaaacgttagacatgaacagtgcaaaactgcacttattttgggatggatcggagggagtatcattttcccttagctattttatagtttttctataataaagattcctatttatgctaataacacatattagcacttcaatacttttctcattggataacgacgcttgcttgagtaactgcacctctcgcgctactgaatccgagccaagcctgtacggcccagctcgtcgtcacgcttgaagacgatgaacctcgtacgtgacgaggataaggctgctggaggcgtacgttgaggtgtcaagatcggaggcagcagcgatcgatgtcgaggtccaggaaattgatagatggaggtgaagtagggtcctccttatatgcgagtgatcgcgggacggacgcatgcgcgatcagaaacggcaaaacagaaaaagccccatacacgtgatcgagaccttgtgacccacattcacgtccataccacttcacacgcgtttatatatatatatatatatatatatatatatatatatatatatatatatatatatatatatatatatgtgttgcaacaggtgaataaattctaatgataatatacgtttcttatacataattatgtcaataataatgtttgtattttaatgagccgtttgttttttcataaacggcgtatttctttctaacagtttcttcttagcatactttttttgatttttttttctgaagacgaaaaccatatttttctccctttttctttttcttttctcacgcgttttttgctttttttaatgttctttttttgcttttttttcaatacatgagaatatatgacgaaataaaagccgtgtaatagatggcaaaaaatcgatagatcctatccgacttaaacgtccatcaatttagcgtttttttttctgacagttttttcagaacgatttattttttaatagacggtgtttttttcttgcgtggttttttcaaatatttttttagaaatggcgtatttttttcgttacatttttttccttgcatgtttttttaaaaaatttaccgacgatggaaataatatttctcgcacgttttttatggaaggtggaaaacctttttagcattttt

SEQ ID NO: 71572 - DNA, 11185 bp, Oryza sativa
gactaaaaatggatttttactcccggttttttcacccgggactaaagatagtgatctttagtcccggattggtagtcccggtttgaaaaccgggactataggggggttacgaaccgggagtaaagcccctttctccaccagtgatacatatatacatatgtacacatatatatacatatgtacatatatatacatatatacatatatatatacatctctcaacttacaaaaccgttcactttagatccttttgtggtttttatcctgattttgtcttacatggtggctaagtcagcgcagaacccacatgggctccatatgtcagaatgccaggtcatctctctccctcctcttctctcccttcctcatctctctctctcacttctctcctctctgcatggcggctggtgggtggggacgaggtcaccagggcgaggcgggagaggagattctgtggacgtcgcgtgcgacctcggggtcggaccgtcgacacgagagaagggaggcggcggcggctgcgacggttgagaagggagaggcagacggcggcgaagcagggtcggcggctggcgaccacgcgggaagaagctgggcggcggcgtgggaagaagctatcttatacgtcgtgcccgttccgcccacaaccgcctgctccactcgccgctccttcgcgctcacacactccttcccgccacgccaccctcgctctccccattcggctccccatcgatgccatttgcctccgcctcgtcgatgaggttcgaccattgtcgaggcggagatgtataactggacgacgacggattcgctttcttctttcccctcgcttctcctctctctcccctccagatggtcgacattgaccgtcgcctgccggtgccgcacgaccttctgcacccgcccttccacatcgccggcttcatggcctctgcacagccaaaaccaaacacttcaaatggtgtcgccgcctcccgcgcacgcaccgcggcgccgacggcgtgtaccttgctgccacagcctcttcctctcccgcagcgcgcctgccagccgctcgtctgctccgcagaccaacagctccccgtactgtcgcctgctccgtcaaccgctcgcccggtcctccggcaggccaatgcggcgggcgcagctaccgccgccgctccgcccaacgcccgcccgctccgccagccggctgctccccgcgccgtcgcccgctcctccagctggccgctccaccccgcgtcgtgccctctccagcgatctgcttggaggggaggggagagaggatagagagaagaagggaaaagagactaaggtttcacttacatgtggggcccacgtaggtcctacgctgacgcaaccgccacgtcggacaaaactggagtcaaaaccaccgaaggacatatagtaaacggttttctaagttgagggatgttatatatctggttttgagattaggggacgattttgtaactcgatgataagttgagagaccttcggtgtacttttttccgagacagaaatacccctctattgggccgacccattaaaatgggctaggaaaatgttatcccgacctccaaggattaacttttaatcttaacagtccagtccattcatgtcaccttatttcattctaatgttctattcattttcatttcccattccacccttcataacccattatcgaaactcacgctccggcctctgggctagtagcaatgtgtttgctttaggcgtatatttggtagtgatatgattgcaaatgctcttgtttagcacaactctagattttaggtcatgttgaaagtttatatatgttaaattatagttgtttaaagtttcgtattttattttaaataaaagtaaaattatttatccaaatgttacagagaaaatttgatctatagcaatgggaaaaaaatcagtactaaaaaatagcacaaaattttcccttttcaacaagaagcatatgccacttagtttttcttcattcatagcactcctgtcatatgttccgttcatgtatgtaggtttatatactatttttttttgttacctttattttctgtgctacagaaattttctcaactaggaaggtagcccgcgcattcgagcgggcatgtaccgtatgtaggatgaatttaagaaacttataggagcggtataacagcgaaataatatctgcaacgtttaaaattgtgattgtttccatgaattttcttcgttagcatcacaaaacgaatttaattgttatttataaaattatctattgaagattggggttggtatggtaccttaagagtctaagacatatgactcttgaagttccatatggaaagtgtaaaacttaagttataaaagatattacatatacaaccatatataattaatggttgtactgatttatgtagaaaaattgatactaactttattatttggcagatatcgattggccatagctatggataattcctcataggaaattatgaatatgtgtacagtatagggatacaaattagaaaaaaaaagtagaagttatgagaaaaaaacaaaatatatgaccctcaatttttacctaattcggtagtccatcatttctaaccattggatattcagatgatctaacatattgtgtatagtccaaccaaccaaattattcgtctttcctcattacagatgttggacatgttaatccggataaatctatgtatctatgatttacatatataaaaatttaagtataataaaatatacaccctactctaccaatgcagcgaacgatgtgtgcgacaggttcgccacggctggcttcaacacgaacatgatcgcgtacctgacgcagcagctgcacctgccgctggtggcagcctcgaatctcctcaccaacttcaccggcacggctgattccttcgccggccacctctggaccaccgccgcccccagcgttctgtcccagctcggcatgctcggcctcgtcgtgtccgcgctcgtccctgctccgccccgcgccgtgcagcgctgccgccgccgccctgtgacaatgactatttagagtatgtacaaatacatatgtacgcacgcactgaggagagggtgggcctatgggagaataggtgggctgtgggatttttttttctaaagataaatataatagttgaaaatagtaggtctagcgatttattattatagaaatagtgggtccaccaatttattataacgccacgtgatggcttagaagcgtttgtaggattctcacgtggtagcttgagagcgtttgtaggaagtttaatggacttttagtatataatagatagaagatagataaatagatgttttgacatagtcgtaaattcagattcatgaacttgtgaatctagaatacccagccccaaaacatgttggatccggagttgtgccaaacattcccctattaggggaaactacttcatttattgatcaaatttattcagtccatatgcgtccctaaatcaacagcagatgaacacggtcgccaaggcaaaacaacaacatgccaagaacacaacaacagagattattcttcttggttactgatgattatttttgtatcgcattgatcagattttggggacggcggcgagggcttcctgcagcttctcgtcggagtgggagaggtcgaccatgtcgcccctcaggtacttctcgtaggacgccaggtcgaagtggccgtgcccgcacatggccatcaggatcaccttcttctcccccgtcctcttgcactccatcgcctccctgatcgccgccgcgatcgcgtgcgtcggctccggcgccgggatgatcccctccgtccgcgcaaatttcaacgcagctggagttcaaagcaaaaacaattatgcaatcacatacatcagctttcgggagaacgaaatcatggataatttcagattataatactttctagtattacccacatttatatagatattaatgaatttagacatacatatatgtctagattcattggcatatatatgaatgtgggcaatgctagaaagtcttataatataaaacggagatctagcattataatataaaacggagatagtagtacggagtaccatcgaagcattcagtttgttggatggcaatggcttccatgaatccaagctcatacacatgggagattagtggcgccattccatggtagcgaagccctcctgcaattgcaaacaatggcttgggtttattagcaaccaagaacttcaaattggagcaagaactgaagaagtgtgcattgttgagatcgataaaagaattcgagacctgcatggatggggtcggggacgaatccatggccgagggtgtgcatcttcatgagcggcgtgaggccggcggtgtcgccgaagtcgtaggcgtagacgcccttggtgagcgtcgggcacgccgccggctcgacggccttgaacgccgggctcatcctgccggcgagcttctcgcgcatgaacgggaacaccagcccgccgaagttggacccgccgccagtgcagccgatgacgacgtcggggacgtcgccggcggccgccagctgctccaggcactcctccccaatcaccgtctggtggagcagcacgtggttgagcacgctgccgaggcagtacttggtgtcggcgtccctcgccgccacctccaccgcctccgagatggcgatcccgaggctgcccgggctcgccgggtcgcgttccaggatcctcctccccgactccgtcgccgccgacggcgacgggtgcaccgtggcgccccacgtctccatcatcagccgccggtacggcttctggtcgtacgacgcgcgcacctgccacacctcgcaggtgagcccgaacaggctgctcgcgaacgacagcgcgctgccccactgcccggcgccggtctccgtcaccacgctcctcaccccggcggcggcgttgtaccacgcctgcggcaccgccgtgttcggcttgtgcgaccccgccgggctcgtcccctcgtacttgtagtagatcttcgccggcgtgcccagcagcttctccagcctcctcgccctgcatcaccaatatatccgccattgcaacaacttttaacaaagaactcttctgaattccagcgctgagattggcaacaatgcagacgaagttctagaggctcattggttgaccacatttcctaatagcttatccacgaataaaaattactgcctcaaattgtttaacataaattaaattaatgtttgagaaaaaagaaactatagtgaccgtataggtaagagtggaagtctggaagggtggttaaaagtataataggaaaaaaaacttaatgaaatatgattgacaagacaatcagtacttcattgtgataactattttgggacaaatctgaatctaataaatacaataattatgagatggagataatgatttataggtgaaccttttgtatgtgcattcttaggcagcgttagttctgggagattagagatagaatgcacatcgttttccacgtgcacgcttcccaaactattaaacggtgtgttttttgcaaaaattttctataggaaagttgctttaaaaaatcatattagtccatttttaaaatttgaaataattaatatttaattaatcatgcactaatagctcacctcgttttgcgtatctttccaatcttctctatctcccctttctcaaacacagccttagtgatttaaaagccaatatccaataaaaactacgttgaaaatatttcaaaatcagcttcaaaattaagcttgaaaattcacattttggctttaactttggtttattaggcctaccgatggagatgctagtgttctacctgatcagcggcgtcgggcgccagagcttgtaaacctcggcgacctcctccgggatgtcgatgaaccgctcctcggtcacctcctgcctgatcagctcgtcggggaagagaggggacaggtcactagggttcagtggctggtgcgtctgcgggtgcagcggcggcggtggcttcaccggcaggtcggcgacgaggttgtaccattgcttcgggatgctcacaggattcgagctggccctggcagtgaagcttcttcttctgacagaagctctctgctttggtttgcaaaggagtgaggctttttctgaacctgctgctgcaatacaggtagtagtgttcatcaggttagtgtgtgtgcagatttgcagctccagaattcagaaattagattgaaggcctgttcactttgatgccattttcaaccttacttttagtaaggttgctaaaaaagtggctacatttaatttgctgccaaattttaataactatataaaaaatcctgccaaaattttgacaactatactaaaattttagcaatgccaaaatttgataaggtttttttggcatcaaagtgaacaggcccgaaaaaaaaagatatactactattaatttccataagatctagataagcatttttcagccacatatctgatatctcaaagtgttgaaattgttgcatagaaactgagtgctaggagtgtggtacactgattaatatttaatttggacatgtactaccaagatgatgtctactcctaactgaaacatttatgttttgccttgcccccacagtactgcaatttggtttaagattcccaattctgcaggacggttagaagggagagaaaatactgaacttacataatctgtaccaacatcatcatcatctattatgttcatctgtaatcaactattgcacatttagaaggaatgaaaatcaatcagaagtgcccaactggggtattctactggttagtttactttatcccactttgtttttctctaaggagagaatgctactgattaatttaatttaattttatgctaggaggtcatactactgttgatgggtttgggccggatagcagacagaacaggatcacaactaacaactgataacataataaattccttgagatccaagtgcacagaaacacaagtgtaaaataaataaagtaatgggttgagttcttgggttgctctacaggagtaacaagaaacataaaccaatccaatccaatccaagaacagcagcaaaacacaacacacccgttgctcccatctcctccaagacgatatctatgttgggccatcaatcaaatcaacccaatctaaagaatccaagaaagtactataaacccaatagcacaagagggcacgatgagatgcagggatccaccttgtcggagcaggggaggtcggacggaggcggtggtggccattctttctccctctcttccgctcccgacgaccctcgccgccggcgccggcttgccgtcggttcgccggagtaactggtcaaccccaaacgcgagctggagagctgcctctctgcctgctctctcctgtgatgcagctggtttttgtagtggccagctctgacggatgcagcaatttttattgttctatctaggtggtggtgcttctcccggcttgcgtttgatggcaaagggaagggagggagggagggaggagaggagactcggttttgctactgcgccatcggatcaacgcaactgaatgcgatggcaatggcaactctgcaatcgcaagcgcaagcacggcggcggatgcagcgagatggcacgtggggaaattgactggggcattggatcctctgcatctgtgtgaaatgtccctaagtttccgtgtctaaagtttaactgtccgtcttatatgaatttttttataattagtatttttattgttgttagatgataaaacatgattaatactttatgcgtgacttatctttttaattttttttcataatttttctaaataagacagatgatcaaacgttggatacgaaaacccagggtttgccttttttggacggaagggagtactactgacttgagctgatgatgctaatgacacaacaactcctcagtacacattttttgatgctaatgacacaacaactcctcagtacacattttttttcctgcgaagacgcaaaaagattgcacgtcaatctattagaaccgtacacatgcaatagaagtcacatgagatatgtttaggttgatagtacttattctaaacattctactatctagatgtttatagactactggtacgagatacgacacattctagtactatgaatctggatagggaatgttccacatcctatattagatttgtttttatgggacaaaggagtagtattgcacttaagagtatgggtgaaattatggtcgaatcacaaaattcctatatcataaccatattttccatttaaactgtaaccgacacagatggtatcagataataaatcacttatcccgtatcctatcaattttatatttctaattcatagattttaaatctagtgaggcaattagtcttaaaaagatagtcaagaaaaaattaagtaatattttttggtgagctcgtaaaaaaatatgaaccaatctttcatcatattcataataaattttcatacatgtttgatcaaattggatatacgggtagatacaactcttcgcttatcctaacccatatttgtttgcaggtttggattcggatttagactcgaattagaatattaccagatatctcattttctctctcgtatccttcccacgagctttccgtcgagcggacggtcaggaaatgttcgttctgttttcacccatactacatactcaatagagaaaaactatgtacagcaaacctaaaaattcatcgaatatataaatagacgtctcagacgtctcatatatatccatgtcttctgagtaaaaggattagttacatataaatctatgagtaaacaaactactcactgttaaatctggagtaaaaaacataggtgaatctcagatgttcatttgtgaatataacgacagttgttaagtacacatatgaagtatgcagtatactgccagtatgtattttcccaatcacaaaggatctctcgttccatggctatataaaacaacaggagtacatgtcactgtttgtactgtgtgaccgttttactgttccaacaaaagcaccgtttagcttcacttttctaggagcggctgtagcatcttagtttcttcttcaatgctgagcagaggatccgattcccggaaaccatggagatgggatttgtacttatcaggcactaatatatccgagtgaactcatacagtaaattttatcttaactaaatcatataacaataataagattaaaatcaacttcgcccgttgcaacgcatgatattttctctagtattatttaaaataataaaaggcacgaataatatggaaggatctaatatcaaataattagaaggtgtgaggcttcgaacccaggtcatctagcccaccaccttaaggagctaagccggaaccagtcgtgtctatcactcttggtagatacttcctccgtcccaaaaaaaagacaaaccctggtttccgtgtccaatgtttgaccgtccgtcttatttaaaaaaattatgaaaaaaattaaaaagataagtcacgcataaagtattaatcatgttttatcatctaacaacaatgaaaatactaattataaaaaaattttatattaagacgaacaatcaaacgttggcacgggaactcacggtttgtctttttttttttgggacggagggaacaattagattgaggatttaagacttcttttctcactaaatttcctctcttcttattcaggtgagctacatataccatttttttttaaatacgcaaaaggcttgcctaacaaaatttggtacagaatttgcccacgcggagctatatacagatcacttagaatatagaaattttacctgaataagtttatttcctgtgaagtttgttttgcttttccaacaaaaaccgcaaatctattttctcaaggttgattgatctcatctcttacatcacacccctggcccgaaaatattaaatggttggtcgcctcaaccgttgcccgtatcacgtcggattcacctacccttaatcctaacattcaaattagaactggaataatactctcatttttttattcagtcagaatgaaaagtgaaacgagcgagaaatcaagttttgcctttgtgagaacacggttattctcagaaacaacagttctcctttgctaaaaggccattgaaaaatcgttgcaaattgcaacaagttagcacctaatcttccccataaaatgtccatcaccttgaccttatctcctaattaaaccaaaaggacagtactttcagaatgctgacaaatatttcggtgttagcatgtagccgtctgttgctgttgctttctcggtagccaatgtgtccagctcatagtgctgccagaggaaaaagcaagacagagtagtcagagatcaaacgcataatttgatatcaatatctcctaagacaaatcaagattagctaagactagtaaactataaatcgtttatgcgatgtgcatgtctctgtcaacatttcttctgccgttgatgctgtgttcctaccaactccctcaatcttaaaaacaaaccaatctaaaatagaatatgaatataatgaatttggatagcaggttgatttattttggaacggatggagtactactgttgtagtagtgacaccacactgcaaatatttgtagtagtgtctctacttaaataattattcagtcctaggaaaaacctaaatgattattcagagtaataaaaaaaacatgtctctgctcacaggagattatgaacaacaggttaactcttgtttcctgatgaacatagtttgatgaagatacaagaagaaggttcaataatggacatttctgtagccaaaatttaaattttaaaacttagttgcagacttaattttggttttctttttcatggactttatttttagcacttacttttaaatcggtaagaatatataaaaattttaccctgtgcggccatatatgggcgtgcatgggctaagaagagagtcctgaaggagcaggcatacggtgacacacactgtagattcagactggcccattaattagatggcatttcgtttaatttaggaataagttcaccggaggtccctcaacttaacagcgagattctttgaggtcccactggtggagaaaccatttttcatcggtcggccgaattccacaat

SEQ ID NO: 71573 - DNA, 1609 bp, Oryza sativa
ctgaaataacagtaaagggttataccctgtgaaagtccctccgcttggattgtgagacagaactgcctccgttggtgttgtcgatcggtgcaccagctcccggatccctaaaaacctgatcacccgcctacccagtgcagatctcaggcgaaggtgtagttccagaggccctgctcgttccaatctctcgtgcgcgcaagcgatcagaactggggaagcagtagcagcagcacaggcagcgtgaggaggaggaagaaccagtgtttggaaagcaatgcaggagatctgatcggggttctctctttccttatagcgcaggagagaaatccgcccgttgccgtagtaacgacgtgatcaatggatattgaatcgcttgcccgttacagcatcgcctcgccctcgccctcggcccgggcccggccggccggctcggcgcgagcgcgcgtgtggctttccaatccccacctcaaccggtcaacagtgagcctctaataactttctatttaagttgagatactccttaacatttattatgggcccttgagatttaaatcgggcctagcccatttattctaacaggtacatgtggcggctcatcgaatccaaggcgccacagacaccgccggccatccctatcaagccacctgcaccgcctgaacatggtgatgacctcatgctccagcagcagcatcagcaatagcagcaagccagcaacagagtgtcatgcaaatgtttgatcctcttcagatgctcccagggatgggttgaattcggtatctgttctgcagttatgctcattacttctctgtattagttgggttgttcctccgtgaatccaatgcttgttttatgtacctttgttcaatgttgggggagattggaagagagtagaactgaaaatgaggaattgggagaattatttaatgaaccaattagcttcatgctaatcatctcgtcaacttcttggtaatgttgggtcgttagttgggtatataatgttgggtcgtaagaagggcagcggggaggcattgccggcggtgggattcgggtggagcacaagaccaagagaaagggtgagaggatgagggaagagagaggtagaagatgagggcagttttgttcaatacatgtaaaatatgaattttagtggcaccattgagattataaacgagtaatagtagcatcattacaaatatttgaatagtaatggcatatttccaaactgggatattttcaatggcatggatctaattaacccttaattatattacttggattggaaaaagttttggtgaggactatgcattgctatagaacctagcatccttgtcagcccaactatggtagagtcatgcgatccgtcacaaaagcactaacctgtgaagggctgaaaagacccggttgaagattcggccttatgacctaacccaacactgatgatgatgcaagttatccgcctgtcaaagattactatatatgaccatcaccaataatctctaatctataacaactataacaatacaacccgttagagataaaaaaaacatacctctaacgggttattctctctacctgtcgctgatgaggccaaactcgtcatcgctgcatt

SEQ ID NO: 71574 - DNA, 28584 bp, Oryza sativa
aacctcggctccggcggctcgggatcggccaccccagagcatgccatcctggccaaatggccggccggtcagaccggccaacacctgccagtcagaccgactatgaggcaatggtcagaccggccgtgaccctgcggtcagaccggctgcatcgtgtaacatcctcaaattttaaacaaaaatctgactgcatcatgctggcttttgattacttttgtgtgcttcaagattttatttgatttttaattggttcaagtgttacttccttagagccctactaatttaccctaattattccctttactctaaatcttagtgaatttgagcaaattctttcaaatttcaaactaaagattattttcttagcttaccctaatattagtgaggattttctttactccaaaccctagtgaaacccttccaaattcatagattaaattcattcttttctagggaaatattcaaaaattcctgaaaacactgttcattgtactcaaagtgttcgacaaaatgccaagcccagctagagcagcccaacctttacccaaacttgtgcaaagtccagaattgatccttagggaccacaccccactcaaaaaccgtggttttctttgcttcttcctccccttcacgcgcaccgcccaggcatccgacttagccgcacgccgtgtcgccgcgcgtcggctttgaggccgcccgcgcgtgcccgaccgccttggcgcgccgtcgcccgtccgacgccttcagaccgctgtcgccgcaccaatcttgacgacgacaaagccgggacaacctccgccgcaaggaatcgccgctcgacgtcgtgcgttcccgtccaaagccgccgccgagtgcgatttagcttctacccggggtgaatcgcgccaattcttgccgcacggttagattgaagataaacggtggtttcccctctcacaattcaaaccattcatccccgagccggccgttttcaccctcgctgccgccgcgcgtcgcgcccggattggcaccaacatgtcgacagccgatttcactcgcggtcaagtcaatctttcaccggtaagtattcgaacgtggcctcccaccactcaaatcgatcttgcccgccctctcacagcccctgccgccccagccatatccaaagatcgagctcatccatggcgatgacggtgtccgagctcatccgctcctcctagccctataaataggaccccaatcccttccttgtccatcatcaatcatcaacaatcaaagacctacaaccccgaagctctgcttcaccaatccatcccatcaaccaccatcgcccgtcggtcgaacaccttgtgcgtgatcgactccacacccctccatccatcctccgccctaaatatcccttataacaccttatatcaaccatgttctagtatactaagccctaaccgaagccctgcgccgagttttacctcgccacaccaagccgaccaccgccgcccccgcgctgctctgttcttcgccgccgagaagttttttcggccgcaattcttcatctcggcatatctcggtgagctcttacgttttaaccatctatgtactccctagattccattttagcaatccttttgcactatcataccatcctctgggctgccgacgtgagcacggccgccgccaatggaggcgcgcttgtcggcaagtattttccgcgccttgccaaaggtcggcaagctatcggaatccatccaggcactccatagatgctctagaacccctcccctagccatgtttaactcacatcacctcgatcaccatcacggcctaaccgtgccaccgccgccctagccgctaggccatccacacaacaaattaacccctccgccgccgctcgccgtcgccggagaaccctagttccctcccctcctcggccgcaacccctttccccctccatcgccgccgcaatcgtcaaccctagcgccgccggccgattttggggaacggccggaggtaggtagaagaagagaagagagagagactgacaggtgggacccacacacagtgccatttcacatttaattgattttcaaactttagaagtccatatcttttaaaacatagatccaattccactgaaacttggaccaatattcttctaaaatcattctctatctattgagcccctttttgctatttttgtattttattttattttctccatttttcttatctttggattttatttgaattccttttgaatttgaattttatgtctaaccctaggtcttgaggattcttctgactcaatagataatatcaatcaacctcaggacatcgagcaaggcaagttaccatatacctttgatcatttaagcctatattttacaaattatttatttatagccttttattctatattctattttacatgcataattcaatcatagaaacccagataatttagtattgcttactttgcttacaatctggttaaaatatcttatacttaggttgggacagtacgtaagatttggttgatttccgggtggctagtactgtctcgatcgatataagttttaccaggtacttatgtcgaacgaacgggtacgaccgcagtttctagaatgaggacagacctagttattatgttaattagcaatatggcacctctgtatagtggttcttatttttaagtcctcgcgcaggaggctactatagctgcgaagggcaacttttaaccattaccatgtacaggtaaatggtttgtgatactcgagtataaactatatggtatatttctaaaccctgatcgagatgacgtggtgtcatacgatcagttccccttaaatacctcgggaacgccagaactcctcttgctgctgttaacattacgttcagagcatatgaggatataagtttatggaacaggtgccacaattgttaataacttaatactgggccatgactaaagccgatgattattagcaagtcgtggactgcgggtaaagcgtacatctgctgcagtagaatatatttgaaactattcgaatagtcgtactcatggagttgagtaccgggactcatatggtaccctggttagaaatttaaagtctacgtatttacaaatttttgctataattcttccagattgtttattactgctttttgcaaagaaccctactatatgctaatgcataacatatttccatgataacttgctgagtattgtgaatactcattcttgctctcataacccctttttcagatttgggtcaagaggatgacccctttgactattactacgatgaccccgataatttagagagtccctaaaggttatacctccctagtcagaatgtatagaaacttccgctgtgtattaattgtgaattaattaagttaggtaagtacctattattgtaaaacccttagtattgtaaaactttaacatatgcaatgaaaaaccagttatattgtatgtatcaatatttactgatccagagattgatacattaatcgtagtcggatccaagtatttagtttcgggctccgacacatcggccggttagaccggcacttgggccgcggtcagaccggccctggtcacccagaccagtgacagcaaatgatgaacaatgaaatttagcacaagtctaaatgcaaacatgacctagtgtggaaattaaaatcatctctttgctaggtcattatccctcttaatagtacggcgaagctaaaaacaaactagcaaatttgatcgcccttcacctcgatcaatttaaaactaaatcactagttttaccgtcttcttttcttcgcttcacgccatcaattttaatccatcggttgtcatccatgcgcacacacataatgtgaacctaactcaaaatttatagcacaaagacaacggttagtccacaattagtgtttgtcattaattaccaaaattaacaacgggggcctagatgcttcacctgatttctttttaaattacttccgagcccttctatgcagtctttttactcaaagtgcaactttgcccattcttcaggggctttctctatctagctgtactcccagatagcttggacaaaacaaaattatagaggcatctactttggatttgtttaaaacggggcattgaaacataacgtatttggtcatgttttcttaggtttttctggtgctaacactacaatcaaatcaattttctgcaattcaatgtgttgttttttccccaaggtgaaaaagagtttaggggaagaaatgatgagtacattgcaaggagaaagcttacggggcaacctcataccttctcatcttggcagtgagattgctcctaaagtggggaagaatatgaagaggagggaagaaggggggggggggggttggacaacttattgatcaaaatatgattaagacaatatattaagtggcgagctaaagtcccaacgttgatgaaatgactccctaaccaacttctagaaattttaatgaaaaactgccccgtgaatagtaagagctacccaaccatttctctctcaccgcattaatttgttacctttttctgaaatataataatacaaggtgcatgtcaaagatttgtttatttgagcaattaatcttttctctttagtgaggtactccagtatataaattttgactaagcaatttcaactcatcagatgagttgcttcaagtattgctttgtggtatatgctattttccaagaaatagaatggtggataaatatgtgcttccaagcttctaaacggtattttttttagaaaaaaatttctatatatgaattgcttagaacattgttttatatccattttaaaccctttttatatttaataaattgattgtaccatcaaataattataataattataaaaacaattgagctattcagacaatcagctattcaacacaagaatggagggattcagactattgacaatcaaaactctttattataatatggaatggagggagtaaagtaattaaagaatggcttaaaatttcaatagatattttttggaggaaactttccatatcaatgatagaatacagaactctcacttgaagtttatcaaacattcacaggaatttaatttgtaaactttctacaatataatcttccatataatgaacctactatctatagaatagacttttcgtagggaattaaaaactttcataaagaaagtacaactttctctagatatatcaaaattgctaaataggcccatttacataggcatgcttgatcaaacaacaagaaacatttttttttattatgagaccgaaaactggtttagggcatgtttaaagatagacgtttcttagttatttagagattgttatcatgagacaataaatatctaacaattaatgcacaaaactaatttctattatctctttctttttccatcttgataagtatagttttcttttatgaacactaagagtccatggtaagccgctgctaagtcttgatatcgatgtttctttctttttttttctttatatttatgtcatctagcttagtatcttgttaagggtgagtttaaatataccattttctaatttctactctctcgtttttcacgcgcacacttctcgaacggtcaatggtacatttgtttataaaatttttctatagacaagtttctcaaaaaaacaaattcaagtttttaagttaatacttaattaataatactactccattttactactagcgtggatattagttttcaacccacaacaaagaacacagtccatttggctactattaatgaatctatcacaaagtattcgtagacaacagcatgcgccaattagcttttccctataagggctcctccacatcatcatgtaggcattgtaggtgtcaatttggtacttgttctgctttaaactccatcgctaaagcaaatgcaaaagactcttttccctttatcccgcacaagtgtgaagtcaagggtggctcagctcaacgctactaggaacgtgaaaggttcgttactagtactataatatggaatggagagagtaaactaattaaataatggtcgaaataaaactttctataagaatgatataatacaaaattctcacttgaagtttatcaaacgttcgcaggaatttcataaactttctacaatataatcttccatataacgaacttactagctatataatagactttttgtagggaattagaaactttcatatagaaagcaaaactttctttagataaaccaaaattgctaaataggcccacttacataggcatgcttaatcaaacaacaagaatttttttattatttaaccaaaaacttgtttagggcatgtttaaagatagacatatcttagtagttatttagagactattatcttgagactatagatatctaaaaattaatgcacaaaactaatttttaattatcattttgttttcccattttcataagcatagtttccttttataaacactaagagtccgtggtaagccgtttctcagatatcaatacataattattgatatcgatgtttctttctcttttttctgtttttatgtaatctaacttacaatctcatttttcgcttatgcttatacttacaagccaaaatttgaattttcaaccttaaatttggagttgattttggggtccttttatcgtaatttattttccaacctttacttttagatcgctaagaacacatatataaaagttgtattcacaaattattttttatttgcaaatatgccttgaataagccaaaccatggagccattagtatctttgttaagggtgagttcgaatgtaccattttctaacttatactctactttttttttacaaattttctataaaaaagtttctttacatccatattaatatgtttcaattcttttattaatactatttgattaatcatgcgttcatccaccactccattttactaactgcgtggatattagttttcgacccacaataacgaatacagtccatttggctgctattaacgaatctatcaagtatttgaagacaacagcatgcgccaattagcttttccctacaaggacgactccacatcatcatgtaggtattgtaggtgtcaatttggtaccttgttctgctttaaactccatcactaggctgccccatcactaaagcaaatgcaaaacactctcttttccctttaagagcccctttcaattaaaggatttatatagaaatttctcataggattgaaatcctatagaaaattttcctatttgaccctttgattcaaatgatagaaactttccaaatcctatgaaattcctatggaacgacacattgtatgtggattttggaggaaatttagcaagagcttcaacctcttggaaaatttcctttaagtctatatctctctcatccgattcctatgtttttcctgcgctccaatcaaacaacaattcctatgttttttctgtgttttacaatcctctgttttacacttcaattcctgtcaaaatcctatgtttttcttattcttttattttttcaaccctgcgattcaaagggaccttcaacctgcacaagtgtgaagtcgagggtgactcagctcaactctactagtaggaagtaggaatgcgaagggttcgtttcgtttccacaccaccattggtcaagtcaagctgcgcgtccaatcccacaactcactgacgcgtgggcccgggtcgtcctcactactactactgtgcagtgcagccagcactagtgctctcctgctctcctctgcttctcttctcctctcctctcctcaccgggagagtggagaccctcgagatgcccggcggtcgccgcggcggcggcgggcgtcctggctccggcagcagcagcaacggcggaggctccggtgagcacccctcccccgcgcgctcgcgccggcggcgccaccctctccgccggtaggattcagggcggtggcctcgtcgtaggcatgtgcgtgtatatgttttttttttattattcccgtagattttgtgctgtgcatggcctgctccgatccccagtttcctgggcctctttgatgagactatggtttactgcattgcattctgctccgtcagtaggaagtactacctccgtccgataataattgcatttctaccattcaaactttgtcccataaaaaatgtatttactataagatgagacccaacaaatggaatttgtaccccaactttccttttaattaatttgtagtagtagtaaacactatccggggaaaaaaagaaagtggcaaagcttttgcccttccttcagagaaaaaaatatattattattatttttttattagatatataaaatcgatcaggttagattcatcttggatctcatattttgctaggaggtatggtaagaaattttagtattttttcacactttgataaatatatcgcggtacttacttaatcattagtagcaaaccttgaggttggagactgtatgatgctaagtatgtgagttatgacttgataataagtatgctaagtagcaaacatgagaagttggttgcatgttccacagtacattttttagttgttcctttgtcgtacattgacacacataggaaaatatcatattactttatctaactgtttttgatgtagggtatagttgggttgagaagaagtcgaagaaatcggagaaatcagttggaaagggacaatgcgcaccatgtacttcttcaaatgctgcacctaaacctgctatggcgtggcaagcacggagtggcaatggatctttacaccctcctggaaatggtcgggttcaacattctgatcataggcctgctgccagaggcagtcctaggtcactgccacaaaataagcatacagaaacaaaattgcaagcaccgtgtccagttgtgactgcacctcttgcaaatggtttgcagtgggtacccaagtctcgctcatctggttctgagagcaatatggatgatgctcctacatcaggttctgaccctgaaatggacaatggtgcaacacacccagttgtgactgcaactcttgcaaatggcttgcagtgggtgcccaggtctcgctcatctgactctcaaagcaacaaggatgatgctcctacagctagttctgaccctgaaacggacaatgttgcaccacacccagttgtaagtgcacctgttgcaaatggcttgcagtgggtacccagatctcactcatctggctctgaaatggacaatggtgaggattatgattcatatgacgatgattctgatgatgatatggttgatgataccagtggtgactttgattctaaggcatctgagaaaaattttgagactcgaaaaaggcacaagctgttgaaaagcatttttgaacttctggagaagttaagtgttgaacagataaatgaaaagactaggcaatggcattgtccagcatgcaaaaatgtacgtggtggagttacctggtacaaagggttacagcctttgatgaatcatgctagaacaaagggttctaagagggttaagcttcacagagaattggctgcattactggaagaggagctgtatcgtacgggaatttcaatggcatcatctggcgagttctttggaatctggaaaggattgcgagaaaacactgatcgtcctatagtatggcccccagtggttattattatgaacactcgattggaacaagataaggatggcaaggtggtgttttctatttcttgctcgagctaaaaaatattttgcttttctatatcattttctgttgcattgtatctggaagttttttgttgtccaattgtaagtcatgttgtttatttactgactatggtgttgtattaggtcgcaatatttatttcttcgaatgttattgaattttgagtaaatttcataaaccccacctgttatggtccaagttacacaaaaccatagggattttgacacgtggcacataaccccgatggtcataaagtttcacaaaaccacactattagccattttgacatactcctatatcaaatattttaaaagtggatgtaacatttatatgatggatagaatcctcataaatttgagatatgattgtaaaactcaaaagtgttgtagatcaaaatcaaaatgatcaatagtgtggttttgtgaaactttaggaccataattcctgtggttatatgccacatgccaaaatctctatggttttgtgcaacttgtaccataataggtggggttttatgaaatttactcttgaattttagttatgggtaatgcacatggattctactaaacctaaattgtacacataactttatggctgtccactattctttctgtaatatctgatctaatcagttgtactcaatgtgtagcaaaattaaagaaataagactgatttgttttcatatggttctattgatttttttttatctattactacgtatcattaaataaaatgtaaatgcatccttcaggagcagttaagatggcaaatgtgatggtttccattacttaaatatcagatagctgtcatatgcattgcaatatcgatccatggacacggtttatctccattaccagtttattttgtttatcattcttatgttagttattattttatgtgccagcaaacatttttctttgtgttgaaggtttaaaatatttacaatattcaaataacataaaactgcaagaaaacatattgtagttattctttattatgttttgcttgcattcatactccactgcaaagaaacataaatatggctactaattaggattgtctaggcatacttggcccaaccagttgaaggtcattgtacaaaaacatccatttgatctatcttttaagctgtatgaagctaagatttacttcattctaatttatatttctcccttgacttgttccagtggaaaggtatgggaaacaaagagctccttagttatttcagtaaatatcacgtgaaggaagcatgccatgcttatggcccagatgggcacagtggcatgagtgcgctaatatttgaaggatctgccgtggcctataaggaggcagaacggttgcataatcactttgttgatcaaagaacagacaagtatgcgtggttgaatcataggatcgtcatacctggtgggaaaaggcaactgtatggtttcttagctgaaaaagaagacctggaggcgttcaatagacatcatggtataatgtttaacttcttttcatatataatgctctgaactctgtgcaattgtatgtgtttgttgtcttttgttataagcatttaaaatggaaacatgatccatacatgttcgcatgtttgaaaggtgaacattataaaatatcattttggaaccttttattgtacatgagagttggagtattgtcagaacgaaatgcatcacctgtatgactgtgtattcatctaatttcctggttttcctgacagattagctttgctgttgcatgtcaatttcaacataaattcagactatttttttttaaattttgtatgattttcaggaaaagactatttgaaatacgagatgaaatcttataacgagatggtggttacccaattgaagcagatgagtgaagacaaccaacaactgaattatgtgaagaatgagatggttaagacagagcgacattctaaagaagtagaagaagccttgggtgttgagacccagaaacttcagggagcaattgaagataatattattttgaagagaaaaaccaaggagatgctctcagagtgcgtggaacaggtattgattgcttaatagttaccctggtgtacatattttctgctaccacatgtatgatctgcaaccagaagtaacataactataaaaatctgcttggacactgcctcctaaaatcttaatacaaagatatgcatcgctcttacgtattcctgaaaaaaatctgcttggacaggcagtcttctgcaattaaaacgtttgccatagaatcccttttgctttgtctcatgttaaccttgttttgattttgtctcctttcctcaccttctatgcagatggagtttaatgcgaaattttatcatgaacaaattgaaagacttcgcaaggacaccgaggagaaagagaatgagtttgagaggttgctgcaggaggagctagcaagagctatagagtgtgatgttgactctgaaactacagaaaattgcaagctaaggtgtgaccaatacgtggttgggacttgggagcagttgaaaatttgatagtacttctgattattcttctattgatcaaatatagatatggtgtctctgtgaatggaaatgctccactccgatatatcactaatccaaaaatattttgtgcagggaggaacagatacaaagaatcatagattgccaggtgaaggatgcggaggagtttgatgctgaacaagatgaattgatcaaaacacacgaagagaagaaggcgaacgtcaagatggagtatatggcaaaggatgttgagctcgaggaggagctttatgccgctctcacaagtctgatggagaaacacaagccggacatcttccaaccgtccagcccttgaagagctgcaggcttgcagctcaccatatatatgccctgctcacaataatctcaagaggtccctctcccaaatgaacttcaatttacatgccgataaattgcttgaaatgctcagaaactctcccgagtggcgtctctgggcaattgtgttgcacccccaatttggtgttttgatctgcaatttttatgcatctgcaaaggtcaatttgattgagttgacaagaatacctgttgctcaactcaaagatgatgtgctattcttgtcaaacatataactctacacggttttgatttcacttgcaagtttgtgaaaataaaagtaaaacagatggttttactttgcaagtaaaagaatttcggaactgccaagtccgtccctaatatttctagagattcagaaacatcacatgtttttgggttactgcaagcatggtttgaagtttggacttcattttggaatgaaaaatctgttcgattgtcatgtatggaagcacatgctaccgtgtcatgatcagatgaaataggatgtcgtatgccgtatgtgtatggtgcagcagtgaattgtccatctcaactctttcgaacttgtaaaatcacatctgttgaaagaatttaaaacgcacaaattaatcgatcaattcgacgacatctacaattctgcacacctaaagatgacttaacatgcatgtgaattgtttgaacttcgaatttcgggcaagaatttggggtatcacaattcacaacatgtcgctatgcaatacccaaatcttgaacattacactactagaatatataatattaacaaggactaaataacgaggacaataaattcctagtcgttaatcatattttggagcagtttcggtagaaaattgggacgtgatgtgtaaccgacgaccacagcttacctcccgtcgttagttttcgttctttgtcatcgttaatagcagttttgatttgcctatcaccgttttatagtaagttgaataaaattttattcgtgtactcccgatccgataatctcgccccccatcttcttgtattcccctcgctcctgctgccgctcacctcggccgccggcgtgatgctactggcgcaaccatcggatccctgcgcacgagctccggcctgtcgctcccaccacccgtgacctccattgctgccaacgttggccgtgcgctctcaccaccaccatctccagatccttgccgaagtgctcccgccaccacaaccccaacggcggtggttcttccccaagttctcaccgggcacacgagggaggaaggaggcttgatttggtgcccccacccccctttggtagaatctccttctcttggcacaagaagtttctatcagttatatgtcctccccttctgcgctaatccaaactgagatcgttccctgctggtttctcctccaaatcagcaaaaatcaggaggttgagagctgattagtgattgctcgctggaggtgctgcctgggggctacatcgagcaaaagggtcacaacaggaaggtaatactatcaaatttgccaggtagttcatacgtgctgattattattaaggtttatttgcatgtctagttgtctactgtgctgcttctccctatcacacaatgtttgatatggtacgttccaccaaattcttgtgcttgtgatagctctgccactttcatgagtaattgaggattacaagcaattaattctattttgtaggtaagcatacttcagttgctagctttaatcaaggaagaaattcataactgtgtatcagtgtgcatgactacaggtaaccgggtaactgggaatgaattgatgccatcagttaagcaggctcaatgtttgatgtgaaattcagggacagcttcactcttcgtggtcctataatctttatcaggattggaattttggaacttaactataggattaatcattgtgttggtaaatgtgtcgccgtgtattaaatttctctttcagtttttagatcaagaattcgctctttgatcaactgttactgaattataatacaattgggcatatgtgtaggaactttgcaacgtttatgtgttgataattatgctgcccccattcatgacctcatccctagtcccccatgaagactctaccaggtgctttcttaactaaataatgtaacatgattaagagttctcctcaactgactgcctggcatgattttatcagaaactaatggatttttgttataagctattgcactgtttatcttctgcaggaacaaaattcaggatgatgcctcctggtccgaacagtttagggaaaactcaatagagccagaggatctacacaagccttctattcattgttttaaattgccatcagtttcatcaaacataattctatctaatttgtgctctgtattgcttgagttaattaatgaattatcatccaaagcataacttgtagtgaacttatttgctacaaagtgttatattgttccatttagctattgaagttaaattgttcttatttatatattgcagtcgaatattgtttaagaaataaatactaagtttgcaaaacttatcaattgataattctagactgtaactgtactaaagtattttgcttctcagtatccttctttttatatttaggtaactgaactaacatatattaggttatcagaacaacatcactggaggtaaattttgctctcaaataagttatatattacatgccaaatataatgtatattaactagtataatccttgccagtggtaggatttatgatgaaatggatgaggaaggtgcagtcgaagacatattgaagggttgtttctctatataatgattagcggttctatccataagacctccagatcgaagaatatttttttgtcatatgtaacattgaagctcgggtgtcccagttagattaggtatcacaatgtatccctgaatattttattacaatcgattcaagaatgatatcattattcttgtactgattgttttgaaatattgctatgttgtgcaataatatatgagattgttaactccaaaatgtgcacttgcaattatttccaagggagtaatggatcttattgtgaattaataatggtgttaatgatgtatcctgaaatttcctaatattagtaaatatgaacttagatgtggtcgtcaatatattaagaaccataaccagtcccagtcattaatacatttacaagcacaaaatgttacggtcgttaatgtattaacaaccgcacataaccatggtcgttaatgtattaacaattgcacataaccatggtcgttaataaagtaacgatgacatattgttcctgtcgttaatgaaataacgatgggaaaaattacgtggtcgttaatactattaacgatggagccttcaatgactagaactttgtagtcgttaatgaccacatttggacctttaacgaccacatttcccatcgctaataatcgtttctctagtagtgttaatcgccattgatgcatgggtaattgccctaccaatctcgcattcatgattttcacatgtctcaaacgtgaagagaacctatcatgcataaactcttactgtcactacataaatatcaaatcagggtgtgtttagttcctgaaaaaagttggaagtttgaagaaagttgagagtttggaaaaaaagttagaagtttggctgtatttagatccaaagtttggatctaaacttcagtctttttccatcatatcaacctgtcatacacacacaacttttcagtcacatcatcaccaatttcaactaaaatccaaactttgcgctgaactaaatacaacctttatgtgtgtgggaaagtttttgatgtgatatgatgtgatggaaagttaggaatagggggaaaactaaacacggcttcagtgccctcacatttcatgtgaatggatcaaagagggtactagcgaagtactataataaaatactacctccgtcccattttaagtgcggccatggtttttcgcgccgaactttggccatccgtcttatttgaaaagtttttgaaaaaatttaaaaacttgagccacaagtaaagtactattcatgttttattatctcgtaataacaaaaatactaattataaaattttttcaaacagttaaaatgaaacacagggagtagatcgataaaatcaaatcacttgcttagtcatgacaaattgattgctcacgattcagcttctttcataaataatgaaacctttgtacttcggcaacttttaaagattcttcataaaacagcagcaacacgaaccagacttctcatgtcttcattcaattcaacaccaacaactagacaaagcttaaaggtcccctgacaaagtgccaactctaagagtccccatccatcactcacagtgacatgtgggcccagctcctcacgttgaccgcagttgactcgttgacagcctcccgggccccaccagacagcgcgaggtgcgcctcctctttaaagccttcgtaaacgaggaaggcgaaaagcggggggggggggggggggggggccaacgcattgccccacggtgaccaaacttaccttaactgaaacatggggcccaccagtgtggaccccactcgtcagctacccggggtaagcggggtggatcgggtgaggaccaaacgagcattccgtgcggccacccacccggtgcggttaccggcgcccccccctccataaaaaaccaaccaaggccacaggcgcgggtccgcttcggcttctctctctctctctctctctctcctcgaaaaccccaacacacacaacgcgaaccccactccgcgatggcgtccgccggcgatcgccgcggcggcggggggcctcccggctccggcgacgactccggtgaggccccgctcccgtccctctcccttgtcccggtggtcggatggccgatccccgcaatgtcggcggcggatgctgctcgttcgcgcgtagggtttatgggggtggttgggttgggttgggtttccccggggatcggtgcgtggttggcgtgcggggtttttgttttcgtgggggtttcgagatgatgtgtgttgcgggggggtggccgcagcgatgcggggggatttgggtgcgctgcgcgggtggattgttcgaggtgattggttctttcattttttttttgggtcgattggggtgtgtactgtgtagggggtttagtgccgtggtgctttgtgtggttgcggattcggtggtctcgtccatgtggttggttcatctgaaggcgatgggttttggtttgatttggttagtttgatccttctgtctttttagagcttcagagtttggtgttgttgggtatttttgggttcctttcggtgaggatttgtgttcactttctatttgaaaaaaagagagagatatatacgtattcaccttatggagcattcagttgtaataggtgggtttttatttgattttgcggctggttcattgtgctaaatttgtgttgttgaaataggatgccgtatgtgattattgtaagatcattgattattgaaataggatgtatgtgattattgtatgttttgaatgttcgcctagcttgctagatcgataattatgcccacatgcttattgtaagtttgtagctatgttaattttgcttccctgcgctcttaggtttatggtgtgacctccttaatttgtgattgatctatgcatgtgtgtgtttaggtctttactactgataaaattcaaaactcttagaactttgcaaatactacttcatgctgaatgattgctctactcagtctggtcagaattaatttacattttgtatagaactgttgatatttatctctatgaatattttgattggacataacattacgaaatatataatgcaatcctaaggtagtgtttacaattgcatttggagaccttttgatatctagtacatatttgtgactggagagagtgttcagtgttctgtattggaaccttttattgctttcatcatacataagagcatttcataattattaatcactggccttcatcagttttggtgtgtgtcaaggagctgcactcgtgaatctgtgcgtgcatgtgcatctgccttataatcacgtgaaaataacatgttatactaatttatgtaaatgccttgtatccagggggtggttgggagactgttgagaagagggtaaagaaaccagcgcaacaagttgggaaggggcaatggggacaatggaattctccaaatgctgcacctgcacctactgcaccacggagtggctctggagcttttcatcattctggaaacactttggttcgacattctgatcgtaggccagcaagaggcactcctaggccaccaccacaaaacaggtctatagaggcagaactgcaagcaccgcacggagttgtgactgcacctctggcaaatggttggcagtggggagccaggtcttgcccacctggtactgaaagcaaggagggtggtcttcctttgtctggttgtgatcctgaaacagacaatgctgaaggttatgacacatcggacgatgataatgatgatgatatgagtgacgatttgagtgatgactatgattctgatgcaagtgagaaaagttttgagactcggaaaaatcacaagttgttcaaaggtttcttcgaagtcctggaggcgttaagtgtagaacagttaaatgaaccaactaggcaatggcattgcccagcatgcaaaaatggacctggtgcaattgactggtacaaagggctacaacctttgatgactcatgccaaaacaaagggttctataaaggtcaagcgtcacagagaattggctagtttattggaagaagagctatctcgcaggggaacttcagtggtaccatctggcgaacaatttaggaaatggaaaggattgcgggaaagcactgatcgtgagattgtttggccaccaatggtggttgttatgaacactgtattggaacaagatgaggatgataaggtaacattttcatttgattgctgttgagtttcagtatagatctgaccagtttttctgcctgacttatatctttatgagcataacttttactcttatcttctattcatcattctgcaattacaggtcttgtctgccacattaaatttgtagtaaatatacatatttttggctattttcttgcttatttttttgtatctcgtaagaacattgagttgattctactgatttgtttacctattagtatcaaaagcaatgcacattcctcaggagcagttactatatgttgacttttgttactcaaatattatatattttttcttatgcactttgatataaattgattagcaagatttatcctcttcatcacacattttggttgaatttattatgttttgttccagcagatatttgttttctcaagtgttaaaacttaaaaaaaaaagacttcaaaattcactctctgttgtgattttcttgcatttatacttcattgtgaaagaataaaaatatgctgagcagtcagggttatctaggcgttgttcattaaaatgtatttcttattttctttattattgtgaaagaatatctgcttgatctattaaatgtgtctgcttttatgtttttattgcattctaatatctcctctttgtctcaatctagtggaaaggtatggggaaccaagagctaattgattatttcagtgaatatgctgcaagcaaagcacgccatgcctatggtccaaatgggcaccgtggcatgagtgtgctaatctttgacagctcggctgtgggctatatggaagcagaacgtttgcatgatcactttgttcgtcaaagaacagacaggaatacatggaacagtgctcacaaggttacattcttacctggtgggaaaaggcagctgtatggtttcttagctacaaaagatgacatggagacattcaatagacattgccacggtaagccatttaactatggtccaatacctgtacattaaattaattaacgctgtgtttttggtgcaattgtcattcatctgataaataactggctttcattacttttatctcctgaattctttctgacgccgattattattggtcacctctatgaagtgctcatgccaaatactagcttgcatttttatgatatgctgcatattcctgttcttcatcttcattggaatgtgatcacaattgatattatttaccgcaatatgtttctactaatgcttcacaacaattcataccttcatttcatttttattacgtagcatgttattatagtgtactcaatgctcatcagctgggtagctttctggtagtttatctctactacttgaaagcatgaatgtctaatctcattccattcaaaatgatatttcccttctgattgtaagaagaaaaattctatactcaaggacaatatgcaagggtaacttacctcttcggggacagcaaaggattagatctgtgcttctatattaataaaccttcagttatctattttctcctagaacatggaatcctatgatttatgctaggtatagattcatcatcattgggttcagcaagagtaatgtagcccattaataaaaaagaactgttaatgcaaaaatttaaatgatgctgatggaccctaatattttattacctttgtgcaatacggataggaggcatgtgcttgtcttttgtcttgtatcctttacctagtttcgttttgttgtttttttctaaataaaatacaccatttttaaagtaagaaagatactctagtttgcagatttctttcttttataagaacaattaattcctgagcattgcatttgggttacattcaaccctctacacttcgatagttttatttcttcatacgcattacaacctgtcaatctgtcattcatcatagcctctctgcatgtcagtttgacttcatatttgctatcctgttgatagtaaaatagaaggggaagtggtgcctgcctgtttgtaataaacaggtcctggcctcccaagtattttcacaacaaatgcaccacccatgtgactgtttatgtatcaattgaacatggccatcagtaatcttgattttcttagcttggctatcttatgattgttttattgtaacattaatgcaaacccctcttttatacctattgcaaattttcaggaaaatcccgtttgaaatatgagatgagatcttataatgagatggtggttacccaaatgaagcagatgagcgaagacaaccagcaactgaattacctgaagaacaaaatggttaagaaagagcagcactctaaattagtagaggatacattgagtgttgttacccagaaacttagggagacaatggaagagaatactattgtacgaaataaagccaaagaaaagcacttggagtatgagaaagaggtaacaattgcttaattggttaccctaatgaatatattttttggtaacatttgtatgagcagcaaccagaactgtcatatacttagtttacatatcagaaatattccgagagaacagatttctgcatttgaaacttgccaatttgccattgtcttgtacccttgttttgatttttgttcccttttcaccttgtggttttatacttcgcagatgaagtaccaggaggaatttttccatgatcaaatcgaaaaaattcacaaggccacagaggagaaagaaatcaagtttgagaagttgctgcaagaggagcgagcaaaggctagacaaagtgatgttgactctggaagtactgaagatcgcaggcaaaggtgaacaactagtttaatgtttttttgtgtgatgtcagttaaaattacgatccttagatcactcttctaggagcaacaaatttgaaatttccatttggaatggaaatgctccgcatcaatatataacctagtcgacattgtttcattgtgcaggaaggaaaagattcagaacttcatagactgccaggtgaaggatgttgaggaatttgaagccgaacgagacaaactgatcaaattgcatgaagagaagaaggtgaagctcaagaaggagtacctggcgaaggaatttgagcttgagaaggagctggacacagccctcacttccctgatggataaacacaagccggacatcttcaaatcctccacctcgccttcgacatgaagaactgcggcttaccatacatttcctgctcatctacaatagctaagactcccatttcctaagtacccgtaaaacttctagcgatgcgaaagcatcattctgtttgggtggatgcatgcctttggaaggaaacctgaaccagttccgtattatatggagtactatcagtttatggttgctgatgaactgatgactgtgcgctgcgcttttacagcaagcgtggaaatcgaatatatatctagtttatctcatcattctgctctgcgttgcatcaactgctgattgagtgcttacggtttcctattagcaacatatactatcttattgtgttaaccctttcatgttgtctttggcatgcagaacgcattttagcctacaaatacaatactagtattgtagtatgacatgcaagctttactttgcacatgttcgacaacgaaatgcaaaggaagatttgtttcttttgcacgttgttgacagtgcaaattgcccaaaatgtggccgagttacatcgcaagaatgatgcctagtaccgtagcgcactatccactatgtcaattcgtcatcattacaactggtttccaagatgttgaaattttggctgtgcggaacatatgttttttacactaaatacttcaatcctgtcggaataagataaaacgtttaattccaaacatcacattgttattgttttccccaaagatataactcgatagatgaaatctctccaaacccattcaaagagagaatggattatcttcttatgatgagacagtaagagctaatgggtcatccgctccacataaattctgaagtaaacgttatctgacgtcaaaactgaacttcattacagtcttaaaaactactccctctaaaaaaaaaaaaaagacaaaccctgatttccccaacttttgaccattcgttttatttgaaaaaattataaaaaagataagtcacgcataaaatattaatcatgatttatcatctaacaacaatgaaaatactaattataaaaaaatttcatataagacggacagtcaaacgttggcacggaaatccagggtttgtctttttttgggacggagggaatagcagcctagtttgcatcaggcataagcccatctttgctagaaaaatgctgcatttatacatcagacatacaataattctgtacaagttggaatcctagattttgaaggacgcccaaactttcaccaagtagcccaaaatcttgatgtcgctgaacatctgcatcatgctatggtttgtgttctttgtcctactcgtttactcatctgagtaagtgtcaaactcaaactgttgctcacctttatcagttgatgctgtccttctcctgagaaagaactggaacagtgtaaccgcagctaccagggctatctcagaatggtctgaagtgctagtcttgacgcagaagcggcctaggttcctgctgtttaggttagcgctgactgagactttcgatccgcggcccattcggaagtctgactgaagattggtgctgattacagtctccttctcgaacgacagagcggtggctgcgactgtgatgctctcttccctcacagggtaatctttccccctgaatgtcatttccaggccacctccatgtgccacttgcccgcagccaaccatcctcccagcattgccgaccaactgaactcgtcgcccgacagtgatggaatcctctaatttggcaccagtaaaatacttgctaccgaatttagtaatggaaatgcctcctccagtagtgttccagggcaaattgtggaacctggcatccccattgacagtacagaccagatccttatttgctgtttgcatattcatgctccctatcaaggagcggccattcttaccgctgtagcttactgaacattctgattggatatacaggtcttctttgtcctttctcatctgccccgcaattgatgcagtggtattcttttctaaatcttgagatacttcaaaattgatcccatcaaatccaatatcatggtcccatccttgtggatctaaaactggtctgaacaccatatcatcagtaataaggtaacggtagcgatggactggataatcagagtcaaaacttgacggaatttccatatctgacatgtgcacaacctctggggacacgctttcttcgtaatcatcaccaacagcatttgatgcatcaacattttgagcttcaacaagcttttgcctcctaattccctccttccactgtttctttaggtacagagtttcacgatagtctagttcatcaagatatgcagatctctgttcttttgacaatttttcatattcagatttcttcagaacacggaatggcggtagctgatcagattcatcctcatcatctgacacttcggtcatgtcaatgccaacatcttctgatcttgatgatggattaggtttaaggagtgatgaaagaagatgaggcagtgaaggcagtctggtatttgcttgtgacagaaggaagctatcttggaacttaagcaaggaatttgcttctgccaacaacttggtcgccccacatagcagtaaaagttctgatacccataccttcccattaggtaaaactctttcacctttggtgttccgtcggcacattggatgattgtcaacaagaactacagggttctccatctgtgtgttagaagcagccacctggatatgacgctgcaccacattcttgcaataacgggcataggagtcatattccagaggataaccatctggtccttcaggaggagatgaagagcagtgagtcatcacaaggacagtgttgaaccacatcgaagaacccaagatatcagttatgagcttcaacagcgggtattcacagtatctactgttaatatggtcgagtcgctcgaagtacaagacgatgtcaggtggtgatcttttaatgaagcgcttgacagcatgtaaaatcttcctgttcttcctctgtctatggtaatgaggcaacaaaccaggtgtgtcgataactgtaactcttattcctttgattgttccatcaatcctccttatcctttcagtagcaggagctaatgcattggtagcaacctttggttcatcaaaaatggagtttatcgtggcactctttcccacaccagtctttccaagtagaagaattcgcaagggcaggtccaaatcaggtccacctggtgcttcttgctctgctgctataactctggctttgttgatagcaaggttggttctcttggaatctgattcgccagctttaatcaagttggcaaggtgcaatctgtacagtacctgtgcgacaacatcagtagtgggaggcactccagttctgtgcacaagccgcaggaacttaatttgaagagcctcaacatgctttagtggatctgactttgtgctatcatgatctggttcataagatggactggatgtgacctctgaatctgatgcgcggatatcattagatggaaatctattggcagacacagtttctacaatctcattttgcatcacgcctgaatcacaagatggaataagggggcattcattatagtattaacatgagcataaatcaataacaaatgtgtcctaaagaccattctattggtaacatgaatgaccaacaagtaacagaatgtcctcccagcaaagcaaatgcatccacaccaatttggcagtaccacagcatataaattttcatcaagagcatctattggtactgggtaaactaatgaatcatgacacaaggccgtgctccaccgacgatggaaaaaagattcaatcctactgaattcgaagacataagatttcctatttcctaatcacaatagggcaacagttcctggtagcacactaatcgaccaccaaacattatacatgcccagaagaactagtattagcgaaaactatcacatatatcatgcaaaggcttgtaatgagcccctgcaccatttagtgaagtccaaaattttatcaatcagatttcagacttcagaggcaatactgtactcgagcaacatcagaaacatccaacaattatcatgcagcggcagactcgaaaacacatggcacagcatgttatccctttcagaacaagaaagaacctaaatagaatctgaaccatggaacctgagctgcaaattctaatcaatcaccataccaaactactactatcactaatcatcatcatcatcatcaagtaagtaagacagagagagtgcctaccatccccatcgcccccgggctgggcggcggcgccgtcgtggtgggcggagagcgagaagggcctcgccgacagcaccgacgagccgagccggtacgagatccagtccctgaagctcatcatcaccaatcaggaatttccacccaccccggctgcataaccagtaccaaaatcctcatcacctcgaaccaacccaaacaaacaaaacagaaaataataattaaaaaaaaccccaatccccccccccccctcctcgaattgaaggattcgatacgggaaccctcacgctacctggcctggtgggaggctcggagcccgcggcggcggcggcggcggcgagggggatgcggatgatggtgtcggagggagttggttggatttgggtggatgagaggagagagtgggtgcgtcggtccaacccagccggaaacggacagggtcgtccgcggcggcgagcgcccggatttgtcacgtctgcgagtgcgaggccgaccgggagatgggggggtcgctgacaggtgggccccagcgatcggtgcgagggtggttattccaggagtgcagctgtgcaggtaatcatagagcaggtccaataagcattttttttgccggtgataatacggccacgttggattctttcatgacctagaacatggaacagagattagaggagagagagtgtgagcccgcgactaattagtcgccggtttcacacgtgctccaaggcgagccaaattgaagtagcgctgctgcttgtcccccacaatactgctggactcataaaaatgaggcagagcgtaggtaaggcaggatgtcgttgaggcttcaagctcgtcggcaagcgactgtggctaggaaggaagcttggcgagcgacacgatgatgactagagtggcaagcttggggacatttcaacgatatgaactgaagcggctggtgagctcagggacattgatcgccccaaacgatgactgaatctggcttggtgtagatggcaagagaacctcgaagaggttgagcagcttgttcttgtgcggagttaagacgaggtcgggaggaggaggattccgggattggggtcgtcagtcgtcaccactccggaagaggaggtagtggccgcaataccagatatcttgacccccctctccaattattaaaaccggtgtaatttaactcccttagtggttttggaggatggttttgctgatgtggcgcctacgtggcggtgttgacctagtcttcgttcgacatggagttgacatgcgcttatttggcgttagaaataaaaacatatgaattggacccatttatcattaacacaaaaacactgtgggacccacatgttatcctctctcctccccttcttcctcctccgtccctccctcttatctctctttctctttctctcctctttctcttccccttcggccggcggcgggtggcgacaactggagcggtggtggtgggctttagtgacgacggcgggcgggagcaatgttggggggctggagcgacgtcggcgagtgggagctgctattgacctcaacgtgttgcttcgtcttggctcgtccgcgtccgttattgcacgaatggacaatagcgccccaagaagctcgtattgcagtgtt

SEQ ID NO: 71575 - DNA, 2549 bp, Oryza sativa
gccctccacgagggcgattttgcactgtgcggggggccgcctgcaaatgggcggcgagggggcatggaattttgcaggcggcccccttgccgccctaggggagggcgatttttgcctccccctataaagcccagcccctcccctatgaaatttcattatattcactaaaaatccaaaaaaaacgaaagagagagagaggggagggcagcagaaggggagcggcgaagccctgctggttcgctcactttatcacaggtatgctcccatacatcttttgcatttgtactaatatattacgtttgagtacatatgttgcgttttagttttagttccatatattttagcagatctatagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattggctgtgatgggaacaaccaggttctacctatggcttttgcatttgtagagagtgagaacactgaaagctggtactggttccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatattgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatattatataaaaaaaatatagagcacagtacaaaatcgccctcccccagggcggcaagggggccgcctgcaaatttccatgccccctcgccgcccatttgcaggcggccccccgcacagtacaaaatcgccctcgcggagggcggcaagggggccgcctgcaaatttc

SEQ ID NO: 71576 - DNA, 24747 bp, Oryza sativa
ggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccctggccgaaccggcaaaggggggcctgtgcggtctccctgtgaggagccccacgctccgtcatctggcgcgccaggtagggggcgcgtgtctttctgagccctcgtcctcctttcgtgtgcgccaagcttctcccgctcagcccaatggccgaacgggcagtggcgcacaacctctctccgagcgctagcggtgacgacggggagcagaacccgcgccgtcgggctcgcaccccaccgtccccctctcgccgaaatcttgggcgggggaaggcgctcgagggggtcgaaggatctgcgacttcgccgcccgcgagcgacgggggaggacggcgagacggggcgcgtcgccgcctcgtctacggcgatggcggcatgccccagggcgcgctccaggctgcgggcgcgctcctgcgtcacccgcccatcgtccccgatccagagactccagcccggcgttggctggatgacgtggccgacttggtcatgacggcgcagcagcgcctaggcgccggcgggcggtcctccgccaccgaggcctctggcgctgccgccgccggctccacgtcgtcaaggcggagggcgcggcgagcggcggccgttacccgccgttcgtccgccattccctcgtcaacgcctccgacccaagaagatgtgcgtgggggtcggatgcccgcctcgatatcgagcgccggcacgacgctcgtcgcgccacccacgcaacggagggcgtttcctcgtccggagcgccacttcggtccgggcacgggggccggccccccgtgtccccggttggtggtgccggctgtcgagcctttgtggcgagccttcggaacgtccgttggcccccaaggttccggcccaccgtcaccgaaaaatacgacggaagcgtcaaccccgtcgagtttctccagatctacacgaccgggatcgaggccgccgggggtgacgacagggtcatggcgaatttcttccccatggccctgaaaggtcaggcgcggggttggctaatgaacttgccacccgcgtcggtccactcctgggaggatttgtgccagcagttcaccacgaacttccagggcacatatccacgcccaggtgaagaagcggacttgcatgcagtacagcgaagggacgatgagtctcttcgctcgtacatccagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctagaactcctccggttctggtgtggcagctccggccgcccccgggtccgccgctcggtcagggcggcgggacaggaggaggaagaaggggtcgacccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcagactgccgcgcggtcaaaagtttggctgagcggacgaggaagtgggaggaggagaagaggcaggagcgccgtgagggcaaggccccggcggctcccgccggcaaccggcgaggtgaggccaagcagaaggccaccgccgaggacatcgacgatggcgacgatgacctggggtttcaggagcctgaggccaccgtcgccaccgtcgatgggggagcgtgcgctcacgtttcttgccggagcctcaaggccatgaagcgcgagcttctggccgcggcccctacccatgaggctacgcggcgggcgcggtggtcggaggttaccctcaccttcgaccagaccgaccacccgccgtgcgttgcccggggaggacagatcgcgattgtggtttcccccaccgtttgcaatgtgaagttggggaggtgattgagcaccgtctcgccgtgcggccaggcgcaaggccggtccggcagaaagtgcggcgacaggccccggaacgtcaaaccttcatccgcgaggaggtggcgcgacttctggaggccggattcatccgtgaggtcatccatccggagtggctggcgaatccggtcgtcgttcccaaggcgaacggcaagcttcggatgtgcattgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaaggatgtgcagtgcgtcaccggctgcatggccgccttaagtcggttcatatcgaggctgggagagaaggcgctacccctatttaagctcctcaaacgctccgggccgtttacctggacggaggaggctgagagggccttcgctcagttgaaggcgtacctcagttctcccccagtcctggtcgtcccggagccagatgagccgttgctactctacctagcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggccggagctggccctccgcctgcttgtccgacggtgccaggtgctcccgacccccaggatggcctcggggccactgcgggaaggccacgcctgtcgccctctgaccccgaggtcgtcggcacagaagccgagtgcgccccgcgcggcctctcggacgaagagcgccctggagatgcggcccctggcgaagaggatcggccccgccgaaaggtgcagcggcccgtctacttcgttagcgaggccctccgagataccaagacccgataccctcaggcccagaagatgctttacgctattctgatggcttcgaggaagttgcgccattatttccaggcgcatcgggtcacggtggttacgtcttaccccctcggccaaatcttgcataaccgagagggtaccggacgggtggtgaaatgggcaatcgaactctctgaattcgatttgcgctttgaaccacgccacgcgatcaagagtcaggccctcgccgactttgtggcggagtggaccccagctcccgagcccgtcttcgcccccgaggccacctcgggcccctcgcagctgcctcacaccgcctactgggtgatacagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagcaggactggggatccgctgcctcctagtgttaggcgactcccagttggtcgttaaccaggtctgtaaggagtaccggtgctctgacccgcagatggacgcttacgtgcgccatgtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacaatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggcgggccccgggcgggttcgagtatctgtatgtcgctgtcgataagttcactaagtggcccgaggcttatccggtcatcaagatcgataggcactccgcgcttaaattcatcaggggcatcactgctcggttcggggtgcctaaccgtatcattacggataacggcacccagttcactagtgagctcttcggtgactactgcgaagacataggcatcaagctctgcttcgcctcccccgcccaccccagaagaaatggccaagtggagcgcgccaacgcggaaatcctcaagggcctcaaaaccaagaccttcaacatcctcaagaagcacggcgactcgtgggtcgaggagctgccagcggtgctctgggcgaaccgaatcacgccaagccgagcaaccggggaaacgcctttcttcctcatctacggcgcggaggcggtcctcccatctgagctcaccctgaggtcccctcgggtcaccatgtattgcgaggcagatcaagatcagcttcgccgagacgacctcgactatttggaggagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagcgggggtcgggtgtcatgtatcgggctcgggccaaccccgcacccccccccccccgggcgtgcagggttggccgggggctaccacatgcatatactcatcttttttctcttccgtatttcaataaaagcattttcgatttcctaaggactgtgtctgtgccatcgttttccttttgaagaatcttggcttgaattagcacgctcgtgctcgaccctgccctcggtggcccgggtcggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgtggatctccccaggcactagccccgacccgcgccgtttgaggatgggacctgggcacgagcccttgttcaagccaagacatagaagtaccacggcacagaccatcctcgtctcatacaaacaacaaacagaactgacgcagaaatttcctctttacttgattgcagattaaatcagtctatacaagaagggggcccgaaggcctcggaagaagaaggaaaagttattaagattggcgggggcctgggggctcactccgacgcgcccgggtcgccggcctcatcgtcgctgttgtccgcaccgtcgtcgccaccctcctcgtcggagtcgagggcgaacgcgagccgaggggccgtaccctcgaagctgtggacgatgtgatcggcggcatcccggacctgcgcgcgcgcgccgtcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgcttgagggtcccggccatctctgagaggcgctaggcgaggcccccctggttggcggcgtacttcgcgtaccgcccgccccagaggcccgcctgccgcccggcgcagtctagacgggagacggcgtcccgaagcatgccgggccctacctcgttcgccaagcggagggcctcaacctccccggcggacgagtccagcgcgccctgcagctcggcgatggtgtgttcggcggctgcgaggcgggcggctaggtcgccgtcgcccgcggccgccccgccgctgtgcgctctcgcgtccagttccttcgcccgcgcctcgagctcagcggcccgctgatccagtgcggccctctcggcgtgggcgccttccagattgtggcgcgcctgctcctcccgcgctgcctcgcggaggaacaggctgtccgccagccgctgcgccgcggcctcggcctcctcgagagctcgcccccgctcggtgagcacgtcctcgcggaggcggagtgcggactcctcttcggcgcaggcggcctcgtgcgccgccagtgttgcctcccgggtggcgacggcggcctcgcggcccgccaggtccttctccttcgtgtccagggcgcgggcgcgctcctccagcgccgtggcgcgagcctcaagggcctcttcgcgctgccgagacgccgcctcgatctccgccgcccgccgttctcgggcagcggcggcgtcaaggactccccgggcggcgtagagcttcttctctagctccgccgcccggctcctgtattggaggcggaggtcgtcccgcacctcgtcgagcacggcggtggcgatgagggcagtctcccgctcctcctccacctccctagcgatctccgccaggtccctacgacgggcctcgagctcggaggcgtgccggcggtgtgccttgcggcccgcctccaccatggcctccaccgagcaccgcccctcctcgacgcgcgcccacgccgcgtcgagctccgcccgctctgcctgcaggacctccatctgggcacttaacccgtccagcaccgtggtgttcgcggcggctaaggcctgcaggaggggctccgcgctcagtggagcagcggaaggcagaggggagagccgcctcggtgtgggtgccgcgcagctcggcccgccgatcgacgtgccggacccgggggcgtcccccgaagctggctcgtcccaagcatcgcccgaggggtcgggccagagcggcgcgtccgcggcctcgtcgtgggtggcctcggaagtcgtcgtcgcctcgggcggagtcgggtcgggggcttggcaggccgcctggcgtgcgcgcgccgcctcctcctcccggacggactccccggcccggcggagtctggcctcctcccgagcggcctcctcagcctggcgaacccggacggcctcctaggcagcctcctcggcttcccggaggcggtctgcggcttctcgccggtcagcttcccgcctccgggcctccgcggtcgccgtctcctcggcctcaaaccggccggacttggaatggcgggggggcgcgacgggatctcgctgaggcagaagaaaaaccagaagacaaaaagaaacgggcgagtgaaaactcgccttgggagatgggagaatgaacacggccgcggtgggcgcggggacgaacctgcggggaggtcggctaaacgaccacctcggaggcgagatgaggttcccccggcatggctcggtcccccccatcttgcggagccgtttcttctttcgctccccctcgggctgcggcgtcggcacggcaccctccgggcgcctgctgctggcacgcaccgccccgccccctcggggaggagatgggggggcgtgccctcctgcttcctcttcccccgggcgtcggcagggcggctgccccccgggcccccgtcgcggggcccagaagcatgaccccctcccggggtagattgtttcctcctgcggctcccgcccgcgccatcgtggcctcggggggcccgctcccccgacgccccgaccgcctgcatgatgatcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatccggcgacgaaggtagtcgccgaacaccatggctcccgtaagcccctgggatcgcagacccgccaggcggtcaagaacggcgtcgtagccgtctcccagatctaccgtctcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattattgcgttgggggtgagatgcgccatctggagatcataaaactccagaacatccatgaagaaattagagaatggcgggaccagcccggccattgcgaaagagaggaagaagacggaccgccccgggtagtctggcgccaggcgtccctcgcccagcgcgaccacctcccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaggtggcgaaggcaaggggaagagtggcgagaggaaggaaacgaatcccttcctcggcgtctttattcccttgccaacgctatgcccggctcctcgcttcccgcgcccactatctcgccccctcgtttctcgcgcccacgcctccactaatcccactcgcccgtttgcggcgcacgcggcagatgtgcggccgtggcggttgagatgggacagatcgtgcgcgcattaactacgtttgccaaccgagaagagcgccatcatcatgtctccaggcgaaacgaaccggctcgtcccgattcgcgcgctgctcgagtaatgtagcggtcttgaagagaccgctcattattgtcggtcggttttcccttgccgatgcacgcgatttgcgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcatgactagaggcttgggcagccgcggtcacccacgtggcctgacccccttgggggggtcgggcccaagggtgacgtggccaccccacactctgtctccccgaggggtcgggccgctcccgtttcggccccgagggctggggcgccccgactccccgtggtattggcgccacgtgtgtgggttaggtgagcacagcggcgctcacctaaccgcatttatagcggattgaatgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagggttcagcgcaagtatggcaaggaagtcgccggccattaaatgaagtttgaaatgggcgtcctccggaaaagctgacgagcggggcaggagacgtgcgctctgcttgtcaaagatcacttccggctgtagactagccctcattgtaaaaagcatgtttcctttcttaggcagctagaggcccatgtggtgacccctgaccagataaaaaggaggcccaggcctaagggagaaggggggaggacgggggggggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccccggccgaaccggcaaaggggggcctgtgcggtctcccggtgaggagccccacgctccgtcacacatgtaagtgagatgaaaaaatatcgggcccacatatcttattttttcctttttttctcttcttctcttttgctttttttgtctttgccaaaaaaggggagtggcgacgtcggcgggcgagccggaggcaggcgaagcggcggctccgggcgcggaaagagcagaggggcaggggacgcggcgggcgagtggaaaaggagtgccagagccgccgctcgcccgctgccgctgcactcgcccgttgagatcatcaagctctgctccgagttcctcaacgctgacaccgacacgacgtccaccacgttgtggtggatcatggccaagctggtcaagaacccgtccatccagtcaaatatccacgacaagatcacggcgaagaccggtgacgaaaaggtcgaggtctccgaggagaacgtccacggtatgccgtacctgagggcagtggtcctggagggtctccggaagcacccaccggggcacttcgtgctgccgcagaaggcaatggaggacatggaggttggcggctacctcatccccaagggcgcaacggtgaacttcatggtggccgagatcagcagggatgagcaggagtgggcgaagccaatggagttcatcccgaagcggttcctccctgatggcgacagcgagggagtggacgtgacgggcagcaaggggatccgcatgatgccgttcggcgtcaagcggaggatctgcgtggggctcaacttcgccatgcaccacctggagtacttcgtggccaacatggtgagggagttcaagtagaaggaggtcgccggcgacgaggtggagttcgtcgagaagcaggagtagcggtgggcgagcagagcgtggtgggcctgaagaagagaatagaggaaagagaagagaaggagaagaaaaaagaagaaaaaaaatgtgcagctgacatgtgggccctatgtacttttttttctgactaggatgccacgtcagctaaaccacgcatatatactggcataggaccttgtgtgcatggtttgtgtgagtttagggtacacagtgatagggctggatgtcgagctggctcggctcggctcggtctggctcgttaggataacgagctagctcggctcggctcgttatcctaacgagctagaaaccaagctcggctcggctcgtcagcaagctcgagctagctcgtttagctcgtgagctttggggacgagagaaagcgaacaaggggagaagccgaggaggggcaccgggaggagccgaggaggggcgcccagaggagcggcgcgggcggcggcgtccacgaccggccgcgtcagcgccgggaggagcggcacaggcgacggcatccacggcggcgtcagcgccggggaggagcggcgcggccggcggcatccatggccagccgcgtcggcgctggggaggagaggcgccggccgcggtgtcggccccgggaggaacggcgcgggcggcggcgtccacggctggccgtgtcggcgccggggaggagaggcacgggcggtggcatcggcaccggggaggagcggcagcgttgagggctggcgcctggcggcggcttgggtggggattggggatggggacaagccagaaggggattcactcactagggttttgagaaggggatgggctgttgggctgggctgggcgcctgagcctcatttgctctggctcattaaggctcgcgagccagctcaagctctctaacgagctgaaatgccagctcggctcgttaggaaattcaaatgagccaagtcgagcctatcacgagccgagctaggtaacgagcgacaagctttctgtccacccctcaaaacatctggtaaggcctttggtggttttgtggttaaagaacctcaaaacatctcaccattaaggaaaattgaggggccttcggtgaatttattcctttaatttatgtagcataaatatattcagcccaccaaacatttggtaaggcctcatttagagcctcaataatttgagttgagaaatgttttgagcttgatggtgaaggaaactgatttgagttccagtggctaagaacgcacctgaatctaaatgcatgacctagcttggatcaaatgactagacagcaataagttcatagcctttactacagaaagcagaagagatcgagaagataaacaaaagtgataagaaaaataaaaggttcaaactctagctacgcttgagtgggaacctggaatatgttaggccctatcatcgtcttgggtttaaacattaaacccctcgatcagagtaattaacaaagatgtcaaggacaaagaaagggtataattaaagaaattaatgtaaaggcaagcatcttttagggcatgcaactatgcaagtagaagagaaactcctcaggtttattagaagaacctggaaaaaaatgctcatagcctaaacactctcttgtcccggtgctgctttattaaaaattttcttttgaaaacatatataggtgtactttattcccaattacaaggcaatttgcaatgcacatgcatgcatacgttggctagctctctgggttgataaggaagaatgcacattattgatattaatttattaatttggttgtcatggcaacatttctcttccaatgttgaaattaatctgtaataatattaaatgatactccctccgtcccaaaataagcgcagccatgagtttctgtgtccaactttgatcatccgtcttatttaatttttttaaaaaaaagctaaaaacataagtcatgcataactaatcataaaaaaaattcaattaagacggacgatcaaagttggacacgaaaactcatgaatggacttattttgggacggaggtaataaattatcactgaagtacttgatcacaaccattagtttgtcaagtaaaattaccattccttttgcctatgaaaccgtttaaattttagttcagtttttctaaaccaggattttggagcatgcgtcttacttaggattattgactcgattcatatattttcctagcactaatgttcctatagggtggctcttgcgtgttactcttaacatttaattgattgatgtatcaaacaatttgttgttctttatttatttttcttacagttttaagtttataatcaatatatatccaaatatttatatttttaatatatctcaattcatgtccatttgtttccaccttattcgactcatgtttaacttaattctttaattaaagagattatactaatttagttaatgtggtttttcaagtgttgttaaaagtgtttctaaattcccgttgcagcgtgtaggcatccataagtttgtagagaaaacggataaccatgtccatccatgtgattttcattaattatgctatctatcaactaatctttttctaactgttgatggagatatatttcaacaggcggtgacacaggtggctagcagagaagaggagggaagtgttttggtaaatatcataaaaaatctaggaaaatgttctatctgcaagaggaaaattattttggccaggattggtctctactagtgctaggccggctgagtgtaagatggggtggttgtttttgctgatggaggaaaatatctcctatatccttttatccttcacatttgttgagaaaatggataagatccatgtatgagagtttcattatctctatcaactaattcttcttctttattgtagatagagatatatttcagcccgcaacgatatcacaattggtgtaactttatcagccgcgtaatttagagaatatatggcttttctccgtataaaaaaaagaagtgttttacacttctggtctctgcacaacgtgcacacaaaccaatgaggaatatatagctaacactacatcgatccgtcgtccacaggcatttgctctcgcctaacaacggctctagctagacctctgaacaagtgatcattatcatcataagattctgcctaaaagctagttattatatataagcattgtggttacagcatgcaagcattacatgcacgatatgatggcactacacgatcgagagagagagagagagattatatatgcagtttggcgtccagaacaaaccaaacactgcaactctagctttctcaaaaagacagtgaaagttctactagctagctaggatcgatattatgcatccaatttgcactttgaaatgggaatttaatgccacctttttgactggtcctacctgattaggtagtactaattaatcttttatgttagttgcattgaccttggcgaaataatgcatgttaaaaggaggaaggtaccatttgaactgtgaaactttgggctagttagggtggttagctaggcaccgaatatggtaaagatgaagagagctatatgaaagatatttctctctctctctctctcaaaagcttgaacatttcgtttcttcaatgtaattaagctatagtcatcgtttcatcgagcagaggtttaagctgataggtaaaaacggggaaattttcttcggattggtatgcattgctttacatttagacgactagactgtacatttatgtcttttataaaattatatatatatacaaaagatttgcatattattgtgttaatataagctaaactgtagttaacgagtggatttaagttgtaaaggtgaacatatttctatttgtttattacaactgtataaacaagttgtacacattgcttttattagttgtagacacaactagacatatgaacgtgaaaaaccctggaaaattaccccattaagagacttactagctagaggccatatacagtacgcctgcatgtttgcaaatcaagcagctggtttttttttgcaagtagtgagtgatcgcctgcatatatagctagaccaaatcttgatgaatgttaattatatataaaaaaaattggccttgaaatgaccgaacgtattagtgactctgagatgccggcttatcgccataaacttttcttatctgaacagttgctccgtatctgaattcagaaaaggaaattatttcctcaagttaaaatgcttatagacagcttcatgtgaaacgaaaccaaaataccatttcgccaccattattaccttaatatattcatgacatttcatatccaagatatccaatgcgtgcatcacgctatgcctatactacatcactactgtcattgtctgtactagcgccctgttcattcagatcaggcttgcaggattcagagctgagtgcagacagctttggtgaccaatagaactctcattgttacatttcgaaagaaaaaccatggaaacttttcatataagtttatatttatcaggaaatatattaaacattcaatcatgatagcaggaagaatgaaataagtacagatataaaattttaagaaaaatcctatttctaaattctaactctctcattgtgtacttgttggccacagcaaaaaaaataataattatatacataatttagagttgattttaagatcttttcatcaaattctattttctatcatcaaacctgtagcaatagaaatataaaagtttaagtgaatttaaaaaactgcatatagatatttttcacaaaactacagatttaaggtgttatatcacaaaattacaaattgaacattaaatttatcataaaactatagatttaaggtgagataaagcaaaattacagatataatagtgaagttatcacataactacacatttagagtttaaatctttagcactactattatgttggagttatatatattatagttttgtgattaaattggcgctaaacatgtagttttgtaataattttaccagtatatctatatttttgcgatactcaatcttaattccattttttcataataagtttactactaaatctattgtttcatgattttttttagataaggaaaatgatttatatccccgacctctgccaacaagttgcatgcggccaatgactcagaaaagataaataaatacttgaggttatgagacaaacccacatctctctcctaattatatctagctgaaaaaccgaaaatagaacatataaaatctataacgatattctataaaaactacaacatccaaagtggaacaacagacatctagctatcgacttcaagagtgtgtagctacactgcacacagtatcatgctccttctgtgaaagcatccagaacaaaaatggagtcaactggaaggaagacatgaagataacctgtaatggttagaaaattttttatcattgaatagtatatcattgcgataatgccaaattaaccaatataagacacttccaaacaaattagtttttttagtggatctaggcactccctttagacaattactaaaaatatttttttagcatatcactatatcagggaggagggattttgaaaggaaaaaatatatatcgctaagcacactttacaatatggcaataaaaaaaatatgctgtataggaactttggactttgggcatttggatggtttgtacgaaacaaattaaacgacagaaggttggtgaaaataatttaatggacgagagatactagagagagaaaggggaagagagagtgcatgcgacttctcaaaacatgagataagacctcatgtttgttttcatttagaattgggacatacgtaggaagcaagttatttttcttaatcatatactccctcattccttaaatgtttgacgccattgacttttttaaatatgtttgaccgttcgtcttattcaaaaattcttgtgaaatgtctaaaactatatgtatacataaaagtatatttaacaataaatcaaatgataggaaaagaattaataattacttaaattttttgaataagatgaatggtcaaacatttttaaaaaaatcaacggcgtcaagcattttagaatggatggagtatattccttcgttccaaaggagttaatatataagaaaattttcctaaggattaatgaaatcgtttcaaattaatttcctctgaaattccttccacccagaagtctgaagaagctaggaactttgctgatcgagtttcacacgcgccgttgtcttccgaagaatctacctgaaccccagcatcaccaccaccaccaccaccacccctgcgcgcggcgcgcaacgtgcacaacacgcggtacgcacgttctctgcagcaatctccaccgtcagatcacggcgcggccgcggttcgagcgaatcccggccgtccgtgatctccttggggggttgccatccctcccctataaattggagagggccaagccatttacccttcaaaattaagcagagctagcttcctctacctgacaagtgtgttccaagtgatcactaccagctacttgacaagtgtatttaagtagctaattaagcaagcagctgtactgagtacacaatgggaggaaacctgtcttgcttcgggtcggcggcggctggttcaggttacggggacatcgccgacgaccagccggcggcggcggcggcgtacgagctgcgacggtcgtcgaggaaggtgcggccgagcgacgaggacaggctgtggtacgtcggcgagcgggacgtcgacaggaaggcggcggagttcatcgccaagttccatgcctcggctaggttcgtggaggcttgaattgagcctaatttgatgacatcttcagatatcttggttcttggatctatacctgggtcactctctctagctagctgctgctcatgctggtgatctgcttggttcgtttagtttacttctcttcttgtataattaactgtgttaattagctagtcctatgcatatatagatatatgtatgtgtatatcaatgtatgtacttaatcggtgtaattaaggacgtgtaaatctgtattattattattctgctaaataagagcaatgctgcacaagctgctgttgtatgtaagtacatgtttcttgcaacgagttggtctctgaaatctgaagtgaaatgcaatgtttattgcttgatgggatttgagaggatgcagtgaattaataattacttgcattaggagaacagaagttccagtaaggattaattatttatcagtactaagtagtgaactctacaaagatgttgtggctggtcaggtaattaacacaaaacttatttggcacgcagtttatatgtgaattaagtgctgattcagactggcatcctctcgctagccatatcaggaatgctgattttttgctttccaattttccaattttgaccaagaaaatatttatgtaactagccttgcccttcatacaaatgcttatagactatgttacccacttacctggctacccttcacgactaaattaacaatgcaattccggtagttttactagctagctgattcgattaattcctttgaaaactagcaaattaacaatatataatgatatacttgaagcctcgatcggtaagctcatcatcaagactagcttatctgtaacggattacaacattatgttcagcttaattaaagtcagagaaaaaggaaattccacagtggatctcctcaattttacccttctgctattttcactcatagcactttaccaagtcgaggtagagtttccaacatttacagaaaaacgatggatgttttctttggctaaatacttgtcaaagagatgacaatttaaggacttactgattaaaagttatgcaaacctcagcctttgcatccaagcattactattgatgccttgattagttcatcttcttcagatatttagaaggagatctgctatagattgacagtaaaatgtgatggtgaacgttaataaagttaatgcgaaataattgaggaatcacattattattggagtaacagttttgattgaacacttagcactatttagtagctgatatatgtttacttccaattatacatccatgattgagtaatattaacccttgcaagaattgtgatgatattcgatcgcatctcattttcaaaaaataaaaaaaaaacatttatgttgtttcagtacttaatttcttgcctctaactgaatttctgctgcaactaattttcttacaacatttatgaagttaatttgttttaaaagacatgatattactgaaaattgttatatttatgtaagttgaaaaggtttgacatatggatacaaaagattcaagcttatcttgggaaaagatgatcaaatgctcggctcgctggacgatacttatctaaacagtctcttggatgcaaatattgcatagtaaaacaaaaaatcaattgcctactatttcgtcagtacaatggagttttggtgccataaaaattaccaggattttgtaccaacagatagtaccaaatatatttttgccgtatggtcttttcagtgcaatgaacatattctacagctacatatcaccaaccattttaaggacctaaccaaaaaataaaaacatttaaaaacaaaacatgaaaggcgcgacaatctttcccgacaaaagcttttatcataaacatatttgtcgcattacttgtccccgtttcatgtacggtgggatctcataggccagaaccatgttccagcctagcaatgtaaccatgttcctgcctagcaatctgctgtcacactaaatcattaatcaactgtcacttgatgctttcattcatgacatttcctccaaaccatcactgatcagcattctaattctatttttaaaaatcagtgtgatgtgttgcctgtcaatctgttaattaacttttacatatatctgttcagtcaatttttttcacttgcaacacatctcttccatatgaatatatttcaccgaaaacttcaaaattcaggttagtactagtaagctgtttttcatacggaatgttattaattgcagtaaaaaaaaacgcattcgacaaggatcatcagcaacttaagctcccaagaacctgtgatacacactttccccggcaaaattaagattcgatccaacttagagggatcacttgaatttgtctctgaactctcatcctttctttcccttaacgtccgaaaattccccttctcaagccatcatcaatactttagggctggggtatcaaatcctcccatggcaagtgttgctttaggtagataagaagaaggagccaatgatttgtgacaagtcactggaccttgtgtgttggaaaattatcagaaaagatcgttgctttgtaccaatggcaccggatcatcgtcctcggaattgcgctttacatataccgtttacattacattcttcagtggagttgcaattacccaattactatatctttgacctgtcaatctctgcatgtttgagaggacagggctggtgaatctgaatattctcaagaaatggtggagatatcgttttgagaaagcggaaattcctttggcatataccgcgctttcgcttttctactgtaccaaactctgagattgtccgcgagatttcctgttcatgttcatctgcaaataatagcctgtgtatgtgcttgccactgttgcatgatttggacatcatgatcaaatcaatagacaccgccatatgtgccacaaaattgcctatttgtgtcacccttgttcatggattttcagaagctgaatggttgcttgtagaagtatctatgacacttcctggatttcaaattatcaccaaatttcaaacttggcaagggacatttttttcaggacatagcgtcaaataggctcagaaacagtcttttattctttttctcatttttccccttgttgataggaacaaaaacgtgcaaaattatgtcatttctttgggcagcattggacggaggagagcaatcttcacatggtgttgcacagctgtgagcacatgatgtgtgaaaaggctatcaaagaaggccttttttttcagtactttggaagtaccagttactatggaaaaagtacatccatagtccaccaggtttctggaagaaaaaaaaacaaattttgataaatgaatgctagcctaacttgttaggactttctagttataaactattttttacaatgagattgaacctttgtacctaataaaggtttcccttttatgttttcaaatgatcctttaagcatcctgaagctaataaattatggattcttgattttgacatcataggtattggtattatatgtattggttcagtgaaccaaacatgagattctaattcagatagctccttgatggggcaatatgcattaaatcttacataaatacactatcattagacaagtgacaagaacctggctatagccaagatttgcattggtccttttttgccaagctgtatcccatggaatctgaaaaagaaaagagggagttcttctttggggcaattaccagcagattgctcagtatgcatatgtcagaattcagagattgttctcatctataaagtgccgcaaaattcattccaccatgacaaatatagatcgcagatcgagcttgcgttcgatgatgagaacaagttgcactttgaagccacacctgataattttgctttcaatcaggagaaaaggctgcccaaagcatcgattctctgctatgcaacaagcgcatgtagcatgtgcgtagctctcttatcttctctgaacctctagctgaattatgaacagattttagtatcatacacactgatatgttggcagaagcagaactgcagaaggttggtacgggacaagtaaagagatcagtactacgtatttcagtacatgatacgtctactggcgtaccaacattcaacaaaaccattgttcagacttatctaactgggctaccgatatatacagctggttttcagtgatatgttctaccacatattttcaaacctacaactgggattggcattgctaggcaaagtagtgggactattttttcgcgttcttcattttttgtgctagcaatgcacaataacaacatgccagaccgttgtttcaatggcgttgaaggtgaggcgatcaccttcttttacctcattttccaggcaaaattttctccaacctggtccatttatgtagccataggtgttcgctgttttgaaagccactcgccaagatccttttttcttcatggatatcttcagtgtgatcgcacaggcttctagcagaccaatttgagagcaaaaggtgcctctcacagactgcaatgttaaagcaatataaagaaataaaatagtagtgagatgtttcattatttttgaaaaaataaacgttcacaaaaatcagaaggattgttattgtcaacacactgtagattaagaatatgtatggcatttctgtattgccttccctaacaaaaaaaatatattgagaaacacaaaagaaattttcattttcatatcagaatcaataacaagtactacaaaatggtcaaaataaacagccaaggacttcttgtcaggaaattctcgacatttaactgatggtatttaaccaaaattctcatgataaactacatttttagttgatatcatgttgtagtgtcctttttctctatgtgtatgacaattttacaattacagatttggttctttaaagcaaaaaaaatcatccatatttagacctaacagatagtttcagaaattgaagaaacaaaagtcagtgattttccatgttgataatttctatatttttttccttaagctcgtattaaaccaaaaaaatcatccatatttagacctgaacagatagttttcagaaatagaagaaacaaaatgtcagtgatctttcatgttgattaatttcatttttttgttcttaagctcataagcagttaagctagataaaaacagcagaagctgaagcgctcacaagtaggctatgaatactataggccgtcatttcctttgtgaatgaattctgtgacacaatgctgacatgtttcttatgtggttcaaccttcacggaaattggggaagccctagatttcctgtttggtccctctaagcatgtaccctcaattcttcgcgtccttttccgcttgacaggtgaaactccaacttttgctgcacctgcataattacattttgaaaagaaacacggaaaatccatagttgaaactacaacggagctggaatgctactggcttactttgttgaggcgcattgctcggtccttcggtaccatcagttaagtacagcgctgccgttttgtactccttcaggcagccgttctgtaggaacacctcaaccgtgaacaccatgttaccttcataccggaacagcaggatgttgccttcggagagatcatgagcagccagaaatggcgcccagccgtctcgcagtagcacgtccggttgctcccgttgtagttcgactcgccagaacttgccaagagggcaaacaataatggcattctggtggttgtttgtgtaggtttcagtcaggtgttgctgcacaaacttctcagggattttctgaaagaatgttgacagcaaaagaaagagcatgctgtgagcacataatacatataactgcatcaccttcagagctaatagcctatcaattccacaaatacatagtactactagcactagcttattagctgaaggcggttttcccctgttcttttcatctcattcatcgaactattgaaacggggttatttgctccactcttcgaaaaatacgttaccacttgttttaagttatttgtttaagtttatttcttaaagcatttaacttatccccataatccaatcgatcgataatccgcttaacaatctaaatcaaacaaggccagagtgcattatcataagaagaagagaagcaggtaatcaaccagaagagcagaacttgggcggaagttgcaagggttatgacgggtgaagcggagctgtggcggctagctagagctgcaatccctgttttggtagctcatgttagtggagaagggtcgcaaaatttagttggagatt

SEQ ID NO: 71577 - DNA, 759 bp, Oryza sativa
ggctatggccatctcgccattggaggcgaagggagaatgggactaaggtactacagttccctaccccgaccctgagcacaggatatggatccggtcatctggccaccggaggcgaagggagaaggaggcaaggccggagcttgtggcaaggaggtggcagccactcgtgtatttgcaggcaaagggggagatgagaaggaggttgatgcttggggttgcaggttgcggcggcgccgatgcttgggaggtggagagggagacgaggtgacggccaacactcactgatgtaggtggtgccgttcaacattcgggcatttggctgtcgttggatcccctcccccctcccctagggtcgggtcacttctagagaattgatcttttgttgtggtacaaaaaacattaagaactgatactaaagatgtatttagtactgattctaaaagtccaagtcctaaaaacatctttagttccggttggagttaccaaaaatacatcttgagtaccggttggtaacaccaaccgagactaatgatagaggatctttagtcccgcttgataacactaacccagactaaaaatccatttttagtaccggttggtaacaccaacccgagtaaagatgcttccagggttagttcaaaaggaaagcacatctatccaagttagatgtgtggagttggtgggatggttagacgtgtgagggctgaggtgacaggtcttgagttcaaatccctatccccccgtccccaaaactttttt

SEQ ID NO: 71578 - DNA, 5354 bp, Oryza sativa
ccgccccctgggagggcgatttttaaaaatcgccctcccagagggcggtaggcgactatttccgtcaattttcaaaatggaaaattatttttgtaaaacttttaataaaaaaattataaataaaaaaaattcgtcatatgtaaggatggtgcgtcaaagtcagctgttttagtcggtggtgagtcacgttttctatttttgcacgagaataaacggaaaatgcatgccgttgcaagttaaacggcacaaaatgtcacctgtgtattcatctttgctccagcaaatgttcgtgtgatgtgcatctaatctagctaagcagtaagcagcgagaacgtactctgttgtgtacacctcgtgcttgtgcggtagcatggtctgtcgatgtgtcttgtctccgctaccggcccatcgtgcattgccgatcgagccggcctcggctgcaattcgcgtccttgttgctcggctgcattgcctgggcgaggttccagggtggaccgatgtggcccggtgcatcgttcgtctgttgttgggctggtgaatatcgatcaaagacaatgctataaactgaccttttatttcttgcaaaatgttatgactggcgctgacaatacggcaaaattccaactatactgattacttaatggcgcgtatagatggccatatggcccgaggcccgtgggctggcccaaggcacgccactttggcctagcccaggcacggccgggcctaggccgtgccgagcggcccatttggccaactataatggtgcgtcgttcacttgcccctttcgtcccagaaaaaaatcaaaccctttttgggacagagtagtatttgtcattagaaaattgataggagtatcagttgcacatttgggcccaccctcttaagtctcaacactgtcctttctttatctagcaagatcacatcacaaaataggccaagaaaggtggtgttattttctcctaaagatgaagattaagtttttacgcaaaacgaggtggtgttattgagttttaattattacaaattgaaaaattgattaatatgatattttagagcaattttcatatagaaagttttcgcatgaaatacaccgtttagcagtttgaaaagctgccatgaaaatcttaatcttcatccaactcttgttggagaaaagaacgggacctttggccacgcccatgaaacaggggctactgttgccaatccgttggtttggagagagctcatatgatcccatcccaccacatcaacctctttggtcaccacctctgtttgtttctctgtcgggccaatcgccattgacgcagagcaccagccatggtgagagagtgtcattatagacggattgggaatgttgcccacagtggagtatagtaaacgaatcctcttcaggggtcgaaatataatccatattatgtgcgtggttactcttcagtcttcactcactcttcaatcttttcttaagagctaatgggcgaacgtgcgccaaaccgatctcacgaataggtatgggaatgagatatttcttcacacgtgcgcgtactgcttccgtttcttcacactaaggtggtgtttgaatctcgtgagaatgaagatgaagataaagattaagtgtttcacgtaaaacgaggcggtaaataacgtgtgattaattaagttttaattattacaaacttgaaaaatagattaatatgatattttagaacaactttcgtatagaaagtttttgcacgaaacgcaccgtttagcactttgaaaaacatgctatgagtatccaaaaatttattatccaactctaaaatctgtcacatgacagatagcaattccgaataaataaagtgcgatacaaccagcgcgtggagttgggcttcaaattctaatcccactcgtttccgatgccatactctagagatatgttgaaattagaattcagcaccaactttagccgaacccaactccgctcgaagaactggaaccccaaacccaattccacggaccggttccaaggatccaaacggaccagcagctgcttccaggaaacaaaggatcgtctctcgttagaagttaccggtgcctgatgaactagagtctcctcatcaggctgcgtcaaaggggaagaacgtgtcttcgtttctagcgtggaattgaacgaccagagcagtatgttgtgcagctgaatcgggtggccggtggtcgacgagaagccgacggccacctcgctcggcaagcttctcctcagatcaacagtcgagttgatgcttctgcagggcgcgccgccgatccggacagattttgttagcacctgcgttctgtggtcgtatccaatatgcacgaacactgtgccttcgccgccgccggccgatccgtggttggtgtctccggccagtgaccacggtggtgttgatgatctgcagcttgtagacgacgatggatgtgacattgacgacgaccgtgctattagtgtagtctcgaactcgacctcctcaatctgatcatcgccgtccgttgtaacgcttctgctgtttctgttgctcgacgggtagtaaggcacgaggaacacagacatgcgaggaggagagccgccggcgccggcgccggtctgctgctgcgttctgaggcagaaggtcatggtgaagctcgcggcagcgccggtggcgttgtcccagagcagcacgggctgcgtgtgaagcaccctgccgacgctccggattcctttgctccacacggtagtagtactgtctccatggaggcggccatggagatcgaggatgcttgtggtcgtcttcaggtagaagaggctgagatctttagtgttgtagtgaggctgggaggagaagtcatagctgaaggagagggacgaaacgccggtaggcggatgggtggacagcagcgagatcagcagcacggagagtagctgccgaggactcatgttgcaggtgcagcagatctcatctcaatggctttgtgcagcaatacatttgatcggtaaatataactaggtataccgtatacactaggaatacataggagtacatttctaaccctgatagcctgctgaaacatgattggcttgtagtctttcgtcgtagacgacagatatcatcgatctcgatctgaactcaacggaaaactagtagaataagagcccgacgttgctctcatcacgctgagcgagtacaacttcacaccacatgacttccgtcttccggtcgtgatccgctgatttcccggaaatttcgaccgaaggtgctgcgtatggtacacaacatatttaagtatttggtgtttaatactttgccactatatttttcttgagaaatacagtgcaaacgcatgtattcacagtgagcgcaaacttacccatatcaacgtacaagcgcacatcctactcctatgaacacaaacgcaggggtatataatgggtgcatactcaccactatgaccatatgaacacaaatgcaggtgctcacaacccgcgcagactcacccatatgaacgcacgcacatgcactctacccctatgagcacaaatgcaggcgcacacaatgggctcacgcccataacgcgcgcacaatcactcatataaacacatacatgcacaccctacttctataagcacaaaccttctccataaccctatgaacacaaatatacaggggtctataaacacctttgaaagacagggtcggcataccataagtttaaggaagtcaccacgggtgcctatgaacacaaatgcatgtgcctatgaacacttttaaaaaacggggtcggcaccacgggtgcctcgctgttaatgggtacgttgctgaccaccgaaaaaataattaaccataaaaacaagcacgtgttaaataaaggatttgaatccgggtggatttattccatcacaagaatctaactagttaagctatgcttacttcgcttttgccactctattctctatcagcctcatcatttggcatattttctgaatatgccaaatggcatatttgcaaacgaaaatcaatttgtgaataaaacttttatatatgagttcttagcgatctaaaagcaaaggctgaaaaataaacttcaattaaaaaaccccaaaatcagctccaaatttaatgttgaaaatttaaattttagctgataaacatatgaatatgccaaacaatgaggccctgtatgtctatagaggagtagtaacaaattgttaaatgccatacttaatagcgtggcaaataattaaatataccaggtccagactccagaatgacagaccgaccgagctaatccgctacacaatttcctcacagcgtacggcaccaaattcccttgatgggcggtcatcttattcataggattcgcttagcattgtacaggggtttgcacttgcttttcaagagcatttatttagttctgtttccatagaacgcatttgaatattttattttttgtactaagagtttgcaatctgttcttgttcaacttataaataagctcactaatttttcaaaagacgactcccctaacaatttaaagcgatctatgaaacagagacggtgtatgtgttggggaggggatacacgatctttctcaaaaagtttaagcctcgagaagaattaagaaagggctatcctgtattaacaactggaaaaggtccatttcacgtcctcaagctatttcattggatcatttaaccacataaactatttttttcctcagtttacccccacaaaattattgaaaatggttcactttaagcagacattttatactatagccttaaatgaaacaattatcaaagtagaacagtcaaaatgtactgccaccgtgttggctccccatgagggcggacgggcagcgacaaccctagcagctgcccgagcgaggtgtcggcaaagccggtgactcgctaggacggcggcagcgggcctcacagctcccgcctctccagatcgagcacgggcggatctgacgatggaggtccacggtgccgtttcggcactgggcagagagcaaggcggcagatcgcggcctagggcaacatggcgtcgttggacctcggaggctagcgaggatgtggcgctagcatcagaccctccttcaccggtcggcgaggagactggtaggtggcggggtagaggaggtagcggtgatgatggaggaggtggcgttggaggcagggacgaggcagcgggctcagttacgggaagcgccgctagatatggcttccccctcgcctaatccggtgctcccctatttcggatctggcctcttcagtgagggaggacagatcacatgtggttgtgattgcagctgaggaggcggtggctgcggcgtagagagtgcgatggcgcatggtg

SEQ ID NO: 71579 - DNA, 18909 bp, Oryza sativa
aaatggatttatttgtatttttagaaaacttctataataaaaaatattttgtaaaatatgcaccgtttaacaattcggtaacatggtcatgataaataatgaagtagccactccgataagcactttagaacttaaccataaatttattacttatgcagtaaaactaaatatgtagtgtataatatactttgtgaatctagaatagtataatatatcaatcgtatgtccccgataaattctatgtaataagttctatatacaaaccagtgtcaacaatcgtcaagttatattgtttatgatacatccatgcacaatgcacttaataattagttgacatccaataagcacgtacgtaatcaagcaccgcagatatatgatgatacttagtgggaacccattaataaaaaaaatgatagattagtagaggatgacacaaaatcacaacaaacaatagttgactacaaatagactatgagtttaagcaatagcgttcctatacttctacaaacacttgtgagatgtcatgtgatgctctaataaataggaggaaatttaagaaaaaatataaggagaaaacaaaacatctacccatcgatttgcacttaaaccgatgaatccattattttcaaccattaaattagatttattcaggtaagcccttgcttctataaactagctaatccctctctatacacgtacatatacaagagatgacaaaaataaaaaaagaagtgcgtgtatatatgcacgtacatatacgagatgtcaaaaataaaaaagaagtgtgtgtatatggtccaccacgtctggtatttttcaatttctttctttgtagcccttaggttctccttaaattatacatatatgtagcgaccactctttgcgaggttgtcgaagaagccacgttgccatggcgccacttcatgtcacccttgccaattttcttgaaaataatttttttgactaacgatataaaacgcaatcataggcggtcgtttaaacgtgtgcacacccaccctatgaatacacatacgcacaccctacctgctatgagagagaaatatttgtcaaaaaaacatgaaaaagaacgaacatacgagagactaccattcggaaaaaaaaacttacatacatacgtacaataaaaaatgtcatatggaatcatattttatcccttttaattatgtcgttctcatataaattgtgttaacaattagtacaaataattttgataatatagagtatttctttgtacattacccatgaacatgcgtaagtgaattagatgtataataaatgaaaaaaaacatcaaaactcatattatgtttgcaaaggatgatgataggtaagtttacatataaccaaaacaaagtgattttttgtttgaatatgatagacactatcatttaccttatcaaattcacagtataaatatttccttcttttatggaaaggttacgaggtaatatactgttcttataattaatatgatgatatatgactttttttcagatttttttatataaacataaaataaattgcccgcgtatctacgtgggctaccttcctagtttacttaattgtcagattgttgcaatattaactacttccataacgattgtgcataaatccctcatgttatggatatattgggcccgtatgtcataaatgtcgttttggacttgggtgagacggtgatacaaaatcagcactccacgtcatcagtagtactgaagcggtcccacgacactccatatcatcatacatattgaagcttgaaatttttttataaactattttggtcgaccatcaacttagcctggcaaaaatttttaaactccaggcatttctatgatttgccctgaacaacacagcgcatgtagcctaggacctaggtttgcttgacacctaacacttggaatctagtggacagcgttagccactgttagataatgaaaggacaacgatggccaccaaggtaagggtggatggttggccatgtctagagactacatgggtggtgcatgttggcacttagggggcaacagttgagatgaatggaaggtggtaggacttggtgatggatggaaggtattggggacttgggaggtggatcgagggaaggtgttagtgctgcaaccatgttggacatcgttgggagaattggagacagtgaggggagcaatggaaacctaattttggaaccgataaatacgtcgactatgttcaatttaggtaaatgtacgattttcctaaaagaaaacaagtaaatggacaaagtaggcatgtgtatagtgatcaccaatatatatgttcataccagtttaaaattgggccaatagtcgtacccacaggcataaaattaaaaacatgttggacctaaatatagtcgtaccttgtgaataagtgataataatctggtaccattgccatccctaattaatatgttgcagtacacttagaagagaaagcaaaagctagcaaataatataagagaggacaaggaataatcctcttatcacctcatgagcccacacccttgtgctaagatggcgatactacatgaataaggcctgtaaatagcatatagcgacagttagtggtggggtccaccgcatgctttgcacttagagattccttttgttgagtttgattcttggtggatgcatggttgagtggagctatcaaattaaaaatactaggcaaagttaattctcatgagtttattgcaccgctacagaatgacacatttgtatcacctatctggtagggtatataaacctagcactgataagagattccccgcccacccaccaagtccgtgctctccaagagcaagaacccagcactaatgacaccaccactgcgtcggtttactaaaacaaccagcattgatagcatcagtattggtttgttaaaaaaatatctctgatgtcctagtaatcagtattggttttttcttttttgaaatagctggtatagaaaaccgctgagctctggccgctgcgtaatccatccacgcaaagccgataaattctctctcaatctcttcgaatcatctcgacctccccatccacctcgcatctctcaccggccaagcgtgctccacatgatatcgtcgctctgcgctcatctctagccatccatgagtttttgcatctcttcgacgcggcggccccaacaccactccctctcccgtacctcccctcttcagcacaagcatcaatcccctctccccctcacctctcttgccagcatcagcgccactgtcaccacacatcctccttgccacctcccatcccctctaccagcatggtggttgtttgaagctctgggcctgatagatccggtcacccagagttgccacaagctcagcacgacttgatccgattggttcaatgggtttgacagcagcaactccctccctcttccatagcaccgcggcggctccctccatcttccttattacaacgggcatctgtcgggtaccgttccttctgccttaggctgctagatccaaccgtatggagattggggcctccaggattcggaagccttgaggtcccatgcctccgacttcaccaccgtcctcaacatccctagtggcctgagtttcacggtgagcagagacggtggcagtaggctcgtcctccgaccaactccgaccagcaacggcgcaacagtgtgatatgatgttattcgtttatcttcttggatttgtgattgattctgggacttgaatgattctcagacgtgaatgattcatgtttggttcagatccactaggattagtgattctgtgattttgagaatgatttcatacgattttgggatgctgtgattttgtgattcacaagctcgtagagccatctcggtttgaaccgtctcagtgctctgttatttttgaatttgttcaaaaggcgtgagtgccagttcacaaatttggcaatgagcacccctcattagtgctacaatattgtagctccaatcctaaaactgacaccgatggtaatttggatctgatactgactagatttaccaccttttaatccttttgaaaacttattgtacaaatagatccgtaaaaaaagttattctagaaataggcttttcacggcgccaacaacattagcattatggttcgacatgacgatgccaatgacgttggtatcattcccctatctctcgagtggaagctaagtcactaatgtgacaggggacggcgcaggggaccattttgtaaaaaaaaaataaaaggaccaatttgtagtagaaaaggatatatttgtaataaaaaatatctacaaataggtcctcagcaccaatgacaatggtactgaggacattattttatcacaacttgatcatttttattacaccttggagccaataatattggtgtcgtccccttcacattagtgacttagtttccaccggagggttagtgaatggcaccaatatcattggcgccgttacgttggatcacggcgtcaatggcgttggagcagcgaaaaagatcatttctaaaatatgtttttttgtcaatttgtagaataagttttctaaaaggatcaaaatgtgaaaaatctggctgatactgatggtcggatctttagtagtgttggctctgttttgtattgcaatccaatatgcttctcgaatttgaaatttaattttcaagaataatttttatttgcttgtttttaggtaatcatgaaaagctatggaaatttttatttgcttgtttttaggtaatcatgaaaagctatggaacggaggtgatgaaaaaaaaaaaccctaaaattaatccggaagtcaaattcaaaataactaagggaaagcagtcgtacatgcatctctgaacatcaaaccaagaggtgagcagaggcgttcccatataattagaaaagaaaattagctatattgaaccactttatattgaaaagatcagttgaattactgccatactcaatcccaacaatcactgtatattgtgtgctaaccattctgtgttagttaattatagcttaatatgtattgagcattcaattatcaatcctttaattccatgctgctgtttttcaagtgtaatatattagggcaagggcaataaaagagcccttgcttactctaattattatccaactcatctcgagctagctttgtagttaatgtatactctataacttctctaaatttataggactagtatatgccacatctaattttaggttgctatattgtgaaatagagggtctctttcctacagaaacatttgtcagggaaacgtgaagaaactcttggaaacaacacagcatctattcagcatctattcaaggactgcacattcacaaagggatgtttgggatatatagggtcccttccagattgaattgcaatcacgctttcatgctaaacattgccgacgttgccttacttgattggtgggaaagaagaacgagttactgccactactacaaaaaggcttttcccaggcggccaaatcatattttcgcaagcggacaagccatccgcttgcacctcaacgccttcgaaaatagttgattttcgtaggcgcgcaacaggtccgcctgcgaaaatagcttcgagcgctaaaaaaacatgggcagccaccgtcggacggcggtagcttcccgttcccaatccaaaacattcccaatccatcccgttcccatccattccccattcaatccccatccaattcgtccacttcatccccatccaatccattcaattcatccagttcatccaaaatcaccgaatcaattctagcaaagaaagcaaataaaaacattcgaaaaaatcacggccgctgcctagccgttgtccgccgcccagccgtcgtccgtcgctgctgccgcacgggcgcgggcgcggacgttgtccgttgccgccgccgcacggccacggcccgcccccctccggccagatctaggagggaggggccgggagccaccggccaccgctctccccccgccccctctggccagatctgggagggaggggccaggagccgcgctgcctcgactctcctcgccgctgccgccctacgccgcgggagggaggggcgcgcccgccgccgccaccgccgggagcacacgccgccaccgccccgcgcccggctgccgaccaccggtctcccctcttcgggcagatctggaggggagaaagggaaggaggggagccgccggcggccgccccttctgccgtggggagagtaaggggagaggagaggtgaaggggaggggaggggatgggagaggagaggagagtgaggggagaggaaaggacttagaaaaattttagcccatatgccacatatatataccacgctaattttcgcaggcgcacctcatatggtccgcctgcgaaaatgattttcgcaggcgccacttaagtggtccctattttcgtaggcggacatcaaatttaaccccgatttatatttttgtaggcggttatttagctctaagcgatatgttcgtctgcgaaaataagacccctacgttgggaaaaatgttttttctagtagtgtacgacaagagcaaaacaaaaggaatacactccattcatatgcttctccgctgggagatttggtgtgaacggaacaaagttttcacaaacaacaaactcacaatgtcgcatctagtgatgaaaattgtggataaaatcgagtggggcaaaaggccgaggcgctgttttgtgaggcaatccattagttactacaacaatcgagcttgtttggctgagggccagccgacaaggcccaacttgtgagaaaggaagcaaacgcacgccgtcatcgatgtaggctactggtgggccggctgcaggaaataagcagggccgtaatattggatagaggaaatagtaatcctatttaaaaaaaacaagactttgtctataagtcccatgtgccaacaaagaaaaagatactaatggatataattttaccatgtgcatcctcagtaaaaaaaatgttttgtaaatagacctttgatacctatctacgtaacgtttcccgcggaaagaaatatttacacgttcatttggaaaaaagaatatttacaagtacctcattgacttatatttacgagatctgatagccgagagaattaggagaaaaatataaaattgtgcatataattttataattcacacttgttaatcatgactatcttacaaataaatttcattaagcttcaggtcattcaaagtatatgatgaggatgttaggtcccgatcttccaataggtactgataaacagtcgatttgggcgaagtcgcgatacaactcaatccggcttctgaactaacacactacttaggcccgcaatcacagcactacgtctcctctggttatcaaccgtgttgaaacccgattgacctaaccaagaaggctaatccctgcatgcgaatcgaagagcacaagcaacaacaaaatgcatatgaatgattaagcacacgaatttggggttccacaaaccgatctagcggcgaaactgttattgacagaataatctaagcaaaacccgactctaaacgatgacgaccactgattaagtatgattagggacgttctagggttgccctaggatgcacacccccttgggctaagccacgacacaattataaggcccaaaacctaaatcagattcggactggatgagatacgcggcctgctttgtagattcccagcagctcggtaggaattttgacgtgggaccaaaaccatctgtaagtagacttcataagcattccaacaagtactcatgggccccgaaattccttctagatcagtggctaggtccgtttgaagttgatgctgttaggaggcccgaatccgaatccaaaatgtatagaacttgatctcttgtcttctatggaccaaaaatgacgtggtgaggtagaagtagacttgtagaaggttttgatttggtccccaatcaacttctttaatcatccatacattccttatgcccagtcttttttctttcgcccaagcaaatacctctacaaagaaaaacacaggaacttattgtgtagcaacgtttgttcaaatatataacaattaaatctaatatagaacatatgcacctttggttgattaatacataaggtagtcatagttatatccgagctagttgtgccctcatcatcctccccttcttgattggaaaccgtcatcggtttcactttgtcatggagcgtagtgaacttatctttatttatcacaacatctagtgaggaacatttcttgatggctatatggttggatcctgaaatctttatagtcgaagaaccacgtcactccccttcttgcaaaccaacatgtaactcatttaaacaattagaggaacaagatagagaattacttatacgcatgcggtcctctagacaatacatttcatcatgaaaaggaggtatagataaattcgaacaaatatatactcgatgcacattatatactcgtttactatcataattgccaataatatgaaaaatcacatcagaagggcatggcaattcaaatcatcaaatttgaatataaccccaagtatttaaagaagatagcaatttaaattcttcattctcgctagcaatgtgaataacatgtttaaactcaacacatggtggctctactatagaactaacatgtccattcactagttgtggcatggatataagtgaagcatcgcacaactcttctttatcacgagaaacatcaagcaaattgttttgtgacaaaagtatttcagcaattgattccactatgggttgctccaatgtagcataagggtgtgttcgcaggtggaggatgggaacccatccctcctgcacgcaaacggagcagccttttaacacgtgattaattaagtattagttaattttttttgaaaaaatggatcaatatgaatttttaaagcaactttcgtatataaaattttttgtaaaagatgcaccgtttagtagtttgaaaagcgtgtatgcggaaaacgagagaggtgggttgggaagagggagtgccaaactcagcctaagtagtggacatagttggcacatcataaatatgcataccttgagtagttgtagcaccattatcattaccttttttctcatcttcagaaattatagacgcttggtcaattgaacattcttcaagcatgcatggagctatagataggtgttgacgattgttaagtgccaaaataatgccgtcaatacctgcataaaaccataaatgtgaaacatccaacatagtggtagggtttatttctaacaatttccacgagtattggtgtatatttgtatgcaggtgatcaaccactaaagttgggagagaatgagcataaagaaaggaaatatattttgctctgacaaactcacatggttttgagctacaatatataaaatgtgcaatcatttggagccaaaacatggagtatcatgaagtggggcccacatgtcagcatcctaaagaaggatgtgtgccaggggagccaaccatggttcggccgaacccccagctggcccaatccagcccgacttcggtatgacggttgtgctcctcattctatgacagttacgagcgttaataccagtagaaaccatcatcaagaggacacatggcaagaggagaaggaagatgctctttggattctatggagaatattcctagcatctccactctcccaaggcaactatccacctataaatacccctctcctctccctcattcacacacaccaaagcatgagctgaattacaagaggctctagtgtactttattgtatattagaatagggagagaggaaggtagaaggaatcggaggaatctcggagttgtcggtaatctcctcctacttttgtatcttgttatttactctgctttaatagaaatatcattctgagtaattaagatttgcttagtgagaattaattcttggttagttcctaattagcatacgggatcattgttcactatagtccatttatttatagtgattgctttagtgtttgatcggcactagagtagttattaattgcgtagacgtggtgtctaggaaattaatctccagtggttgctgcgtatcccacagtacgtttgaggtgggtgtagaggtggtgacggccctcaagagcacttaagtcctccctgtccgggtacgtagtagagtgacatctgggaacagcaggttgccagtgcctgaagtattacgttaggattaaacttaagctttccctagacactgtttcttattaggaaatcctctctgccctctgcccacattagctttgttattctcagatgtcacacacgttcccttagaatcgatacccttggaatactcctaggggaagtgctacatcggtatatccgtgcgcttgtggatcttatatgtgatcgtaagaaataccaacaataggtctttttcctcttcatctttcttctcttcctcattaccttggttgttctcagatgcctgcaaaatattagtatccaaagcaataggcacaacaatacattcgttttgtaataactcagacttagttgaaggcatcgcaatattagtatcattcttggtatctctgaaaatctcatcaattctattcctcatcctttcaagactatctttgtaaatttcatcgattccattcttcatcctttcaagattatcttcgaaaatttcagcaacacttattggtaccaatttcattttttgaccattatgtctaaatgtgtatgtattagcaatatcattatgcaaagcattattatcatatatccatggttgaccaaacaacaaagaacatgcttgcattgggacaatatcaaaatttgtagtatcatggtaatttccaatcgaaaagtttactctcacaattctattttccttgaacttaccacaagagttgaaccatttgatgtaatatggatgaggatgtggttgtgtaggcaactcaagtttctcaaccaaatctaaactcacaaagttattgcaactctcagtatcgattataacacgacatgctctatcctttacctcaaactttgtttcaaatagttcgtggtacgacctttgctctgctttatccatttgagaacttagcacttgttgcaccaaagtactttcatcacgtgcatctgtggaaggtgatgtagcagctatggtttgtctcccatccaattttatctaatttccataagagatgtaacctgccattgacagtagaaaagagagaacaacagaacaatattgttcctattaactacataacatggattgtagtggaggctagcaattggaagctgttggtggttcttaaatgccgattctataccgccaacatctgcataaagtccagataataaaacatctaacatagtgataggtattaaatctcacatattccacaagtattggtgtatatttatatgtaggtgtcaaaccccgaattgggagggaaatcagactaaagtgaggagaaacatgtatccatacaaggatgggttgtgaacttcatcaaaataccagagaatcagcccaaaactccaggaaatggatagaggagaaccaagagagaagatgagccgtatgccaggccaagagggcccagcctaggttctgcataccggacagaatacaagacacccattggaatgtctccctatcagatagtctacgggaagtcatgctgactccctgtagagcttgagcacagagcatactgggccatcaggaattggaacatggactttgaaagagcaggagaatagaggaaaatgtaaattgctgaacttgaagaatggagagagaaggcgtatcacaacgctaagatatacaaagagaggatgaagcgctggcatgttaaaaggataaaaatcaagaaattcaagcgaggagacaaagtgctgatgttcaactctagggttaagctttttgaccatgggaaattgcgcagtaaatgggaaggaccgttcgatgtcattgacacctcttcgcacggggcaatcacactccacgacgattcagataacatatttaaggtaaatggtcaacgtttaaaaattttccttgagccggatgaaactttagatgaagaagtggatattattgaattaatcgattatgaatcataatgatctcatctaaagcatgcttaatttcctgtaaaattgtcatttctgtgcttagaataagttagcttgagcatgtagaaaatttggaagccacacaggcccaccagggttctaatatatgaggaagattaaaatagataggatttgaattggtggaatttagatggtcagacattcgggatagaattaaattagatcaaaggaattattcgagggatgatatgcactttgcgacaaaattaaacaagaaagaaacactggaaacaaacatggaaaataatattttttaaataaatgtctaactcgacggttatatttttagagaatcaaagcaaactaaatcggttttaaaaagttgtcaaattctagggatgttacatgacgtgcgaggcgagatgacgaagaggaagctagagtcaatgccaatttcggagatgcgcagaaatcgatgaggcgatgggtgacgcaaacccaataattaattgaaaaaaaaagatactagcagcaatcagtaccactacaggagcaccatgtgtcaacatcctctatgccctccatggccggccatgaccaagtcaatgggccataaattctgcagccatttatggtctctctcctccctctcttggtacgagggcacaagttcacaagaacgagggagacaaagaaaaagcagaaagaacagtccgatgaagagatccagaccggtggcctattgtcatccagattggtagtagaggggcgtcatttatactaaataaaataaatcgttagtcctacctaaaatcgtattgtcgttaatcactaaaataattgggggcctagatgcgcttttagttcctcccggattagcaatggcggcctcaactgtggacatcaaagagaggtggagctagcctgcaggggaggttgcgacagaaggagcctagcgccagctggcaagggcggggctgaagcacgacgaggaaggatacggtggtctcgagaagtgatgacctttgggtggcccaccagatcggtggagagaaccctcaacggtggtggccatggaggggatggccgaaggtgggcggtctaggctatgcgtgcatcgcgtgatggagtctagggtgccgacaatgggaccaatggggacagttgtcacgatggaggttgaagagaatggtggtgtgcacatgctactgactcgacgcaaagacgaatagagcaatgaagaactagcccagctgaggagatcaatttactcgaaggtgtgaacgacgatgacaaggaaaacgaaaaaactaatggccaccgcagaagatcgctagtcgtagggacagcatgggcagaagcgtgcgagcggcgactagatctcttgctttgataccatgttggacagtagagggagagggatattatgaatattggacgcattatattgagtcttagggggccggtatatataggagatacacagatagagataaggaaaaattacatataagaaaaaaaagtccacacaaatcaatcctatcctaatacatatctagccgtctaactaccatatactataacagtttggtggcggagaaggatggcatgaacgaggatttgattgctggtggtagtgacaacgctgccatgcgacctgcctcgggaaaggatagagctattctagtggcttttatagctgcggcaggcgcttgataacgatattggtatttcttaacgacattactagaaatataattcccaccaatggcgccagaaatactcctggtatattatggttacagatttcatctgcaagcgcgcggatataccattgtagcatttcacccaagagtattccaagggtatcgtatttatttaatcccgtggaaaaatcatagtagagagaactatactaataatttatatgttacttgtaataattatagtctaagcaagggttgaggtaaatcaaagggtagagtgacacacaagcaggaagctactcattctcatactaaaatatctaagctaagtggaaagaaaatagaaagagaatctattcctatacttctagtatacatagtatacatacattctagttatatgattaactagctaataccctttttccgatgccctcttagtactacgagaagttactcctgactgtcgagttccttacgacatctcgtcttaccatacaaccggggctaaatacggaggagtaccctccccagggaattaacttaggactatatacacgcgcggaggaatacccatactgagctgtcaccatcagcggaccacctctcatccgcagcatataaccccaaataataatatcccgtaatctagacaccacgcctaaactaccagatactactctaatatcatcgtcatgacatagagtaattgcataagcaaacattatacccgtacctatgtatctccaagataagctagcagtataatcagtataacatggacataatgtaaagttggcactcatatactcggaaagtattccaacaccataaatgtataaagaagagtattctattaaaagtgcaaagcttacaaaagaggaaaggaaagctactagagccatacccgaactcttctgaaggcttccggactccgatttctattctattcctaattacctagctagatactactaaactaaacttgagagaaatgagagagctattacttgaggtgtgtgagtgaagtgagaagtgaagtccttatatagaggtagttatgacgattgtggaaggggaattgtctgaagtgccctccaaccgtcattggaatgcaatcctggacgtccacatcgaaccctgcatccaacggtgctaggatgggttcggccgaaccatgggctaggtcttcccggcccatcttcggctggcggcctgctctattgctttactttgtagacttgtgaattttggcccaattcatcgtgtcaattttgagtttgtggcccattgatacataagtctggttctcgacatcgtccgattgatttatcgtttgagttgatgtcgattatcctccactttattgtcattctctgcaaaaggttagtatacctaatactagtggaatattattattctaacagatatatgcattgcaagcattactagttctcctctattttggtaatactgacggtcgaaactgattgataacgaccgtcaacaaaaccccccaaccttgaaactttgctcgtcccgagtgaaggacgaaaggaaacaaagacttgttgttgatcaggagttgctactatgctgcatatctcaaagatataggtgcaaggtatatgtactctctctcagattaaataatctttggcacggtggcttacccttacccctgattcccacgagacactgcttctccttgtcttaggcagttgaaagatagaatagtaattagagcaccaatcacccaatctttattcaactcttattccagaagttttcaaatgattttgcaaaagaaagccaagttcctcaaatgatttactcagtctctccaagtgtatcaaaatgaatttctcaccagttgttgccttgttgattcctactctaaggttttgatatgtggagctcggtaaggatcaaacatggcatacttgcattcacatttattactgagtcaaaaacttagactaaagcagataactaaacatactcaagatcaagatcatgcaatgtgtgtgatatatggtggaaatgatatatgaagaataaagaaaattcttctcctttgtgcttactttcttctcccaaaaatccttcttttattgattaggagagggcatgattacattttttttcaacatcatgctcatgcttgatggagcataacttttatttttcataaccatgcctttccctcctctttttttttctttttttttcaaaaggatatttttttctctaggagaagaaagcacatgaaagcatggagaatttattttggtggtaaaatgggaatgtaatggaatatttcttagctcctagtgtaggagtttagcatgtgtataaatgtggatgtatgatcttgatcatagagcatgaaaagtatccacacaagtcacaagagtttgacaaagttcaatggaatgacaagcaaccaaaatatatatggtttaatcatgatggcacatttttggctttggtaggaatttataacaaatgaggaactttcaattttatcattttgaaaaaaaaaacaaaacatccggaattcaagtcaaactagtatcaggatcatagcaactcatatttactatctcatatctcgtaataacttagacttagatcagcaagtgcagctcatttacgtcaggttcccggataattgttggccacttatatttgacctttgagagagcacttaccaagaacccatatatcagagatataaaacagagcaactattcatcatttcaacaatgagaactagcttgtcttacctagcatgactcacacctatcctatctttttggtattttctattttgcaaatttttatgttgttttcaaggtttacaagatgcaattggaaagcaaatatgcaagtgaaaagggaaagtgtgatacaagttacctcggttgggggagagatatctccccccaagcttggctttcgctcagggtccttgataaggattgaacccctgaaagcgagagtacgcgtgaaggtcatcgtgctgttgctgcatcatgttgttgatgttggcgaactgagcatcagcagatcgttaccattcttgcgtttgtgctattagttccatgaggttttactggatctcctctgtctgcatatcaagggtgtccattctcctagtgatttcacccaagtcccaatgagaggaacttgagtgccattcacttggagatgaaggcacaccacttgagctggaggcttggttgtccccccattggatgtcatgaggcgcaagccaccggtcctcactggcacttgcccaggttgagactccgatgttgtgacgtggagcttgggtccatccggatgcatccccaattgctgcccaacctgcctcatacatctgtacgggtgttgaggatgatgaactttctcgttcattccttgtcatgttgtgcgtctccctgtatgctccacctacacgagattcttctatggtctgcaggggaatggttagttcatggcagttgtacaaatgataccccgcatttggcaacgggatttcatttgtacaaccggggaaaaagtaaatcaaagatccatctactccatgtttcagaatatgcccttgcactagataattctcgtcaatacacggacagcggctgagataaaagcaatttggtcactaccgacccctagcccttttgctatccgagtaatcagagaagtgcactcaacaggagcagagaactttatactttctaaccattaccttatcatacatttcacaggagcaattttcatctttctaaccatggcaaacatgataatcaattcatctcccctaatgggcctttgatcacctctaggaaacaaagtcatagcaatccatttgtgcatgagcctaagtgtaggattatggatttcattcattcttggtttcttgcaaattggagcaccagaaatgtcttccgaaaacctatttttctcgaacccagaaattcctttctggagatcgattttacaggtatcgtgaaaaccaagaagtgtacttaagcctttccatctaagtgtgtactccttatggaaaaagcgaaaggaaattccatcttctatttctttcaaagtgcacagaaattgcaaagtaagcagacgaaaaccaggctcatctaccacaacaaatctctgccaaccaacagctttccaaatagtacgaaattcaacatccatacctatcatttttagcagcttcggtgagtattctcgcgtgtgagcatactcccggtcgctcggcatgtagtaggcctgtctctcccaatcaatgacaaggtcgaggtcggtgtcgttcaggagtcgtcgtggagcttcggcgtcttccatcgagacatcggctgatgaacgagtgctagactcgtcataatgacttgatgaaaagccggaccccttgaacagacgagacagtcgcctcctgattctgcacaatggagcaagaacggactaactcggcggggttaggaatgacaaaaatttcacccgccggttagtttcaccaaagcaacttgtatatatgtaactaaatatttgaatttgagggaaactatcaaagcttgaatgaacttgagagcaaactttggaggggaaatgaaaatgtgatgaaatggggtggaattccctctctcggccgactagcttttataggttactcacaacgatcagaaatgacatgtgggacccactagccgttaccctgccaaaagtggcaaggaaccgttgcctggccagttcggccgaacccacagtgggcccaaccagcaccactttcggccattgggttccaacggtcagtgtggtcgtggaacagcgaagtttcgttgaaaacttcattttggtttgctctgaaaaattcatttgaagaaatttcctcaaaattaaaaatcctgaatgcaattttgaaattcaaacatgtgatgatgcaaaaattcaaattgttgaaagcaaatatacggatacataccaatgtacctgttggtgaaggtcgcgtcatttaaagtctgacgtgcaagactgtacctccttctagt

SEQ ID NO: 71580 - DNA, 14258 bp, Oryza sativa
  unsure (1)..(14258): unsure at all n locations
caaaagttggcttcaaactaaatagacactaaacactattgaaattgtcaaatattggtaagcctaatttaggcctcaaaccaaaccaaccttatattttttctgattttaagtgccacgtcaacgccatgtaagcatcatgttagtcgaaaacgccatctaaactgttttaggactggttttgtaagttgaagggcacttcatatatgatattgtagttcagacacgtatttctgactcctaaaaattgagtaacctaaagtgaacttattccgttggctgttgcggtcggcctagaattggctgacgtactgatccagttggaccatatctgcaaataaagaattttttatttataattttttttattaaaagttttacaaaaataattttctattttgaaaattgacggaaggagtcgcctaccgcccttaaaaatcgccctctcagagggcggcgaaaatgacgtggcagacggccgtcgctcggcccccttgccgccctccgctagggcgattttgtactgtgggggggccgcctgcaaatgggcggcgagggggcatggaattttgcaggcgacccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttaagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgatcgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagtgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggatgactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgtaggagaagatgcgtgcggtcatgcgcgtcttctcctgtcgcagcgccgtggacgtcgtacctccagctggtccggtacaactacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggcgcagggtaggagggacaggggtaagaggcctcgtcagtagtgttctacctcttcagtccttatgtgactgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattgataatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgccccctcgccgcccatttgctcccgcacagtacaaaatcgccctcgcggagggcggcaagggggccgcctgcaaaattccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgagtacttccgtcaattttcaaaatggaaaattatttttgtaaaacttttaataaaaaaaataaaaaataaaaaaaattctgcaaataaacgtgtgtgggcattaaaccgaagaaaattttcaaaaataaaaatgtttaatttgttcgaacttggtagatctcataagaaaacttagtaacagaggagctctagctgatgaccgattgctcaaaaaattttagaatacaatataataagtaagcacaatacatatattacaatttgcaaagtccgtagcccctatacatatactagacgccttctcttgcattcctcgtcgaagccgctggcatgatcggcttgctgagcggcacacgcaagcagaggcctcttcggcgccgccaccgccgcgtccatctgttccatggcgtcgtcggcgaggacctgctcggccagctgcgccacggcgccggctccggcgttggcggccgccacggttctcttgacgcggagcatctcccggaacgtgcactcgtcgccgtgacgcacctcgaagtcgttccaccgcctccagaagtcggggtgagccgtcgggtcggtgaagccggaggcgtagacgtacagcgcccgtgcacggtgggcttcgccgaggccaatctcgaggtcggcgaactggaggcagagcaccctggcgtccgcgtccgggaggccgccgccgtggaggatggcctggtggtatatctccctcgccttgagtacgccgaacagcgcggtggcccgtgcgacgtacgcctcgtagacggcgagcttgtcgccgccggggacggcggccgcggcctcctcgtacaccttcaggacacgcttggcgaggccgaagtcctcctcgaacctcgcgtactgcatgtacacggccgccttcttctccgccggcgcatgccggacggcgtcgtcgaacaggtccctcacccgctgcggcttgctcgcgccgtgcctctcgacgaactttgtcaggtacgccgcccatattgcctcgtcgtgcgggtacttgaacgtcctgacgccgcgctcgtagacacggaacgcgtcctcgaatcgcttgtgctcttggaggagggaagcatggcggagcaccagcagcggcgtgatgatccctagctcgtgcatcctatcgtacacggcgcaggtggattccggcgacccgtgcgtctccatcaggtcggcgtagaagcaccacagcttgagagaccgatgcagctttgtttggacgacggtctcgccgacgccggcggcgacctgcctcctgacctcgagcgacggctctgacgtcgcctgccgaatgagctcgatggccctgttggcattgtgctgtctcagctccatctccgcccactcgcaccaaacggcggcgaggtggtccgccgccttgaagctcgcctgcgtggctctccgcaacacctcccgcgcgctgtcgaggaggccgcggtcctcgtacatcttggcgaacgcgagccagagcgtgtgcggcggcggcttccccgtcgccttcgccgggtcgacggtcttgacggcctcgacgtaggtggctactttcctcgcggggtcctcgtcgaacagcttggccctcgcgtgccacgcctgcacgtcgtgcgggttctgcctgagctgcacgcggttgagcagctccggccggcgttccagaagccgctcgagcctcgcgagcgccatgtcgccgtcgtcgcggtcggccagccagcagccttgaccgagagtgttctcctctgcgtcgccgtgctccccgagctccacgtcaatcatggcgttctcgaagtgcaggtacgcctcgaacaccaaccggaagtccttgacggtggtcgccgtggcgacgccctcctcgaacacgtcccttgccttgccgtggagacccacccgcgcgtagtggccggccaaacacgtccacagcgcgccggcctcgtcggggaacctgcgtacgctgccgcggagtatggcgtcgaccggtagcccggcgacctcctccgggtgctgcgcgagcaggtggcacagatcgagcaggagctggcgcttggtcctgcccttggccgagacgaagcagtcatcgttgacggccgcggcgaggtgatcagcggcttctcgccatcggccagcggagacaaggaaggcgatgaagtgctcggcgtgggcggggtcgaattggaggtggcggcggaggacgcggatggcggtgggaacggggcagccggggagggaggcgaggcggaggaggagcggccacatgcggtggtgctgcgtgacgggcagcgagcggagcgcgcggtcgagggctcggcgagcgcgggtgaggaggcgctggtcgaggagagccgagaagtacatgtgccacacgcgcggcatccgcgacatgcccgcggcgagcgagcgctcgaaggcggagttgagggcggcgtgggcgcggtgggcgacgggcatggcgcgcgcggcgtcggcgagctccgtgaggtacgcgtgccacagcttgtaggagcccgggagagcccgcagagcgcgctcgtagatgaccgagcgcttcgccagcggcgccgagcggatggccgacaggtagcgcgtccagcaccgtagccggaacggttcgcgcaggacgtcctcctcgtatggaacgtcctccggcgagatcatcatcgccgccaccatctctctaactcttttgactgatgaagggccggtctatcttctcttctcgtctcgtctgatcgttgcgttgcgctggatttggatgggcgattgtcgacgaggcggcacgaaccccagatttatagagaaggatgaccggtacgagcccgagtcggtttccacttccagcattccgcgtgaacgccagaagcccagaagtcggtgcccccctcggggttgcgaacaggagtcgtactccgactcgctggcccatgttccccgttgccccgctcgtcaagtcgtcattgggcagtacaaatatcaaggcaaaagccctgctaatcagctaatgtaaaatcttattttaatcttatcttatcttaatctatacctacacctatacctatacctacttttttaattaaaaaataagctaatttttcatccgtcattaaaacatgggcccacgcgatatttcaccactaagagcaagtttaatagtatagctaactactagctctaattcatttatagccaatctaacagctcatttatacaatagttatatactacactattaatatctggtcccacttgtcatacacacactgcgtcttggagtccgtactacagctagctacaaatctgtagctcgctgcccttctctcttctcatttatctacttaaaatatatttgcagctggcttatagcctgctattgtacttgctctaatccgcgagtccagacacgtgacagcgatctctaagggagtgtttggcaaatgggaaagggaaatgatttcccacccatctttaaatcttaaccattcattctcccttttccatttaatcctaacccttcattcatttcccaatcccaatctcaccccctattttccattatccaaacacatcctaacgctctgcaaataaaaagaggaagctggcaagtagctcggccaaagcagaagcagaccggcccaacaaaaaaacaaacatagcccagcagccagcccacggagcagaggagtagcaacccagcacagtactgcgcgacatgtagcaaccgagcattgtagcacgaataataccacctcacttatctagcttgggcagcactagattaaataggaggtttgccagaggctactaacactgataaagtttggaaccatgctgtcgagcgagcgattgctcggacaacgggcctagatcagtgcatcaaagcaagatgtttttgttgttttccctagatcagctagatcagtgcatcaaagcaatatcagatccctagatcagtgcatcaaagcaagatcggatctgcttgcacggcgtgtacggcgtagaaagataacaaagtagatcagtgcatcaaagcaagatcggatctgcttgcacgcctatgtttttgttgtcttcccaaggtcagtgcacggcgtagaaataaagagatcaaaatatcaaagcaagattggatctgcgggaccctactcctgtgttttgttgtcttccctaaatcaggttttgttgtcttcccttgtgttttgttgtcttccctaaatcaggttttgttgtcttccctagatcagtgcacagcgtagaaagagatcaaagcaagattctgtgtttcgttgtcttccctagaacagtgcatggcgtagaaagagatcaaagcaagatcggatctgcgggaccctactcctatgttttgttgtcttcccaagatcagtgcatggcgtagatcagtgcacgacgtagaaagagaagatcagtgcacggcgtagaaagggatcaaagcaagatcctgtgttttgttgtcttccctagatcagtgcacggcgtagaaagagatcaaagcaagatcggatctgcaagaccctactcctgtgttttgttgtcttccctagatcagtacacgacgtagaaagagaagatcattgcacggcgtagaaagagatcaaagcaagatccagtgttttgttgtcttccctagatcagtgcacggcttagaaatgtgttagtgttttgttgtcttccctacatcagtgcacggcgtagaaatgtgttttgttgtcttccctagatcagtgtactcctgtgttttgttgtattccctagatcagtgcacggcgggaccctactcctgtgttttgttgtcttccctagattagtgcatgacgtagaaagagatcaaagcaagatcggatctgcgggacccgagaaacagactagggagacacaggaattatgcaggttcagccaaaggtgtaataccctacttgtgtgtttcgtgttggtgtagttgtcttctctagatcagttgaatacaatacaggttcagccagaggtgtaataccctactccatccggctgctttatttaacatgactgggtgtcgtcgcgcgccatcatcggctttgtctatcacccgccagcatgccacgcggagggcgggtccaccatgattcatgggtattcagttgaatacccaaaatttttgacaaaaaaaaattcatatatgtaatatatatttcatatgtatatgaaaaaaaatatgtaaaatagacttgtttcttcagagaagcccgacttagcaccatcccatcccacctccgtcctctcctcggctggtcggcccattggcccaatagcccatatcagcaaaagggaataatgaaaccctaacctctccttcccattcgatcttctccctggcggcctcccgaccctgattcccgactcccgacggcgcacgggcacagcgacagcggactagcggaggcgcgtcggggtcgcagcatcgcctcccaaccccgatggcggcggcgcccagctggctgccaagctgctgcagctccacggctacccagtggccacgcccgcgcccccgggctgccgcctgccgcgaagggcgccatccgcccatcccntatggcgcccacgcgccgccgcccttgtgggctgtggcgcccaagtgcccacgcagccgcgctccgtgctccggcctcctctgtcctctccaccactccaccgcgccaaacgcccagacggctggacccagatgaaggtaaaactggttaggaacattttggtaattaggttcgaataggatttaggagtttcggatttatagttcctagttgaatccaggatggttcattttatttaggatttgaatccagccatacagggatggttcatggtttatggatgaacaattgaactttgaaacttgtgattcactgatttgtgaggctttgtagcagagttagtgcacatatttagcagagttagcatggttaatacttaaattagaagaccgtagtgttgttttgtaggtttgaaacatgaagaggaaagtgaaggataaagacatcgtcacttattttcaaaatatcaagaaacgaaaagtctctctaaattgtaagatttcttatcatttttccattttctatgctttataaatttgacatgttttgtcaattaatactttagtactgtactttaaaatatgcttaacatatttaatttatggtcaattctatgaatctatgactttacaactcgttcgctcactacgaagaaacatttcatctagttgacttgaaccccattcaactcaactcgatttcaggttttgaataaatccctgatggacggaagggagcgggagtcagctcccttcctatgaaagacacgcatcatgcttataccattatatattatacaactattagactttgtgttggaaaaaaatatctcttccaatttcgaatacccaagttgaaaatcctgggcccgccccacgcctgacatcgcgaagtggcgaagatgtgtgtgcagactcaccgaaggagattcgtccctacgttttgccgtttggtgattctctgaggtgacaactgacaacaagtgagtggccctcctgtcacatcggatgtatagacactaatttaaagtattaaatataaactagtaaaaaactaatttcataaatgagagctaatccgcgagacgaattttttaagcctaattaatccataattagcaaatgtttactgtagcatcacataggctaatcatggattaattaggctacgaattagctcaaggttatggaatgtgttttgtaattatctatgtttaatactctaaattagcgtcaaacatccgatgtcacagggccgtatcgaacggaataatgtaccgaggagctaagcaatttcagaaaacaaaaacatgtgcatgacaaaaaggaaataataaattttaagtggcctagcaaaagtgcctgcgcgatgcaacaagaacagatttatgattgcaatcaaactccacatactccaataaattcaggtttctgtaattcttttaggtgatgaaaattcaggtttctgtaattcttttaggtgatgggcagcggcttcagtaattaatcaaactctagacaaaaaagtaaacaaaattcaagcataatcctcacagttaaaaccaaaccgagatcgaagctgtggttgtttatagggacaatttgaaccaagccacacaaattttgcaaaatttgtgatatgccaccctaaccccttgtttataatttataatatattgcagtactggtctattcattccactagagcgaatcaaaagatataaacagtgctgtaactgaatgcaagtttatgtaaggcagacaacttagggttataagaaaaatagcactaaatttcataaaaccccacctaatatgattcaaatctctactattataaaaatcaaagatatttttgccggtattttggtacgtcatccgtgtatgagtcggtttttaaattcgtttgcttttggaaatacatatccgtatttgagtcggtttttaagatcgttcacttttggcaaatacagaagaaatcatataagaaatctgttttaaaaaactcgcatactaacttgagacgatcgaactcctaactacagctcatgattttctaaaaatatatatccaagcgaacttccacagtgaattttatctttactaaaccatataacaataataaaattaaaatagacttcacccgttgcaacgcacgggcattttttttctagttacataaaaccataggaattttgacatgtgacacataactcagggaattatggtcctaaagtttcataaaaccatatcattaactattttgacatatttctatatcaaaattttataaaatagatgtaacattaatacgatggataatttgtcataaatttgagatgtgattgtacaactcaaatatgtattagatcaaatttaaaatgattaatattgtggtttgtgaaactttagtatcataatacctaggttatgtgtcacaagccaaaatttctatgattttatgtaatttggaccatagtatatgtggttttctaaaatttacgattatatatatgatcccagagggaagagggaagatgaaacaacagaaataaagaatgaagagtaaatttcacaaaactacatgttttgtggtccaagttgcagaaaatcacacgcactttgacacttggcacttgagtacatatatt

SEQ ID NO: 71581 - DNA, 1168 bp, Oryza sativa
aaacgaacacagccttggtgttgtaggacgagccgagtatgatgttgcttggcttgatgtcgccgtggacgacgcactgctcccactcttgctgaaggtagcggagtgcagagcccaggccaatgatgatcttgtacttgttgatgaaagattagcgtagtgaaaatgagagaattgtttgtagctatgtccgccaacttctggtgagtgtggatagatttgaattctacatgctaaatttaatgttgttatttatatttaggaaactacacagctgaacctaaccaactgaagatttagctagtccttaattttagttccattattgtctcaaatctacctgaaaatataaacagttgattaggagtcctaaaaaaaaaaaactacttctcaactgtggaataaactcaaatgagtactccctttactataactacgtgagaagtagctaaccttcatagcctagtgtttagaagaaaactacttctaaacaaaagttaactgtgttctcaactgtgtactctctccgtcaactgttaactgagtactcatttacctttatattttttcataggctatgtcaactgttgtgaggaccctcaggagtcctcaactgtgttatagttttcttctcagtcgtagaagtagtttttttggttgtcctggcctaaccttcatagcctagtgtttagaagaaaattacttctaggactgtaaacggcctttcctacaccaaaagctagctattgaggtgaggggctcccccacttatatcttaggtcctttatccttcacattgatgtcccttagcccttcaccatctcccccttcgcacattggtatctctcagcccttcaccatctcccccttcatacattagtgtcctatacgggccccaccggcccacagtccatcagttatacgggccccgcatgcacccacggtccattaggtcttcacacactgtgtccatcgggccagagatgttaacctagctaggctctgataccaattgtacgatcgtaaatggcctttcccaccccaaaacacggtcttcacacacttcacacattggtgtcctatacgggccccaccggcccacggtccatcaggtatacgggccccgcatgcacccacggtccattaggtcttcacacactgtgtccat

SEQ ID NO: 71582 - DNA, 13230 bp, Oryza sativa
tcctgcagccctagccattgagatgagggactcccccacttatatcttaggtcctttaccctttcacaaacaatgtgggactattcaaccctactaacttcaccatcaaagttcaatggtttgctagtattttgttgatcaattttcaagttgatgagtgtgcatcatttttattgtgcagtctattaggctatcctgaattggcctggttgttgtcagtgggtctttccagaaacacaccttattaaccaccaaattgatcaagtaagaaactcaaaagatatatcttctattagtctcaaattttagaaatatattacgatttctataaattttgttcgttagaatcgttgtatgatttctataataaaaaatacatatcattacactgcaagtgtgacatccctgagttaacatgagactgcaagtgtgatatccatgagttaccattcgactgcaagtctgatatccatgagtgcaactgttatctctgttctccaggtagaaggtctatctttaaaaggcaaacatattcagcaaaaaatgagttcgatatcgtacctttcggcccatgttaaaaacctctcatttttgtatatatgcttgtcaagactaccttcagatacgagctcataaacaatcaggagacccgtgcaactgccacacccaggttcactatatcggtttagtggttttgatcgggggtcaccgaaatcccgaaatttcggaaatttcggaaattttggtccgaaatttccgaaattttgaacaaaatttagttgaatttgaacaaatattacccaaattcatgaaaaaattaaaaaaattcaaaaaattcggctgaattaatatcgtttcggaggggaccaaaatgaatttcggaaatttcggtccgaaatttccaaccctagtcacaccaaccaattaattggacaaggtttcgatgcctcaaccgacttatgatcttgatctcagcctcaaactccttcctcccctgagcagatgagtctggtgagaactttttgatggccacaagcctttcctgatcatcaattttcaggcatccgtggtaaacatgaccaaaaccccctcttcctagcttcttctcctcagcaaagttacccgtcgcagcagcaagttccctgtaattataccttctggggccaacacctttcgcaaattcaatttcgtcaagttcaacctgacaatttccatcagagattccatttgatctcttccatgctaatcgacgtcttagaagaaaacccatgaaaggacataccagcacaaaggatactgcaaacgcaactgaaattgctattgtgccatgtaattaatttaccttgtgatctgggggagctcactttttctgggggcactgctgctcctggtgacattattggttcagagctgacagtttctgggggcacaggtgctgctcctggtggcattactgaaaaatccatccatgttagggtggagttgaatgaccatgacagcacccggtgtacctcaatggagcttccggtagaagcagagaaaccaacagcgaccacctcaggcaagcatcttctcatgtcaacgctggctgtcgaaacaagatttcggcaatactaaaaggggtggctatcaagctaggaaagtggatgggtttagagacaaagaattttatacaggttcaggccttcttattcaagaagtaataccctactcctgtccggggatgattccgccgagtgtattattgattgtatgatctgaggaaaaaatcgcgccctgagaggcatccggacccctccttatataggggaaggggtccgctttacaaaatacagtccatatcccaacggaacatgggattacagataaaatacaatcgtaaccgactaggatcccgagtatttccttgacatacaagtttagaatctaacccgagtcctcgtgaagatattctatctctattcggtaccctgtacccagctggaatataactgccatgtagatatggggtatccataatctccacagtagccctcgagacctttgcagtcgacgaaatagccatcaccccctggtactagacccagtggttcgcaatgtcaagctccggagaactctcatcgatggtggcaatgcactcaacatccttttcactaagaccctggacgatatgtagattcctcgcacggaattaaagccgagtaatgcacccttccacagtgttatcccaggattatcagctacaccacttggccagatcactcttccggttactttcggcactcgggagaattttcgcacagaaaacgtttgtttcgaagttgctgatttcgagacagcgtaccatgctatactcggacgaccggctctagccaaattcatggccgtcccacactacacctacatgatgatgaagatgcctggtcctcgaggagtcatatcactacggagcgacatcaagcaagccgtcacatgtgacaaagaaagttgcgagatggcccaaacccgcgagatcactctcgctcgcgaagagatccgactggctgcgaccacggcaagcgaaggagaaatgcctgtgaccaagctgtcaaagaccgaagaaggcgacgacaaaactaagaagattccactagatccctctgatcctaccaaaactgctgtaataggcgttgagttagattgtaaataggaaagcgcgctcatcacctttcttcagaataataaagatatttttgcgtggaaaccatccgatatgcctggtattcccagagaagtgattgagcactctttacatgtcaaggaagacgccaaacccatcaaacaacgactccgccgttttgcacaagataggaaggatgcgatcaaagaagaattaaccaagctgttagcagcaggcttcatcaaagaagtcctccatcccgactggctggctaacccagtcctggttcggaagaagaccgggcaatgacgtatgtgtgtcgattacaccgacctcaacaagtcttgccctaaagatcttttcgggttacctcgcattgaccaggtggttgactcaacggccggctgcgagctactcagtttcttggactgctattcgggatatcatcagatccgactaaaagaatccgactacttgaagacctcgtttattacgccctttggggcctactgctacatcaccatgccctttggattaaagaacgcaggagcaacctatcaacacatgattcaaagatgtttttcaactcagatcggccgcaatgttgaagcttatgttgatgatgtagtcgtcaagaccaagcagaaggatgacctgattgcggatttagaagaaacttttacaagcattcgtgctttcaggatgaaactaaaccctgaaaagtgcatcttcggagtaccatcagggaagctgctcggatttatggtatctcaaagaggcatacaggccaacctggagaaaatcaacgccatcctcaacatgaaaccgccgagctcccagaaaaatgtccaaaagctgactggttgcatggcggcgctcagccggttcgtttcgcgactcggcgaacgggggatgccctttttcaagttgctgaagaaaactgacaatttccagtggggacccgaagcacaaaaagcctttgaagacttcaaaaaacttctcactactccaccagttttggcctcgccacgtccgcaagagccgctactattatatgtgtcggggacctcccaggttgtgagcacggtcctggttgtcgagcgtgaagaggaaggccatattcaaaaagttcaacgaccaatttatttcgttagcgaggttttggccgactccaagacaagatatcctcaggttcaaaagttattatatggtgtcttaattaccgtcaggaaattatctcactattttcaaagtcactcggtcacggtggtcacatcgtttccactcggggatatacttcataaccgcgaagcaaacggacggattgcgaagtgggccttagaattgatgtctttggacatatctttcaagccatgaacttcaatcaagtcataagctttagctgatttcctcgccgagtggaccgagtgccaagaagacatgccagaggaaaagatggaatattggactatgcattttgatgggtcaaagaggcttacgggcgctggagctggggttgtcttaatttccccgactggagaaagattgagctacgtattgtggatacatttttctgcgtcccataacgtggcggaatacgaggcgctgctccatggattaaggattgccatctctttaggcattcgccgactaatcgtccgtggagattctcagttggttgttaatcaagtcatgaaagaatggtcctgtctagatgataatatgaccgcttatcgacaagaggtatgcaagttggaagataaattcgatggacttgagctcacccatgtccttcgacacagtaatgagctaggagacagattggccaatttcggttcaaaacgggaagcagccctaatccagtcggctcagtatttacaagggttgcaccgttatcataatcggaatgttcgatcgcgagcctttctagtcggcgacctggttttgaggagaattcaaactacacaggatcggcataagttatctcccttgtgggaaggaccgttcataatcgctgaagtcactcggccaggttcttaccgactcaagcgtgaagatggtactcttgtcaacaattcttggaatattgaacaccttcgtcgattttatgcttaggcatttcgtttgtatctttcctctttgactgctaacttcaagtttttccttgaagtttttagtcggggggttactataataataatggaacattatttttatcaattcaatttgcttacttgatttatcattgccctgcttgatttttttggcttagacaatgaggactgaaagttttttaataacttttgcgagttttaggctcaataaggtttgacaaaagcttttaagaaatcagaggctaagtttgaaatatctagcacatcataaattcatcagtattgtacaaattgatcttccatcatcatcagaatcactgctactaatcagtgtcagttttttcatcgtcggaattatcagacccagtcggccgaaggtcgacatcttggaatctctcaactacgtcagcagcaatcttgtcagcggctttttgcgcatcattgatgaggttgagggttgtttcttcgcttgtcccgtctgcaaatccatcaacggcgacaatatcgattttggggtataaagatttggtcatagctaatgtcatgcttgctcccatacttctagcctccctgatattcttgaagtaagtatccggagcgactctcagcttgtcgaagatctcggaagcgtcaagtgtactcggaccggcgttattgaagaacatggcttggatgagtggggtagcggcattagcgactttatccctggccccttcaagcctattgatcttgttgactaagacatcaaactgtgcctgggacttgattttgcgatctgcacgaatagattcgtatcaacaagtggctataagaacatggggaatcagttatcattaccttcaacatcttttaaggccaagtccctctgctttgctagttcggccttgtccttctccagagcctcgacctgcttctctaggtcagaaatcctggcggcttgcactgtaatgcttttcggttaatcgatatgacaaggaaggcttcacgaatacgtcagacagatatggcatttacctttggatgaaccacttagttcataattagattcttgaagctcggagattctattcctcagatcatgctcagttttcctcgcgagctctctaacctcatgtagctggcttctagtagcttcaagagttccaagatgaggaactaatttctcaagagttgcggtcttcgcctcattcctaagatggattctctgcaatacgaatttactggcgttttagcaaaacatgaaaggggataattaaagctatgcattaatggacttacatttacaatgcgagtagcctcgctgagtgcctttttcagcaagcatacttcctcatcttctttttgtttgtttattacgattccttgaggttgcctatcattgtcccaccacttgactaggatgggagggcgcgagtcttcagctgcttgtatacggggaatttcttcttcatcactaatcattagtcctaatgtatccattgacaaaggttagacaattgatcagagtcatttggatcaacacggtttcaggcaaggtgtttacctgtgatgatttccggacggggacgagtcgactcttgcgccttaacgggggaccctggcatcgggtcgttgctggcatcttgtctacgagggctgtctgcccgagctccaacttctggaatctcttggcttggcctagtgtccgactggttttcagtcgggggctcctgattaatttcggctccagcttcggccgactcgtttccaatcggggattgatcaccagatcctacattatcggttgctggctagttgtcactcggctgatcctcagcagttggctcggtttcttttaagttcgttcccatgttggtcgggtcagagtcttttccagaaggatctatatcagatggtttcctgcaagtttggttatcagtattatttccgcactgggtgcgcatcaatgcaagggagaccgttatatgatttgtacctggaagacttcctgatctttggcacaggacgactagatgtttttttccttggagtagcctgcttcggcagtttcttggttgcctctcggtctccaggctttctagcagtatcactttcgtcgtcacttgacaccaacttccttttgcgtgaatttggctggccggctggattggaggtatttggccgggcttcagaacggatcttgggacccccgctcccttgaccggtttggtggtggggtgatcggcgttgaacgactgggggatccaacttcatcaaagcaaattcctgggcgtaatatccttcattgttgattgattcaacaaaaagacaagactatattttgtgaaaggttgaaatgtttgattacataccggtggaggaggattgaaagcattgaatggcacgactggcagcaagtgcgaatagctgacgacgatagcattcgagaagatcttgtacatcctttccttcataaccttaaagtcaagaggtcagccggtcagccggtcagccgtccccctccccctctctcccctggctcgtgggcttggcccattggccagccttcctcctcggcctaacaaaacaaaggaagtttacttttactcccttccgagtccggtgctcacacaccgaagagctaaaagtccgcaattgctccctccaattgctcctcactctctctcttaccttcttattggccccactcgtcaatgagtcaaagataatcttgagattgtctttccaatattccacaaatatttctctcttctataaattcagtaaatcattttatcttatttcatgggttaataaatctttttcccttgatcccataaatcaattctctattccaaaatttcatgaatcattttccttataaatcatttcctttggtcccgcacgtcagacggtcaataatattcttgagaatattatttctataaatatcatgaatcaatctccccttgttccacaaatatcttcctatgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcacatagttgcggttaccggattttcgtcgatcgtggatatcttgaagattcgtgaagcttcgtgaagaccatgagcaaggcaagccacctttgaacatattgtgcctatatttgaacttaattatattgcttgcaaaatattatgcattgataggattacacttaatttgtttgccccgtctgaaaggcagaccggtgggcctacccaacttgttgcatctgatccttccattgttaattgttatatcatgttcccttgtaaccatctagttgcgcctcgatattcgtgcactctgtgcgagtatcgacggtcgccttcaaacttaaaatctgagtaacttcttgggtaaaacttagtttacaaaagctttggaaaacccgacgcctgggtcggtgccttgtgaaagaaaatgagttttaaaaaaataaaactcgcgacacaaggccattcctgggcggaatacttgtgcggtcgcatctaaggaccgattcctttggaattacatctgagcatacaatagtgcgaccacacgggtggaatgggacacccctggctgagtaaattgctaatcgggggagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcccttaggtcaccagacgtggccgttctacacgggctgggtgattcgggttagtaatgtcgtgtgggtaaagtgtaccccctctgcagaagttaacaaactgttcgaacagccgtgcccacggtcatgggcggatgtgaggtgattccttagcgtagtttttgttttaccctgttttatgaaaaggtgttaaggtttgggaaacctaatgcatgggaagcatttagctgtccgggggatagcgggaccgggtgtccctggaagtgattggtcgtttggggaccactattatcgggaagtttggaaaattggtttggtttgggaaaaaccagatttgaagccaactctaggagttgtgcaaatcttgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctagcttgctgagtacgtaagtactcacctttgctctctatataaataaagttcagtcagctccgaagatgaagttgaagtgaagtaaagattagggtttcgtcctagttccctgcagctgcctgtggtgttgggtgttaggccgttggttccgctgctgctgctgttggtgttcgcctcgtccgtgtcgtcggttgcattctcgggctgtctgagctgcaacctaagttaaggtaaataagtcctctatttattttaagtattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgctagattaggggcgcgacacctgtacccagctagaatataactgccatgtagatatggggtatccataatctccacactggcattgatatggtaggaggttccgttgatctagagggtgactgccagtatctctgcactgctgtcgtagctgatctcggcagtcatggtgttgccgcttgttaagttcttgtccggtgagatcgccgcgacggagacgatggaattaacatcgatcccgacatggttgccatccttctcccattccttgttcatgtaggtgtcaaactcgaccgccacgatcctagcggtgcccgttgcgttcctgttgttgctgctgccattgaagaggccgaggtttccgccatagctgcgatgagggatgcctgacgggtaatgcccgaggaagaaggccataccgtcagcgctgacgtccaggttgaccggcttgatttggaaggagaaggtggtcctgaagctggccacctcaccagtggtgttgttccagagctgcaccggccgcgcataccacgcgcggccgatgctgcggaggtttcggtcgctgatgtcggtctttgtcagctcgatcgtgcgggcgtaggggtaggcatcgccagcacaggcgatatctgaacctggggtacagtaggaaccaggctcggagaagtcaaatctgaagttgagtgaggtagcatggtgaacatggatgagcaacagcgagttgcagaggtgaagctgtgtgaatagaaggcgatgagagctcattgctgccattgctgatgcttgggagaactgctatagccataattttgcaagacagcggggtagctgtctggctggccggccggctcaccagtcaccaggtttatttgaagccttccaaataatggctgactatatattagcatttcacaattggcccaaacccattcattaacagttggctatgcaatatgtcttatcgcataatccaacgcttgcgacaatgttgcattgtggagacataaccggcttcaagtgacatccaattaatgtagaatgacctcttttttttttctataacatgcaaagtacaatctacttgctaaggaccctgcttaggaaattaatttctgacagagctatgcagctgtggaggaaaccagttaggccaaagaagacaagcaaatggagccaaaaggtagtacttgtggagatgggagagatgcaaagaattcatcctttgagtcatcttgttgttgtattgcttgttataatgatgaaatctgaatgaatcaaagaattcctgggagagcttgccctccaacaacatattccctccattttaaaatgtatgatgtcgttaacttttcgcataacatttgactatttatattatttaaagacattatatagatatcatttattgtgttgtgacttattttattatcaaataaaatataatcttaacctataattttacatatttataatttaataagataaatggtcaaacgttatgaaaaagtcaacggcgttatacattttaaaattggggtagtaaaacaaaaatgatctccagttgttatgttcagtgatattccaacatgtctctctgtataacttttcaggtttagcataaacatccaacagaaatcagcacaagacgaatcatgtaatgacgagacatatctaacagaggaagaggagagataccgagctcacaatcaccaagggtggcgcctgtctccctgcgccgcccgaacaagcgtaccagagctgcagaacactccgcacgaacgtgctgtagcaaaagcccgagctgcacggcgcgggagtgcacatgccgggggaaggctaggtccgatgcgtataggcgaggcgctgtcccggtcaggcaattcgtcgaacacatcctgtgcgcgatgtggggcgagccgctacaggtgtggatccaccggcggccggcggggagcccgggtcttcttgtcagcgactcttcagctagcgttaggcccatcaaagtacggcccgcctcaagtctaattgacgggaaaaagtacatgaaaggtctctcatcttgtaatcggattataaaattatcccccaaccatgaaaccagatttatttcatctctcattttccaaaaccgagtcactttaaattcttgggcggtttcgacaccggctttatcctatatgacagctaagtcagcgtggaacccatgtgagctccacacgtcagcctcttcttctcctcccctctccacccctcttcctttctctcctcccctctccacgggcggcaaccggcggagaggagttgggctggcaggccagtgcgctaggcacagttggtgggtggcgggggacgagcgacggcatcaccgagcttgactggcgtcgcaaagagatgggttaagccgcgttagtcgtgggaggagcacgacggctgccatggagactcacgctcgccctgtccacatcctctccgatccgctgcctccacatcggcggtcgggtcatcatgctccctagcttccatatccttcgctctgtcgcctccgcgtgaagggatgccgccgccgacgccgctcttcccctcacttccctctctctctgccttgagctcgacgcggagcgccgtttccatccacgccaccacccaggtgccacgagcccgacgaggagcgtcgcatccatccacactattgtcgtcgttgccacatctacactacaccataacctagtattcatggcacttaactgccggcaataaaatgaagttagtagcgaattatttgccgggaatatatcaagtgccggcaataatcttggacatcatctcatcagccgggaattaaaaaaataggacaacaaattaagtgccggcaatggacaaatataacatgtcaattgatctgccatagataatttaagagatcactttatctgccgggaatttagttactgggaaatcaaattcacagtgaactgtttgaggaaatattggcgggccaaaaatattggcaggccgagcaaggctccaaggcatggaaattttcgtgggcccaacatccgcggagcacatggttccactcccatcgtgccgcacccgattcctcatccgcgtcatctccacctgcacgccgccgcacgctggttcctcctccgcccaacgccttcccatcgctgcagttgattccatcatcttccccacctcctccgccgcctcctctagtgcttcacccttatgtgccaccgccgccgcaccacgcgctccacccctctgcgacgttgactcctccgcactcagccgttgcactccactccatccgcgctgcctccaaaaccctcgactccaccaccaccttgactccacgcaccgccatcgactcctcactcctccacccccgatgcctctcctgctcgttggcctcctccccacctcctcccaatcgttgccgcctcctcttctttcgcctatccttcttcagcacaacccactgcattgagatcaaggaagcaccgaggaaatccccttgttcaggtgaaattcttcgggttataccaaatctgtggtttgatttttttttcctcatggatggatatgtgaattttttttatcaatgacttgattatatccccaaaactgattagaacacgtcgtgtatcgatggggttggggg

SEQ ID NO: 71583 - DNA, 857 bp, Oryza sativa
gagtaggtttttcgagagatggccaagacttgaaggtattcttccagtgacccaggttagggttggctagtctaaaggggatccggttggtttcaccgatgatgaaatcagtgtggtcgagattgtcgattaggccaagaaaatagtggtttttgtgtgaaaggctaggaatcgcgactaggttggaaaggtgcaacaaatctaaaggaattgggaagcagaaaacatgaggagaaaaggagaaatcaatttcatgcgaggaaaagggatctagctggtgaggacttacctcagcgtactcggccgatggcgcagtagaagggctggtggaagacgacatcgccgcgggcggagatctggtcgggaacgaaatcgcctggagatcgccttgtgcgtcggggagatcgccggagagagagagggcaaagttggtttcagtggtgaaaacggaggaggacggtgtgagatttctcgagggtaacggttagtatttaaagcacggcagtaatggtcggaaaacggcaaggtgcgaaacttgctcggagtcgatttacagcaaatccgaaacattatcaaatattccgtacttggggggcatgtgttaacaaccaaatttggtaatatcggcatcgggaaagaagattggatcgaagcaaagtcggaggcggagatcgagttcggaagcggatcaggaatcggctggagtccagatcggctacgagtaggatcggttgggtctgagtcgggctaggtaagccgatgcaaccgattccgacaatgcaactgtatgatatcgggttgaattgaggcgcttcaaggtgattgccgcacatgatagagtcatgagaaggcaattg

SEQ ID NO: 71584 - DNA, 4032 bp, Oryza sativa
caaaagaacgtaacactttactccatgctaaaaaattacctcagtcctagaataaatacagttttatgagtagaaggataaattaacaacgagggaaaatcatctagctgttccctatcaattggggggtggttgaaagtgtgaagatagttgggtgtaaattagagaacatttaaattagttgttattaatgggacaagtaacaagtagcactataagttttacttattttgggacaaaattaaaatcgagaattgcactttttaggacggatatagaataagacgtaaaatcgatcttgaatatcgtaatttaaccatttatttcttttataaattattatccacaacaacaaactttacatcatatgaaacttaccagttgattttgctaccgaaccgctatgggaagcacggctgctccggtatccaccattaagataaaccctgatctctaccagtactagtattatagtactagtcttattattagtagaacaatctaaatcatcgatttatactacaagtaaaaaaaatctaccacaactaattgaagctatagtataaatagaaattattcattagataaaataagacaaatgcttacataaattgtgctacctctatagaccatcatgaaaattaccatgttaatatgcatgtaaccacatttttaggaaaaagggaaaggttatatgtataagtggaattcatgttaacttcagttgcatttgttccattgaagcgagagcctatagattaggaaaacccaacaaattaaccctcgtagcatagattttaacaaaaagaaaaagatttaagatgcggagaacaaataaaataaaatcataattaaaaatattagtaaaataaaagcctcaatttcataaatcataatacaactcggagattaccgtcggtcttatgcgacaaccgctatcgattatatagttttggttgtgatagtgttctcctattaaatatggaagatcaacaaatactatgagaaataaagtaacgaggacggaagtaatggtaacaactatgcacaactaaagtgaagtgcatgggcatccaaccatagagaaataaaccaaaacccagctgagctagatggtgtaaggagtatttaagaagagagcatatggagcaaccccgccgtcccttgggcacatagagctgcgcgccgcccttgttggcgaactaccggacgtagaagacccagctgagctagatggggtaaggagtatttaagaagagagcatatagagtaaaccctccgtcccttgggcacgtagagctgcgcgccgcccttgttggtgaactaccggacgtagaagacggcgttctgaaatggcagggtgttgagcgtgttgccatcgccgaacttggtgacgggcgcaacccggtgcccatcgccacccatcgctgccgccatggaccaactcaacaacggtcagcaacgccaatgctacagccaactgaacaacgccattgccatgaacacaacaacaattagcatccattggggaacaaatcaaaacagtccttccagatcaaaacctccaaaattcgggaccaataaaactaagacgcgacaatcttaaagagaaactaaactatcaagaagcacggaatagatatgccattttctccaagagaaaagatcccgatcacatgaagaatcaacaggccaagccagttactatcgattatatagttttcggtgtgatagtattctcctattaaataacaaagcagaacccagctgctagatggtgtaaggagtattaaagaagagagcatatggagcacaacacacatgtctacatctagcgtaagatttgtttcgctccactatctcacaacagttctatctccactatctcacaacagtcctaccttaatttcaaagtgctaattaaccatacaaatcctgttttttttcatccatctatacccttcaatttatatagtactccgcaatgaatgacatgaaattcttcatccaattcttccgagccacccgcgtttaatttggtaggtggtcatgcattcttgcatacatggagtcacctagcaagtagttacccggtcaagggccaaggctatcacttattagttcctactttgtctttattccgctgttcttcatgtgtttgtttcatcgaggaagcatacatgcatacatcacgtgtgagttggatgaggaacccctgacctacaatgatgattgtgtggctctaacgtgagaggctctcctagctagccttagcccgactcatagccagggttcaccaagggcctgtttagtttccaaataaaatttttcatgccatcacattaaatgtttggacacatgcatgcagtattaaatgtagaaaaaaaaccaattacacagttagccaggaaattgcgagacaattcttttaaccctaattgcgctatgatttgacaatgtggtgctacagtaaacatttgctaatgatggattaattaggcttaataaattcatctcgtagtttcttggcagaatctgtaatttgttttgttatttgaatatatttaatacttcaaatatgtgtccgtatatccgatgtgatatgcaggggcacaattttttgccaactaaacaagccctaaatcgttttggatgtggttaccatcacctcacagtgagacggttatcacgataacagcgtggttactatgaaaaccgtgcggttaccacaaggtttatagtgattaaaaactaagaaaattgctggacgtgataatagtgataatcacacgattttgtaaaccctattcatagcaagatcagttaaaaagtactccctccatcccaaaatataagcattttggctatgaatctggacaactgtatgtctaaatttatagccaaaagttgttatattttaggacgaaggtagtagaacgcaattatcctcaaagatattagaacagactgaatttaaaactaaaatttattgtctctaaattttaaaggccctgtatggtcagatactctctactgatgttaatacacggcgctggaaggccagggcaccaagccaagcttgagttgcagcccatgtatggtaagccatttctttaatatcttgtcctttacttctattttatttttatgtaaggaaaaagtgcgaattaccccctcgaactatcgcggtcctccaaattaccccataaacccgaaaacctgtcatcgtccaccttgaactttcaataccggacaaattacccacctcgacctaatccagagcggttttatccaacgtggcacacgcgtggcaatctagtcagcattttatttaataaaaaagggtgggacccacctgtcatgctcttcttccgctcttccttctctgtcttctctctctcgcgcagtgcgcacggcgaggacgggcggtgggcgtgggctgtcggcggcgctcgccggcgccaacgagctggtactggtagcgccgtgcccgtggagtacctcgatgacgtggagcttcacggacacggcagcgtgcacgccatgatcatgatgcccatgtactcctgccccgtgcccgtggagtacctcgacgacgtgaagaactatagctgcgtgagcccggcaccgaagttgacgccggcgccggtcatgccggagatgatgccgagcgagcggcgggagacgaaggggatgacgccgaagatggtgccgcaggctgcctgggcgcagaaggagaagaggaccatgcagacgacggaggaggggagagtggaggcgcggccgagcaagaggcagaacggccgtcggcggtatggaggatccagatgttccatgggcgatggactccaaaatcgagttccagctgcagtgggtgacgaagccaccgacggcgcggtgcgacaggatggcgagctgcggcgcccacccgcggaccacgacgccgcgccccgccactcgcgccttcagcgcggacagccattcttgcacctccggcgtggccacctccgactccttcaccacacagatgaa

SEQ ID NO: 71585 - DNA, 14912 bp, Oryza sativa
gaatctcagctgttggatttattttggagggctgagatctacgctatatcacctttaacatgcttatcctatgtcaccatctgaatccgctttttcaattcatacctcctgacttgtcagtgttttgcttgaaacacagaattgtggccgccaatccaaccaatgaagccgtggctacaacaacagagccaccaccaacggcgaaacccatctgtatcgcgtaacgagatgagagacatatgagctgcgagtgaacaaaagaaaagattttcgatttgagaaccgggtgagatgagagacgaacggagtggaaagagtgagctgctggcctccccgcccgagtgaggatacccagcgaggactccgcctgcgcacgggggatcccgcgtggcgagaaccccctccggcttcgggtgagaaggtaaccgatggcccggagcgacatggccgcgaccggagaagctccccttcttcctcctcctccgcccgcctccaatctcgcctagtcgccgagattcgattctagggttttctctctcgtgacttcccttcccgatcgacgtacgcacactacagttacggcccagtttgtaaggcccgcatatagatcccagcccaatagggctcaactataatgggcccgttccaatcgaacgagtaccacgcgtgcgtgtgggccctgtcgtcgagaaccaccgtcactacctgcacctgcacgggcccgataataataataaaaaagaaaaaggaaaaaaaaaagagaaaaatccaactaggcggagccattcgccccgcacgaactccgaggcgcacgaccaaatgcgcgccgccgccgccggccgcagcgtccgcctcctctaggagcgacggccaccaccgccgtatgagcctgtagcccggcgccgaggtccgcgagcttttgctttggggggtgggagctaagctttgctcccccctgtgcgtgcgggcgggggggagcggggatgaagggccagggtggcggcgcgggggccccggcgaagaggcggtggaggagcgtggcggccgcggccgccgcgctggcgctgctgttcctctccgtcggcgtgccgctcgccgtgctgctcggcctccaccagcgcttcccgtccagtccgtaaccacccacccctctctcccctgccaaaaccctacttttctcttcagcctctccgctcccagatctgggcttcccgtccggctcgccggctcgcgctcgatctaggggctcatcaactctctctctatgctcccctgactcgattttgtttgtatttgttttgtcttttgatatcacagtgtatttggccgacgagagcgccgtgtcggtgagtgtcaattgagattgaaactaactagtagctcatgcttaagccatttgatttgtttaatccattgctgttaagatttttgcctcatgtttctgttgcacaggtgtttggcggcagcgagggtggtggttgggagccaaatacatcgcaggtagggggtgtgctcatgattgccatttctgggatatttttgttctattacctgaaatgttccaatcacatgggggtgtggttaggtgtatttatcctaattaggtttggtcaatgatgactgatggggtactactgcgggaagagaatttaatctttagatcagtgatgcatttttttttcgcaggaaaatgacaggctgccagtcaacgacacgaacaaatttccgccatcgattgaaaaggtttgcatttgagcccatcggccgcagctgtttcttctctttgttcatgcgtgaaattttatccaagtagagtgcttgttgtgagttgctatcgtgccgattgtggtctcatgggtagtgtttgagtggaattgccttttaatacatggtccatggccccatttttttggaaatgtcagtctgcttttgccatatcatggatcttgtttcacatggccctcttttgcatttctactgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcaggccttcctatcaaacaaatcgtgatctttgatgatatatcattactgagtgtaagagctaatatgctttacagttatttttaacatgcccttgtctgttcgtgcagtaaatatatatgctgctttcgcatgaatttctgagcagggcatgtgatatgcaccttgcttttgcaatattttaaagaaacatttcaataatcctttgtaacttgtttgcggacttgcagaattatcatatattacatactttttatttttcacctaatgttgcagaatactgatgctgatcctaaggacaattttgaacaaggtttacctggtgatgagagtataaaatcgtgccaactagaatttggaagctattgtgtttggtctgttgaacacaaggaagtgatgaaagattctgtagtgaagagacttaaagaccagctctttgttgcaagagcttactatccaagcatagcaaaacttgaggggatggaaaaactttcacatgaaatgaagcaaagtatccaagagcatgagcacatgctcagcgaagccatatgtgatgctgatcttcctgcattgtaagtaatcttccagaaatactttctttagttctcatttttaagctatcatctttaatccataaggcactgctaacttcagaaattgatattttaccatacatgaaactgttgggtatttaagcagcctgactttgcaccaaaaatggtctacctactaactgttgtgcttcactgtttgttttttattttcacagattttgatatccactgtcgtctaatatgcacgtatacaagataacttatgcataattgacagcctacagttgattgagcattacctgaatgattccttaggattatctctttcatcacctagcatgttcgtagtccttattattttgtgaaatgtattaacactctgtagtttgatcgaataacattgtattaagctaaaagtgtgatattgggatgaataatttaccaataattgtagcagtaagttctaaatgatgagtggactgatgatctgatggctcaatgtgttatacagattcactttggaacagaaaatttccccataggtttagagtttgctataatgattatttgttttgttatagtgattatttgttatttttgaagccatggagccaatatggcaaagatggagaagacaatagctgcagcaaaatcatgtctgatagaatgcactaattttgagaaaaaactgaggcaattgcttgatatgactgaggatgaagctcattttcatgcaagacaaggtgcatatctttaccggcttggagttcagacattacctaagagcctccactgcctttcaatgagattgacagtagactactttaaatcctttgctgacatggagtactccaatgtgcaaaagcttgaaaatccagttctccggcactatgttattttctctaccaaccttcttgcatcttccatgactgtcaactcgactgtgataaattctgaggtatgatattacttttgttgtgtagaccatgtggtctcttgaaatttctgcatcatgacactcaccagttcttttcagtgtttcaggaatcagcaaatgtggtttttcatcttgttactgatgcacagaacttttatgcatttaagaattggttcattagaaattcttacaaggaagccactatcggtgttctgaattttgaagatttccaagcaacacatttggataataggagagttgaacacttatcaccatatgaggagttccgcatcgcttcccatagcaatgcccgaattccaaatacccaaatgagaactgaatatatttcagtgtttggacactctcttttcttgcttcctgagctgtttagcaatcttaaacgggtgattgttttggaagatgatactatagtccagagagacttgtcacacatatggaatcttgatttgaaaggaaaagtgattggtgctgtacagtcttgtcgagttagattaaggcatctcagaccatacttggttgacttcccatatgatgctagttcatgtatctggatgtctggagtgagtgttattgatctcaataaatggagggagcatgatgtgactgcagttcgtaatcgagtactccaaaaggttagtattgaatagtgatgcttagcagctgtcttttcttctctctttcaagaattgtttttaagaaactactttcgatgttatatttgacataaggcatattcctcatggctatactcttgattttctgtttgtgttcaactgaacttaccctactgtaccgtgatcttcactaataagataaacttgcttgaagccttgaagtttatttaagatatgtattttttttcttgcacgtttggcctgttaagcgaagagctgcaaattcttaactgatacggttgtgcctatgtctcacttttgacagctgcaacatggccctgaagcgtcatggagagctgcggtgttacctgcaggcctgcttgcttttcaaaatctggtccatcctattgaagcacagtggatccagtctggtcttggtcatgactatggagtcaatcatggtgctataaagaaagctggcatattgcactacaacggcaacatgaaaccgtggttagaactcggcatacggcgatacaggaaatattggagaaggtacctgccaagggatgatccattcttgatagattgcaatgtgaatccatgaacaaggcaattttgttagtcctggagtccggaagtccatgttcgacgaacagcaccaccttgtgcgatagcgagagttcactgtatgcgggaaatttgatgagaggagaggggcttcagtgagcaccgcccaaactactgaggatctttcaggatgctgctgagatatgaagtaaaattgatttttttttgcaaactggtcgtctaccgtggtatgttgagtagtagttccatttgttcattgatcaatgtacagtgaggattggacagatgctgattcgtacaccagcatcacaaaatgggtgagggtgttgtagtttaggagagccttttggggcttgtagattcagtagattaggatcatggggcattaacccaaaaaaaatactgcatatattctgtgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatgtatagtttgattcgggatgatgattggcagtagagtagggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggcgtgcccttccaccccagccgcaccgtgccgtcgtggtctcccgccaccgtgtagcccagcccgcccggacacgccgcggccaccagctgcgcgcgcccgccgccgccgccgccggcgtgcgcgaacccgtgccgggcgagcacctcccgccagctcccgggcccctcccggccgctgctccgcgccggcccgccgacggcgagcacgttcgcgatctccctgccgagcacgccgtgctccgccagatgcctgctcgcgtcctcgccgtccggccgcgacgcgcccatggcgtcgaacaccgccgagtagtggtgcagcgcggagacgaacctgtccaggaagcgcccgtggccgccgccgccgccgtgtgctctctcctgctccacgagcgtcaccgcgccggctccagccaccgcaccagccgcatggaggcgccgtcgtcgccggccgcgtcgtacatggcgtggcgcagccagtgcacggccaccgcctcccccggcctccttccgggcatgtcggcgaccgcgtcggcgtctcccggtcgcttcgcgacggcgtagaactcgaaaaacatgcacagcttcctcgccagcccggcgagctggttgccggtgtcgtgcagcaccgacgccgacatgccgaagccggtgacgcggatcaccggcgggcctcccggccgcgccgccagtgccgggaggagcgagagccactgcagcgcgccgccggggacgacgtcgaggtcgacaatgtggacgaggcgcttgccgtggaacgcctcgaggatggcctggttgcacgccaggtaggcgagccgcgcgaacggcgcgacgttgtacagcgcccggaacgcggcgttgatggccccgcacgacggcggcggcgccatgggcgccacgacgccgacccacgaccccaccagccgcgccgccatggccctggcgaagtaggccacgagccgctcgccgcacgacgccgcgtacggcgaggccatctgcgacagctcgagcagcgccccgttggcgcccgcgaggttgcccaccgacatcgccgccgcgcactccatcagcagcgcgatcatccgcacgccgtgagcctcctcctcatcctccaccgccacctgttcgacgtcggcccccgccatcgccacgcccgtcctctcctccgccgcgccgccttcctcggagtacacctccttgcacgctcctaactccggccgttgctcgaacgtcccggccgccgccgccgccgccggcggctcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggatgttaactcctaagaggtttcagagtactgacatttgacgattgcgatgcgtaattttctttgcttttctcaaggaaaaccgaaaccgagctactagaacccctaagaattaatcgaagtcatcacatttcatgattgtgatgtgtaattgagaaatgagtaagaaaatagctttgaagcagtagcttcttcctaatggcgagctgatagatcacttggtgatcatcgctagttgaggacgagtcgacgaggagctaggctgcgcttgcaggcagcgaatcaatggctggcgatatcatcaaccaatttggccagttagcttgcttaattcttcagctactaattgagtaattggccggactaattggcatcaagcagcagaattccagcatcaatctgccggtgcctccacatgtcaaactcatcgtttcctatgtgctattacacactgaactcatagtagtttgctacatgtttaattgtggtctgttaatttgacctggtattgttacaaggccatgcgaacatatttatatatgtatatatcctgctaattaattcaggctgacaaggccatgcgtagatgtaccgtgctaattaattcaggatatatgcatcatcgatcgatgacaatgtaattaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatacaagaacaagaagatcagtatcacttggagtataagtgaattgttagttttttttcatcattttaatatttgggttgaattggtagttatatgcaactcaataaggtatcgttagtttaaaaaaaaaaactcaataaggtatcggagctacaagtctcaagttcaaatcttgtcggacgcacacttaaataaataattgcagcttccattccatgtctgagcactcaaaaaaattcaggcatgttttgtttttgttgttatttactatcggcttagtcttttatatgaaaattcaattctgttttttttgttgtttacttattggcagtcctttagatgaaaattcaggcgtgttttttgatgaacaaaagatgaattggttggtgcatggaaacatttacaaagagaaattataccagccatccagcaaacagtgccaccccgttgtacaggtaaagcttggagtccttccggcctgcaagatcaaggtacctgcattttcagaaagaatgcatgaataattgtgatctcagacatgaacaagcaagatgattaatgagcaatttgggaaaactgaatgagtattaccatctgaggttcacgaagggtgtggttgcttcagtgatgaggaccatgaggatgtacacgtgtcctttgccactcaacagagcaagagagattgcatacatggacaatccatgatgcaagagctgaacatatcaatacaatcagaatagattgttaacttgtgtcacctcaaattgtagtaaaagaaaaagggacaactcagaacattaacacttacatattcctttcctcctagagaagggaaatgccagaggatcatcaacaaatctgtcaagaagtagcccagggatacctgccaataattaaaatttcagacattttgggacagatatctttctctcttttctccatggtttcctggatgcgtagggctgcaaacttacaccaaacatggcatcagacatccatgattttcgatcaattatgatggcaccatggacgtccttactgaagaggtcagatatcaccagcagataaaaagagactacagcagcaactaatgcgtggaaggtagagaatcccctaaaacatggataaacgagttgtaattactagcatgaagagaagtgaatatgcatcgctactgttagttgatttttagataatactgcaattagtcgataataagaacctgtcaaagatttattgaaaaagacctgtcaaagaaaaagaaagagaaaaacaagcaagctccaattaatcacctgttgttccactcaagtttgtgcaattcattcagtccattataacccttgtagcaccgggagctaacttcacgagttatatcatatacctataagaatggagtagaagctagtcagtgcctcagtggcataatacaaaatataatgcagaatgaattcatcatgtaggctcaggaacaattgatccctcctctttttttccctatgttttcttgttaccatttaccatgcatgtacttctcaagctacctacctagccttttgacaagtaaaaaaaaaatgaaaaaggtaatctggtatatctcttcacatactaatccgtattggtgatggaggaattcacaaattataaaggtaatctggtccttaagcattattgacggcacgattccgttggctacctcctcgactgtgtggtactaaatgctgacataagtagtcttcaaaattgaaaaggagtagtgattcataattcactcatattcagtaaaaaaaagtaataattcattcatatttttaacaccatgtatcacccaagtagcaactccttccattcccgaatattttaaaaaatgttagattctcttatgatggaaaattgtgtgattatatttttcacataaggtaatttgataatataatatattttgaattgttttataaattaattaacggaaaaagattagtcaaagtttgattgtgaatagtgtttggtgacaagtttttgggaacggagggagtatcaaggctagattgcattcaacaaacgtctacgagtccaactaagctgtcactattagttgctttgctctctgcagaagttaggttcagtacttgtaatggctggtctgcatacattgcaagagtttttacagtcgaataatactattcttcctacattaaaaaaagaagaagaagaaaaggtgggacgttccaagcagaaagactgagctatggaagtcaagtgcagattgatggtgatactttgccctttttggatctcaaaagttggatgatagaaatgcataaattaatatcagtactgaggaacatttcacaaattttctttttataacgaaaaaccgaaacctgatttagtagttcgacctctaaaaaggtaaatacaagatgggattgctcatctcactagagaaaatacactttaggcagtttagctttaccgtgaagatgcaaatttgtagcaaaattttagggctattttgtaacgcacgattaaaaaaaaggagaaatagaaaaaacacacatgattgcaaaacaggttgtttgattaggcagtaggagataaaagaaatatagtcaaaggaaattttcaaaaaagttggagctctttttaatttttctaaatctctataatattgtccatttcgtaggatttttttttttaaaaaagattgatttcaaaggccttcataggaatttcttcaatttcttttgtacaatattgaaatcctctaagtatcttatgtttcctctacaaatcaaagtaggacttactgggaatgcactctcgtatctagctaagcaatggaagagatcgatggaacaacttaccgctgcgcacatgaggatcccagcaagaacagaagccggccacacgatctgctcctcgggcccaaacctcacatccatgtccaccgctgccaaatcactctgcccttcgatctcctccttcctcgatctcggcggctggccgttcggtcgagacgatgaaaagctccccaaatcaacagaagccagaggatccaatccttgcagcaagcgtttgcaagtcctcgaagagaggcgccccgggcttaaatgggcagagctcgatcgccatggatgggagtcgtgcgcggcgacggtgaccgagggagacggtggacgacgaagcgagctaaccgattgagtcgtccgcgtacaacaccctctcttcgtttttttttctccttccttcaaaaaatcttctcgcgtcagccgccgtcgcgccggaccgatcgacaacttagacctgactccactgggtcccttgactggtctataatactgttttttttttttttaccaacggctacaacgaatgtcaatgggaaaatatatatatatatatatatatacacacacacacacacatatatatatatatatatatatatatatatatatatatatatatatatatatatatatatatatatatattcgaaatctagaaaactgcctttgaatttaaatatgaacgtctaagatttattcatgtcaccaaacaataaaaattttactcgcaaattcaatcatgagtaaaaatgttgggagtaaaatttttacccttgatgatatggacaaatatcgggccttcattttttaatccaacgatagtttctaggttttcaccacatatataatttgtacttcctccatttcaagttataagtcgttttgactttggttaaagtcaaaatgtttcaagttttatcaaatttgtagaaaaaaagagtaacattttcaacccgaaacaaatttattttgaaaatataatcaattattgatttgatgaaactaatttggtattgtaaatattattatatttatctataaacttagtcaaacttaaagtagtttgactttgaccaaagttaaacgacttatctatactaatataaaaaggaggagttgtacccctccaatcctacatgccaaatcacccggatcaatccctaccgtccgtccgtcatctaatctaatctcatccatccatccggtgaaatcacccagaccgcatctaatccatccatcgtccatcgcccgcgcaatccccgccaccacatcctccccacgctaacagaggcaccgcgcgaacaacacatctgccctatgcgctcactatgctgtcacaccctaatccggcaccgccgtacaacggcacctgacaggagcgtgtcgtaggaataacggcgcgaaccacttcctacgaaaccgcgatctcagtaccagtcccaggacatagtgctggtacccacggtgacaaatatgaatcattgcaaatccttaaaataaatagaggacttatttaccttaacttaggttgcagctcaagacagcctgagaatacaaccgaagacacagacgaggaaacaccagcaacagcagcagcagcggaaccaacggtctaacacccaacaccacaggcgacagctgggaaccaggacgaaaccctaatcttcacttcacttcatctttacttcaaggcggaggaactatatatatttatatagagcaaggtgagtactttcatactcagcaagtcacggggacttaggtgtttaatg

SEQ ID NO: 71586 - DNA, 46607 bp, Oryza sativa
tgtcaatggagatatcatccaaattaacaaatgtccaatgctgtcatcgcaagctagtgcagtgttagttgggcggcacaagcaagcaaacaacgagcagtttagacattctgaagcgtttgcataatgacaagatttgatttcgttgtttgttctcaagtgatgtaagaactagaaaacttttaagattcctctaaagaaaaagagaacttttactatcgctgtgatgattcaacaagatttgacatgcgtaaagttaggtattcctttcgtctcaaaatataaaaaaaattaattgaataggatacgttctagtactacaaatctagagctatttataagatatgtctcatcaaaccaaaatatcttatattttagaacaaagggagtaattagagaaactataagagcatgtacaatagtagactataagccagctataaacatattttaagaagataaaagagaagagataagagcagcgggctacagatttgtagccagctgcagcatggactccaagatacatgtgtgtatgataggtgggatcagacattaattatgtagcacatacttaaagataactatggtatgaattgactattaaattaactatatatgatttggagcccataatcggctatactattaatactattaaacttgctctaatatacagtttaatctggcggtaatgcatgcatgcaagaaaaagtgatgagccatatgtgcgcaggtgattgatttggcgtcggttccaaacacatttaaaagcaagtttaatagtatagctaactactgactcaaaattatctgatatagtcaatttaatagctaattcatataatagttatctataaatatatactatattattaatatttggtctcacatgtcatacacatattgcgttttggagtccatgctgtagctggctataaatttatagctcgctgcttatctctcttctttcatctccttaatatgtgtttatagctagtttataatctgctattgtacctgctctaaaaacatgattgtggggttatgtgtagtataataagcatctgcgtgtgaaagttaaattaaaaaaagtatgatcaatctattggaaattgtgtcgatagccaactattatatgtatgatctcttggtcacctgtaatatgacgtaacgcttttaattgttgacagttatgtattttatacactggacccttttgatttggaggaaaaacatagaaattttaagataacttttatcctatagaaaagatttcaaagaatggctttgaatcaaaggattgaatcatatccaatcctttgaaattcctattgaatagataattctacagagatttttgtagaaaacttagcaagagctcaaaactcttagaaaatttcctttgagtttatctttctcatatgatttttttcctacggtacaatcacatggtatttcctgtattttaaattatttgttttacacttctatttctgttagaataatgggtttttcctattaattcgttttcttgttcctactatttaaattggccctaatctctttttttaaaaagaaaattgactctaatctcttactggcgtactactccgtcccagaaaaataaattatagctacgaacctgggcacatatatgttcaagttcgtaactaggattgttttttagactgagagatagttattcaagttcgtagctaggattaggattgtattttttagatagaggggtagtgctgctgctaatagcattattacgttacccagaaaggttaattattactacgtgctttgatcatgattgttttttgtggcagtaagaaaatttcttgtctttgaattcgagtttagtggatgcatgtctgcatattgcggctattgccgtactactcggctactcctgctttcagatcgatttaatgtttggctgagtataaagtttaaattttggttaaaattagagatgatgtgactgaaaagttatgtgtatatgatagattgatttaatgaaaaatgattaaagtttggatctaaactttaaatctaaacagcctgtacagtggccgtggaccaactgaacgtacggcgacaagtggcatggctcactagaaaaagaaaattcgctgtcagcttcactccggatcggacggccacgcctccagtccacgacttttttgatcgcacgtgttagcttttaaaactactctagctcgggtcgcacgtgtgaatggaagctgtttcgttcttttgacctcatcgattttgtggagcaacagtacacgcacgatggaaaacgcacgtcgtttagcgagcgtgtctattgacaacccattttaagagcgagccacggagcaaagagcgtgttcttaatactctggttgagtttatttgttcacgtttttcacttacttctctcgtttttcatgcgtatgttttttaaattgctaaataatacgtatttaaaaaaattatatacaaaagttgtttaaaaaatatattaattcatttttcataaaagttcagctaatacttaattagtgataagttaataaattacttcattttacgtgcgtgagatgttagttcctaacctcgatcaactaaagaactcaacctaattaatgtttttgatttcgccacgtaatatagctctaccttattacttttaagggattttcttattgtgatttaaaagagttgtgcacttcactgatcggtctgagctgactcaattaatctatcaattctaaggttcggtttaagaaatatactctatgaatgaacactactacagatcaagcgatcgaaatcgatcttcgcctacggttaaacggtccgtgatgcacgcaggtgtttgtaaaaatcagtattgtctcgtgcatctcatccttgttcaaacatcgacatttgaattctaaaaccttaacatgtggctatatatgccaccttataattagtgggtggatgtagtgggagaaatcacaccttaattagtggagtggatgtagtgggagaaatcgcactacatggagatgtttgcgtatatattcttcctatttaagatagagaacgtacgtatagaaactcctcgtgtggcatggcacgtcctaccctgttcttaattgttctctactgaagtgttgcgtgctcatcgtgaatttagctagacactgcacttacatgataaaatgaaatgatttgatcagtctcactcgcatttcattctcacggaggccggccatacgttacggcgagttagtggcattgtcaattcgtttgcaaatgcaatgcgtatccttgtcaattaaattgccgtcttgttgaaaaaacgctgataatgtgtggtgtatgcatgtgctaggctagtataacaatacggcgctgaaaaactgaaagttgtcccagtgagagcgaactgaacattgacggtcaaactatgacctttgtctcgaggagattaaaattacgagaaacagtgggtaagaatatggagaagccaacttttagtttatagtttattttataggttctactagggttggcaacggggcgggacggggcgggtgcgggttggataggaacggccccgcctccgcatccttgagggttcacccggccccggccccggagtgaggaacggggcgaaatcaatccccgcccccggcccctccggggccccgcaccatttccgggtccccgcacccagatacaagcggcgactgctagcagccgaaggaaggaaagaatggtctgggaaacttgcagcagccgggtggaggaagggaataatgatgtggggaacctgcagcagccggagggagaggaacggtcggagaaggaggagaacagcacaggcgccggcagctggagaggtaggagaacgacatggggcgtcggcggatggcaggatggggagacggcgtccgtgagagcaacgatacgggcagcgtggaagagcgccgaccgccgctacttgatggtgcgggaccaactcgcgaggcgtgatttgtggaggtgaggaagcgccaaagcggcgtgcggcgtgtgatgtgttgcgtgatttgtgggatagcgtcaaaagtcaaaactactggaacgagaatagagattggtggcggcggcgacaaactcacgggattgattttacggcccgtttggttggagggagtttttaagaggaattgggattagagggatgaggctattaagtattttgtttggttgggagacatgggaattttggtgggattgggatggggaattgaggaagaaactccctccttttcaatacctgggtaggggcaggtaattgggagggaatttctcctttactttgtctaagcaaatctcagccatccgtttttattaatgagctaatctccaactaaactccctatcagtttctatcacatctaccaaacaagacattgggattaaaaatcaaattcccatcttaatctcatcataaattccctcgtgtaaactcctaatccccttccctcaagttaccaaacaagtcttagggttggcttctctttactgatctgtatatatatatattgggctatatgggcctaaatttgattatgggctgtatgccatattttagatccctatattccggggccccgtgggtcacccgcgggtgagcctgtggccccgcccccacccccgcatagttccggtgccccgtccccgcagccccgcgggttgaaatttcgccccgtccccgtccccgtaggggtgggtacccggcgggtccccgcccccaacgggaaaattgccatccctaggttctacagctacagctttttagaatctgaatgaaaatctagattgtttgagggaggatttgataactagtgcttctagaaaaatcttcagctactaaaagcttccccaaacaggctctatgtccgttctttctagtacttcatagaactagtaatttacccgtgctaatgctacggtgtaataatattttgattaataaattatattattaaatttcatgttagtcaaattacatttctagaatcagtctcaaatgttaatttaagacaaagagcaaaaatatcatattgtctgaaaaaaaataatttaagaccatcaactatatctaggctaaattctttcccacgagtctttaaaaaaagtatgttttcatgaaaataccgtgttgtactgcattgaaagcttttttgttaactttagttatcaaatatttaatttagttttataactaaatttgtaaaaataattcaataaataatttgttttagacgtgggcaagatttttttttactagataggcaccggcgaaaatcccggcatgacgagtgcgcaggtgtggcggtggccggccgtcgacggcgacgcttcatattgaagactactagcaccgtggatgctcgccggccgttttgcccctcagcttgtctgctggcaaagtcgtagactaaacagatggagtagtaaactaaatcacgtctactatttatttttttcctacttaaatattaattaaaattttaagtttgatcgaatctatagaaatgaaatgagtatagctcaactagattacttgtgatggaaacagctcatctgagctcaaatcatagaattgacatatatacttgtatttacggctaattatattttcagtgataggcgacttacccatcgacagataggcactcgtggtgacttcgttaatctcaggatatgccgaccaagtcttctatcgacacccatagtgacttcgtctcatcaacctcaaaatatatcggtctagtcttctattgacgcccgtggtgacttcatcgatctagagatatgctggtccagtcttctggaggtgctcataggagtgggtgtgtgcacgttttgagcgcatgcatttattctgtgtttctcaaaaaatatagtacacgaaacaaatatattatcaaaatatattaaatgttaatgtgtttctagaaaagttatagaaaaatataaaaaaaaattttgacacaaaataaatatattataaaaatatattaaatgttagttttaataaaactaatttggcgttattgaccttgctaacttttttttaataaatttggtcaaagtgaaaacaatttgactacgaaaaaaaagttagtaccaaatatacgcacttcaactcaaatataaacagaccctagtaggaagatgctctctcagatgatgtaataaaaacgaagagctattacaaaatggggaaaaaagatggttaagcatctcgcagaagaaaatgaaaaaaaaaagcctaagcaaagcagattaggatgggccacgggcccacggaccatacgcataggattcaacctgacggcccacatgccgatggatcgggcccatataggcctgttcctaacttccccaatcttaagcccggcccactcgtgagctctcccccgtctcataagaaaccctcgcggagcacacgctgctcccccctctccctcccgcgccgccgccgccgccgccaccgccgcatcgccgctgccgacggctgcgctccgaaggtatcgcgtcgaaatgctcttcgtctcgcctctaccaccgccgcagatagttcttgcagcgtctatgcctctgctgccctttacatttccctcgagcgactagaagaattagggcgggttggtcgttgcggcggtcctaggctagattcgagaagaagaagaagaaatgccggagatccttgagcttgtaaatggggatggtttcttcttcttctctcttatagttgatcttgacacggtgtagtgcggtgtatatacatctgttgctactcctttggaggcaggattccggttttcttgagtatgtgacaccgtggtgattccgtttgatttgatttaccatggctagctgcgcttctttgatagattctggattatttgcctagatgcgtgtgaaagcaccggtactgaggcgctatggccattgtgatggccgtagcagcctattcttttgtgtgctatatgaaccagggaacccgctttgcaggggagatttgtcccatgtttcttctgccagtagtcgcccgacagttcacccctttctggggttctggattcctagtcatggatggtaatccgatgcgcgtatgaactgcaatgtttctggttctcttgagtgctttgagcatttgaggaaccttgtgtgtgtcgcacagtcgcactcaggtgctatggcctttgtgattgcatagtagcctagttgattaatgtgcaagatggaccagggtagtatccttgcagcaggagctaagctaagttgattatgcttctactgcctgtagaatccctacatttttaatagttaaaatttgagatgattaccctgtctgtgtattgtcgatatcttgatgtaggtttttaatgttccatgattacctctgcacaattttgttttctggattctagtcctgattcctttttcttttgatgttggaaatttggcagaattctgtgaggatttaagctgagaagatggtgctgaagtaagttcctgtgtatattttgttgtttcaatatgattgtagattgttttagtgcccttttatcctgtgcatgctctaggctatgtagttttttggttaatggtagtaaaaggttaatagcaatgatttaccaatgagtactatttcatatttggaaggtatttcaactattacttttatttttatcctacaggacagagctttgccgttttagtggccagaagatatatccagggaagggcattcgctttattcgtgctgattcacaggtcaggctgttcatcgaatgattgctttaatgtcaggatatttctctgcttagaaggttgttgtaaacgtattggtatattgtacaggtcttcctttttgcaaactcaaaatgcaagcgctacttccacaaccgcctgaagcctgcaaagcttacctggacagccatgtacaggaagcagcacaagaaggtattgtatctagatttaggcgggcgttttctcacctatatgcacatactctaactggatgacctttaacccttttttttttgttcactgaccgttgctttcttaaatttgttgggttgagccgaatgcttaaaatttgtaatgttgtattgtgcttgaaatgctaagttaattgtttcttaagctatcaaacctggattccagtaaatgtctgtttgtatgattaagtgtgaccgtctacattcaagattgcggttttttttactgtgcaaacatcatgttgattcttcaaataagcgccttgcagtgtttgcgtgcagataaaaatattgtatgtttgggtactttggttatgtctgtgccatgtagttctctttgtcagcttatgctcaattccttgtatatatgtacagttagtcatgctatgtattgcttccgatcagataaattctgtttacaccctttcccaattttctgttttttaggatatccatgctgaagctgtcaagaagaggcgccgcaccaccaagaagccatactctaggtcaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtttgctcctagtgaactctctgttcatattcatgcataatcccctattgcatattgtgtatgcataatcctccgatatacatttcgatgatgctaaaggattaaattcatttgagcttatgcattgtgcagtgagatcaaggaacgcatcaagaagaccaaggatgaaaagaaggcgaagaaggctgaggtaaccaagtcccagaagtcgcagtcgaagggtgccgccccgaggggttccaagggcccgaagattggtggtggtggtggaaagcgctgaagatttcttgatccccaggaaagggtcgcctggttctcgccggctgtctaaatcgtatctcatcaaaagctaccctgtagaacctctgttaaattagcactactgccaaaatgttttaacatcgccactggagataatgtcatgaagtttgaaatgctatgtgggaaaaatgtttttctttggttgtgtaactattacgagatttgacttggcttaatgtttctgagcaaagtttgatgctgcttggcattttaatcctcttgtgttttgttcggtaaagagcattggtgttcatgtatcatgatctgaatgctcgttctgaattgacggccctagaaatcccatcgtattatattctctacagaaatataggcttttgaaatcctgttagtagcgttaaaagcgaatttgacttttaaagtttcaccattttttgcgaacgggtagcaggaaagctaaagtacgttcccttcaaacaggctagactttgtagtgtccgagtggtatttatttctctttccttatttacttgaaaaaatattcatgtgttgcaacgggtaaatgctattttaattttattattgtttacggtttagttagataaaattcactgtgggaagtcgtttggatatttttttcaggaaatcatgagctacaattaggttcgtatttcatctcatgctagcatgcgagtttttttaaagatttcttatacgactcctattatacttccaaaaggaaaacaatcttaaaatctaactcaaacacgcatctgtatttccaaaaacgaacgaacttaaaacctgactcagatacggatgacgtaccaaaataccagtaaaaacatctttaagttttaatttttataatagtagatatttctctttctttatccaggatttttgctatatgtatgagacttgatttcgtatttgatgtattaagtattgggtatcccatattcagggcattaacagcatgcatcatataagttaattttagggcattaacagtatgcatcttagtataagttaattttttttctttggtcttgcttaaaaaatagtaaatactctcttcatcccataaaatcaactactgactatgtatctaggtcaagatacacaatcaaaaattggtttttatgggatggaagaagcatgttttagacttcagatggaggaagtactccctccattccaaaatatgcaggttcttgaatggatggaacacatcacaatagtacaaatctggatgtcttaagaatttaaatgtctattcaaatttacagtagtaagatgcgtcacatccattctaaaaccctttattttgggatgaaggaagtattacttaacatattactaactgtattacgatggaccatgctactctgcattagagacgttgtaaggcagaggatcaacatgattactataaattatgggagttggcagccatccgatcaagggcataaggcctatatatctcaggccgagtttagctctaaatttaattttttcttcaaacttctaacttttccatcacatcaaaactttcctacacatataaacttctaacttttctatcacatcattccaatttcaaccaaacttccaattttgacgtgaactaaacacatcattactacactaaataaaagtgtgctacaattttcatgttattgtagataccataaatcgacggtattcattacattgatccactgttatactcacatacttcctctatctcataaaaaaccaatttagtactggatgtccagatttgtagataggatgtgtcacatccaatatgttagttttttatggacggagggagtactccctccattaaaaaaaatcaatcttaactataaatatagacacacgtgttcaaattcatagttggaccataattttcatggagaaaatgaacatttggccacgttcaaaacacggtttcgctagaatgccaccccaaaaacacggttcgataaaatgccaatacgaagcgtgcatctgttgtcactttgccattttcaccattttattcatttccaaaaagattttggctcctccgctgggtaataagacggaactgccccttatcaccctacggcgttgatattcttccccatcccctttcttcccccactctctctctccccttcggcatggcggtggtggcagtgcgagcggtgtgtttcgacaaagggagtggcgcagggacgaagcagcttcgagcagagacgcggagctcgctgaagatacatgcgcggggatgagctagagcgccatgaccactgcgagcttggcgcaccctttagcgagctcgagctcgagctctactcgtgtggaggtggaggtcatgggcgatgtttttgtcagtagcgacgacatcgcacggaacctcatcattgactatggctctggcaagatcgcgctcaccgccgcgtgcatccacttccgtatccctagcgctgccctcaactcccccttccaccactgcgtcgcttcggtcctcccaacaattgctttgctgtcactaccaccgaagaagaagccacttccgccgctgtcaccgacggcggttgctaagaggagcccacaaccccctcagcctttcgtgcttcggccagtgcggcggtgtggcccctcctagccaacggagggaggcgcaagaagcagccggcggcggtgagggcgtgaggcctttttttttttttttagaaatgctcgatcccctttcacttgcgagatgaagaaaaggcaagccggaggggtattttcgtctgatcaccacgtgaacagcaaaaaaaacatttcggaaatcatgaaaaggcgaaaatggcaatgcgacgagtagcgcgcgctcgagattagtattatatcgaattacgttttgaggatgacataatagcgaaatccagttttaaagatagctaaacgtttattttctcatttttcatgggacggaaggcgtaaacaataaacctctacaataatgcccaggattcggatctcattggatgtgagaagagagagacagcgagcaaagcgaagtgaactgactgtgaagtgaccgcacttcggctgcattaactgcatcgtctcggctaggctagggctaaacacgtccagagaccaaaacgagtcgactcgtcgtcgtcgtcgacactcgagaggcacctgcactactccactcagctcacacgcaaaacgtccgcttcgtctcgtctccctcctctcaaaccgcctcgtctctcgcgccctcctcctctcctgtactactctcctatcactcgctcactcgctcgccgacgctgcccgaggcggaagcggcggcggcggcggctaagaggccgtagcccgcttcgctcggcggatcgcgcgcgcgaaccgggcggtggaggaagggggagggggagggagaggggcggagagcgccatcgccgaccaggtgagcgctttgattcccctccttttccccctctatttctgaccctccggctcgcacgtgtctccccctcccacccaccatctccggtgtggccggccggcagatggtcggcggcgacgacgacggtagtgtagtgctgcgggtacctacgcttccccgaatttaaattttgtaacctaattttggtgttgattttagggttctcaccatagtttatttccaacggttttccctgaggagaaaggagaagacttggaatatacagtacgtaaaacaagctgaacgcctgaactagtacatgattaattagatattaactattttaaatttgaaaaatatattaatataatttcttaaagcaacttttctatagtaaatatttttcaaacacgcactgtttagcagctcgggaaatgcgcgcgcgaaaaacgaaggaacccttctccctatctgccactcttacaaaagaacacagcaaaacatttcattgctaagaacagatataaaagttttacccacaaattattttgagtctattcaacacgctgcattcatttcattagctgcatatatatttgtgtactattgctacaatgatcaacagaattagcagtgctatacgttttgccccctttcgaagtccaaaatttggcgctcttctgcctcccaggaacccctcctcgcttgattgcttcgacaactttaagcagtgatcattggaatataactccactgtgaatggtgcgagatggttactagttttttgtcagtaagagatgcatgattactcctgtcctgcccctgaatcagggttgcattgtaacaacggacatataaacgcaaattgaatttcctagtaaagtgctaaaggcagggatgtgtttgccaatgaattttctttgcaaatggtctagagtttggattttaataatgcgacgagttttgtaattccaacttgaattgatctcgtttttacaaacaagactattgaaaaagttagggatatgctacttatgatttgattaatcaattaatctgggggagctatttaaataatgatgggactaatattgtccagctgctgctctcagcttcaccctactctcatgctgccttgtagatcatgagcacaatggctgacagcgtatttggagaaagggacagcagtaatctcgagattcttcaacgaagtcatatgaacagcaattagttgactaggcaaagcatctttctgagtaaatcacgtcttgttagggtacttcagttgtctttcccagatctcttgtaaaattctttccctcagtcctgcagatttgcatgctcaaggacaaggacctacacattatgtggtggttcatgcaaaaaagaaaaatcaagtttttctataatatctacacatatactcaacagtttgactgtatacattttttctattatagaataagacagcattggctgcagagggttcaaatgagaaagctgcggtagatgcaaatgaagtttcattgcctctttctaatctaagcaacactcgacaacattctgatagagaaaacaacatgcctggaaaacatggcaacgatggcatgtcaaaagacatgggacgtgctactagattgaagagactgcaaacgccaatcaacttatttgaagatgaatgcgttttctgccattcatttagaacacctcctcaggtgaaccatgatctattaaccagaggttatgttttgaggtcttcttaaccatttctgacactaaaggtcctcacttttcctatttcagtttcatggtccaatggcgcattatcaaaagggaaagcttgtgtccagtgacaatggcagtccatgcccaacagatatcatttatgttcataagaaatgcctggagtggtaagttcctaaatatatttcaactcttgatgcttattcaccacaatttagatttatcatcatgcgcttccaatgcaggtttaagatacaaggatgctggacaatttttatttttatttgttgagatctggacccttgtataattttttagtttaataccttattggtttgctttataagacaaccattccatttgtttaattatgtccaaatattagtcagtatgatatatagttttagtggcatgcaagaattaccattttgattcctatttcaaagtaaattcacatgatatttttttttagccattaaacagcctattcaatgtttgagacgtgctaagtctaaccatacctaataaaaataaccagtggctggagtggtattaaagtgggtagttgaggggtgatggtgcgttctacatccccctccctccatcccccatcataattttgttgtttgcatgatatattcttctgcaaaaagttgatttgtttgcacatgtgtatgtgtagatggttgattgatctcatgtagtaatttttcaattttctagatttggagacaattcttatttttagtatatttagctttacattataaactatatttacttcttccagtgcaacagttggcactagctagttactctcaaaggactatttcttgggtaaattgtttgtctttccctacttttttcttttgcgaagggccccgcaagtattttacgaaggtgataccattgtgaacttggagttggaaataaaacgtgccgcgaaattgaagtgcaaaagatgcaagcttcctggagcagctcttgggtgttattatacaaagtgcaataggagctatcatgttccatgtgcaatgatgactttgaattgccgctgggatgttgtaagctcttgagaatattgtgtaatcgatccttttgtttgtgatattcgtcaccactctaatagtctaatgttctaagctccgagatgctaattttcattttgcaggataacggttgtgttatgtgccctgaacatgcaacgatgccactaccatgtgataagataagctcgccaagaaatgagagtggcaattcttcttccttccctcagaggtttttccatgaataagaaattgttattcaatcttattgctttcttggaaggttatacaaaggctctggtatttgattaatcattgatccttcatttgtatttttctccttgattctgtgttccagccaatcgtcaattgaacaaagcgattccgctgattgcgaatgggaatatcctataatagatcaatggaacacatcaagttctttgtctcaagggtatatgacctttattcacctgccttttgagttactttgtaatcattttatgaattagctaatacggagtaaatacctacaacattctcttttgccttttgttgttccagacaaagttcagccaaagaaggaatttctgctgttcctaaaagggaaatagatcaacttaacacttcatgttcttcctttcctgaggggtacacaatctttcctaacctttcttgttagatgtctttaaggttcctgattctttgatcaattgtagtcttgcattccataaatttgtgttgtatttaatcattgcagccaatacttggacaaagaaggaatttccactgacgaatacaggaaagaaaagcaaacagatcacctttacacagaaagagattgcccctcggatctgtgggttttgcttggttcagctttaagtgaatccgagaaggtaggataagtgagaagtagcaaacattactctttttttgtggtgaacaagtatacggacaaacaatgctgaatcctacttcatggataattcaacatagtggatgatttgctacatttatgaagttaactcttccattccagcttttgtggtaaacatgatttatgtttttcaagcaggattccttgcaagagtttgcgtcttggacagatgcaactgtggtcaacgagtggactgaaaatgtgacccatgttatcgttggaaaaagtgctggtagtgcatggagccgatcttatgaggtcctgatggctctactgtttgggaaatgggttgtcacggttggatgtcagtattgagctatcttctctacagttctctatttcttttaggaccccaatttgagtattctttcctttacgtttatattgtttgatatacctaagtatccctaaggccattcaaggtttatcataaatctgcagagtattatctattcctaagctgaagtgcttcgccttgctcttttagggattatggattgcttggtaaagtttattccaagtccagaagcttcctttgagttaagatttagccatgactcacgtgcatcaattggtggaaacaagaaaagaagaaatcaagcttctgaaggggtacatatacatcgctggctataagattagacttattttatgtagtgaaaactatcgtaggctgtcacttgtataagcttaggaatttgatttgcaaatctttcccagtaatattttcttacaggcctagctacaactgggtacaacaatgcataaaaatactttttacatatcgctgttcaaagtcaaggtgtatatatctagtgcataactccatatattccacctgctttgtgttgcaacttacgacatttcattctttagagcaaattttctgccgcaacaatctccatgatgataatgcgatgctttcaggcacagaagttgttctcgggactgaacttttgcctcagtgcctacataaaccctgacgacagacaacacatacagagcctgattgcagctgctggagggcagatactggagacaaacggcggctcgcatttgctgcgtgaaaacctggagaaagttgctgtgaagccatgctacttcgtctacgacgggggcgctccaagggatttcacccaaggattgcttgatgatctccctaaggagatggaagagggcagagagtatgctgcctgtggagctcaggtgatcagccatttgagggtgtttgatgccattgcggcttatgatgcacagattctcagccacaaggatcacttcaccccggatgtgtaatggcgcaagctgtgactgtacatggtaaagcatatatccatggctagttgttggcaatttgtaggtgcttttggagcagtgcccttcagatcaaatctttggcactgtaggacagtaatgctgttgtatatatataaaccattcgatgtttactgacacatctggttagcctgatattcacctactaagagcaggtacaatagtggattattagccggttgtaaacattttaatgagataaaagatgagagaagagcagcgggctacagatctgtagccagctgcagcgcgaactctaagacgcaatgtgtgtatgacaggtgggaccatatattaatagtatagcaagcaactattgtataaattggctattagattggctataaatgaattggagttaggtcctctttgtttaggcttataagccagcttataagtcgaaaagtctaagtcaaaacaaacaagtagcttttttttatttggcttttttgaagccataagccactctaacactattaagccaaaagataggttggagaagcttttttggcttttatgagatagatgtatgactccaccactaaacttaggacattaaatccactgtcttataaatcatataagccaataagctgacttaaaagtctaggccaataagcctaagcctaaacaaagagggccttagtagtgggctgtactattgtaacaccctgaaaattcgaccaataaaatcaaaactctaaaaatacggattttcaaaaactttttaaacaaattgcattatgccgattttattcacctatttcattggattttgatttcggagttcgttgatcgcgaataaagaataattaattaggaataaaccctaaaattaaactggcaaaataaataattaaaatataatttaaaataaagattaagtgaggttggtaataaataaaaatattatcgcgaccatattagtatcaattaaatttaagtgcgatggaataagaattaactttaattaaattcaagtaatttatataaaaataaaatatgtgtaatgttaatctagggcgaatcttttggttagagcaacacaaatattgagtaaacttgatttgtgcaaaagttagaatttatagggcgagatttaaatagaaaatagactaaattagggttaataaggatctagccctattcattgcctacaaggtgcttgatgtaatcctagcctagccggccccgagccccgcgccgccgacgccgtcgcgtcgccatcgccgcgcgctgtcccatcgccgcctgccgccgcgcgccgtcgccatcgccgctgccgcgccgcgcgccgtcccgtcgcgccgtcgcgtcatgtaacatactgaaaatttgctattttctaaatatgcatcatgccgattcttatgttcttaataacttcctaaacctaagaaattataattagagggacctcctaaaactaacctgtataaaatccctctttggtatttaaaatctttcgtggttttattctaaaaattgatcttgttaaatcgaggtattctctttgatttgattttgtatcttaaaccttctttcgaccaaaatttcctttctttaaatttagtttaaaaatcctttttacttttatgaatcatggtccaagaaatcctccaactatacctttgaacctaaacccaagcaattccaatttcattggaattaattgtcgacccatcctttaaaattctcgatccaaattatttctttaaatctagccgccgatttaatttccgtggcttgatttccttctcagcacgagaataatattattatgaacaattgctcctgtgctaagagaatagactttatccctccacccgaaatccaaaacctcatttagcccatatctaattctttaaattccatgccatatattttgggctaaaattctatttactctactcccgtcgcctcgcgccacgcgcttgccgcctcgcgccccgcgccgctgccgcgccgcgtcgccgtcgcgtcgcctgtcgccgtcgcgtcgcctgttgccgtcgcgccgagccccgtgccaagccgcgccgagccccgcgccgcgccacccacccgtcgcgtcgctgctgccgcctgccgcgccgcgcgcccgtcgccgtagccgcctcaagccccacgcgccgcgccgtcgcgtcgccattagggccggccacctctccccgcgccctataaatcccctccccggtcgccatttcaccccgcaccaccccacctcctcttcccccattttcccctctttcctctccaccgcgccgccgtcttcgtgccgccgcaccaccgccctcggtgccgccgcaccgcgtggagtgccgcgccgtgcgtcgcccgccttgcgccgccgccgcccctccccttgttcggtcgccgccgccgccccgggtaggcagtgagccgagagagagaggaagggagaagccgggagggagagaaaaagaaagaaagaaagaaaagaaaaaaaagaattgaaaagaagaaaaaggaaaaataaatagaaaattagggagagattaaggaggtttggaaaattaaataattggggttagttgtaggtttcttttagttgtagaatcacaaaattttatataattatagaatattttggtaatctctatacaaaatcaattcgtggtagaaatttagatttatttaagagctaaataattatgttgaattattaggaatgtacttctaaatcacaaaaaaaaagacttaggatgaatgaacttaaaattggaatgaagtggttttgcaaactttgtagtcgatatagaaagatcgattcgcgttcgacttttatttaagtttatttggatttcatttgaattctaattgaattcaaatcaattcttcgcacgtacttttagacccgagggagttgcggatccgagcgaggatcaagacccgcaggactacgagcaatgcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttagaaatgctattctagaatcatgcatactcatatttatcaaatgctatattcttgggcaattatctttgggaaggtaattgagatgcggcatgtggagacatgagcgccacattgccatgatgttgatgacatgatttgtgaaaggagaaataaaattaaacaactgttttcgactggggcggacggaggatttgggtggtgtccggaaaaggctagtgccgtccccggtcaattaagaaccgagccatgaagttaagcatgaaacgaccccccgtacaactgcatttctcatatgggtatagacctagcgaatagatagctgagcggaggcgacgtgcgggtgcggtgcctcgccgtggcgaagctgagcgtcaccgttagctcgccggccgacggcacggcgaccaccgtcgccaccgcggcggcctgagcagtagcggtatcggcggccagcatcagcttcggaggaagcgggatggactcctcgtggatgacaatcccgtcgccgccgccgtcaccgtcgccggcgatggcgcggtagacggcagccacgctctggaagcagctcgcgcaggagtcgcccaggaacacctcgacggcggcctcgacgccgctcttgatgaacatgtagtccatgtccagcgagcagattgggccctcgatgcgtgacctcagcaatctgccggcgctgcaggtgatcgtcctgtcgacgaactctttgcacgcgtcgaccagcacgtcgtcggcgtcagcgtcggcgccgtcgccggcggtgttcttcagcttcaggtcgaactcgagcaacacatgctcgaacgcggagatgccgcgcagtggagatgacagctccagtgcaggagagctctgaattattccaaacaaatcaatttttttaaaaaaatcgaacgtgtttgaatttcctaaaatttgttcaaattcagccaagatagatcctgttcaaactcaaaatttaacattgtcactcaccagtgtcacttcctgggcgttgtcccgtgtccggttgaacacaaagttgggcagcccctccatgtcgtcgcgggcggcgacgatcccatagacgagcagccgccgcccatcaccgccgctgccggcgccggcggcgaggctgagcgagcagagctgcagcatgttgtcggcttcgtagtcccagcgggggtgaggggtggtgaacctggagcggggcagcgatgtcggcgccgtctcgtgcatccggtactcggagtgccacgagaggccgaagaagccgtcgcggtgggaggagccctcgaggacgaaggtcggggtgtagcgccgctcgccggccggcagctcggcgttcagcttctcggtgagctcgtagccatctgtgtaagggtatcgttttatcgtggctcctcctgcaagacaagaaatgttcatatactccatttgtcctaaaatataagtatttttggactctggtacagtctccgagatgctactttgactaacaatatctataaaagttattttaaattaaaagagttgcacattatgatagtatgtttaataataaatctagtaacatcaattttacatgattgatctttttttattattttactattaatggtcaaagttaaaaatgcttatatgttggaaacggagggagtatgtggcaagtgttttaaatttgagggaatataatcttgtttgtttaaacatcatataaatagttggtaaatctttttataaaaaaacgacaacattaataatgtatatataaaatactctatataaaatcaagttaaaacttaaatcacccatctaggaataaaagaatcaaatcaaagtgctctggatttatctttttttaattctcaatatgtaaatcgaatttgaattatatttttttggtggtgataaaagttactataatgtacattgctaacaatttttacagctagaggcctcggttgttggtcgttctccaatgccattgtgtaagggctggcatgggttcaagggctttcttgacctgcgtgagaaggttttattctacacaggatgtacagggtctattttgtctttggtgggtcaagttttttttttaaaaaaaatacaaacattcacattgaatttgaaaaaaaagaaaaagttacacgaggagatatccttcgagggtttagaatcctgtcccaatatttgacttgcatattatgaacaagaaatttatactttggtgctgcttgcaatggaggcacttacgaatctcatattgaccaatccgatattcagctaagtgtttattcaggccttgcagctgattatcttcttcctcctcttctgctgattcttcgtggtgatcatcgtcgtcgtcgtcggatcggaatagccaggccgggatgagagccttgttggacggcttcttcttcgtcgtcacattgcagcagtcgcaggtgcagcttgagcggccggggacggtcagccatggctgcctcgtccggtccagcttcatcaccggcaccatccggtcgatctccgccatgtcgaactcggcgtcgcggttgcgccgccgtcgccgacgacccatcgatcggcgcctcggtgatcgatcggaaagcaagcagaagcgaaaggcgaataatatgggattaattcggatccggccttccaaaggcgatcgatcgcttcttccgtttgcctaaaaccgagagggactccgattctttgcaattctggttgcgaattcctaagaagccacggctcatgattagttgtagacttaaacttgtaataactacagtacacttgctagttactagtagttactacaccgcaatatttgtacattagttacttcatttatatcgtacaaaaagaaacacaaacagctcaggatcaatatacaggcattcctatacaccataggagactttgtagctcggagtgaaagtaggtgattgaatggcttgagaaacggctggcaaattggaaggcaaacttttattacttagagggcgactgacactaatcaatttagtgattatcagcctatcaatatatatgatgttcttttttgaaatacataaaggagtgatcaataaaattgattattttcaatcaaggttcttttggcaagaggatggacacaaaaggaaataccgactagcaaggtgagacatcatcgtaaagatcaagggggttgggaattcaagatcttgaaattaagaacaagattctctttagtaagtagttgtataagctactcactatagatggtgtgtggcaataaatgctaaggaaaaaatatttggagtcacagccttctcattggaaaacaagagagtcacacttttgggctagtctaatgaaggctaagcctgattttcacatatttgactctttcaacatcaaagatggctctcaagtacggttttgagaagataaatagttagggaatgcctatttaatagaacaatacccatgtctttataatgttgttaggcataaacatgcaactatttcagaaattttccatactagtctgctaagcttttcttagcgcagggaccttactggctctaagttagtggcgtgtaatcaccttctctcacacatcgctaatattatatttctcacaaccaagatgagtttaaatggaatctaaccactgatgacagattttcggttaaatctctatatcttgtgttggtgcataccgatgttcccaatataaattaaagaatttggaagattaaagccccataaagattaaagattaagatcttcttatggtacttatatcagggagtagttttaataaaagataatctgattaaaaggaatgggagaggaacttgttctttttgtcgtaaagatgaaactattaatcatttattctttgattatcttgcgcggtttggtctttaatccaatctgcttcgaatattagtttacctaatagtataactcatatgtttgggcatttcataagaagacaactacacaatttgaggcatttggtcttatttggggcaactgccactatttgatctatttggctttgcaaaaatgatgtgggttttgaaatgaaaaacatatcttctctgttataggttatattttttttactacatataggctctactcatgggctattctccagaaggtcaatttgttgggtaccatcactgcggcttgccaataattggagttagtggccatggagttttctaccctagcacatgggtggagttctaggctacggttagagagttcctaaagtttttcggttgtcttggatgatgatattatcttttgtttctttcttgttggctgggtgcactctttgggtgcatacgccagagatgctctcggaataattttatattatttactgagataataaaacttccattataaaaaacaatatacaatggcgaatagtgacagctaccgagagccacacctctccgcggaaaccacatgggtggcttctcattggatcatcctaagatgttggaagacattagcaggcaaggcaaccgattgatgaatgatatgggagcggtgagagagtagccccgacagcagaactctcctgctgtgcatgtcaatcctgcaaacgtgatatagttgggggtcattttatgtcctgagcggcttaggctgttcactttagtgccattttcaaccttaccaaatttcggtaaagttgccaaaaaatggctacatttagtttgctgccaaattttgataactatataagaaatcctgccaaaattttggcatagttaataaaattttggcattgccaaaatgacattgccaaaattttgtaaggttttttttggcaacaaagtaaacaggccctaagaagtagagaacaacaccatcttcccgcagcctcacgaagggccacgtgagcaccatccggggcaaccgtgacgtcttgtagtcctcctacgcccataagctcctcatgtcgagcgtgtctcaagtctcatcagctgatttgtccagagtccatatggccaccgtcgcgttggctgcttcggtggcggcgtggcacggtgacgatggcatgtcttcttcttctttcgttgtggcagcggcaacagcgatgcgggcggtgttaacggaaacgagtttgatgaagttgtccaagatgcctaggtgtggtgcatctccatacatccaagcttctcggatttgaaggtgtggagaagtaggtactacggggcagacgcggatctgacatagggccccgctaagggatctcagccctcactactggcgttaggaatgtgggagccccacctgagctcttctacaactatttgctccacatatatagaaaatggaggtttaaattttatctaatttattcagccccacctgcttttttttttttggatccgctactgtccgggtggaggctgacgtacctgagatcgacgggtggtggtgagccgcctccgtcgccggtgaagacgatggcggtgtcgcagcacatgaagccctgcgagagatccgcccagaatgtgttgccgtcgaacgagaagatggtgtccgtgcagaagaatcctcttgtgtgtccactgttcgctccgccacaggcatccgcggcgtgcagcttgcaggagaaggtgatcaccttggtccagcggcggccggcatgacatgatggtgttcatcttgatcctcagcagagcctcgtcggccgcgccgaaggcgaggccggagaggaggtcgtcgccggcgccggcgccgaggcgcgcgtagagcgtcaggccatccacaaccaccagcgcctggccgatcgagctcgccgcagccgaaggcgtccatgcgcgagcactcgattcataccactagcacgcgagccaaacccaatacggcaacttttacctgaccaccaccatcggcatcggcgatgtgtcgtccttgtcagatcgttaccactagccagttgtctgttgcttgaatcatactttcttcgtccaaaaaaactcaacctaaaaaggatgtagaaggaaatggctagattcatgcccagattgagtttttttttggacggagagagtaagttcacaacatggcaaaattttacctgaccaaaaattatcaaagtaataataaaaaaaaaaacaggacaggagctgattcaagatccaaaatgtcggtgcctgataagtttaaacgacatatctggtacggtacaggtaaaaacaggtttaaacattcaaaacattcagtcatcacaagaccgaaacataattaaaacggggttcaactttgtttcaaaacttaaaaatgggtttaactgattgcagccaacgaattatgaaccgcggtatttcgcagctaccacaaacgccggccatcgcaggagctccgatccccagaaccagcatgcataccctgttcagaggaaattaatgtagtttaggccaccaagtaagttaatctgaacttactatagaactaaacaagttcttgcagaatcattttgtgagagttaactgtaccttaataataccaacaattgatccaagccatgaaactctaatcttcaacacggagaacctactgcaatggctgcaaatgcaaacttacatcagaaaagggaattatggcactttttttaatcataattatgacactattttgacattgtgcacaaaaaaaacgtctattgggactcccaaatctgaccttgtttattcttacactaccattttgggtggcaggattttgggtggcaggaagaaggggaggaagggcaggtatcttctcgatatcgtcataacggagaataaagttgtcctgcaaccaactttcagatatattttcttctgctatcggaaaaagctgaaaatatctgtcagaatttctttcggacgtttaccttaggaattgcatcccaaatgttggcatcaaaaagatagcagagtccttgttcataagttgtagttttgacgagaggggtcgtattaggagctcttttaacccactgacgcagctctttgtggtaaacccacccgtatttgcatctgaagaaatggaagcaacaatctgagctatctggcataccaggccatcgttttactgaaaatgacaggcaaatgagaaaacaatatagaactgtggttttgtgcttacatttcattcgcggcatataactgagctgcatcctgtggcatactgcacaaaagacagtcaaataatgcatagcctactaacacaggaattcactgttgattgaactaagtacctgtagaagatgtagaatagtgtcatgaggtgaaacctcagaaaatgcaacgcctgcagaggaagataaatcgtaatgtcagatacaacaagattaatgctaacctaaacattccctcacaaaaagaaaaaagaaggtaactcgaaaattgagggccttacttgcaggggtggaggctgcatagaagagtagcaatccggaatttcataagaatactcttctttaactggctcacttgaccaaggagagccaaatgtcttgtaaagattatctgaagagttcatatccaaccctagtgttgtcaaatcaatccctaaagcaagagatgccggtccctcctctttcaacttcattaccctcagtagtccatgtaagccatatggatcatatggatccggtgcggtatcagttctctgagaagacttgggactctgaaccttgtgagactctggtgcggtatcggttctctgagaaggcttgggactctgaaccttgtaagactctggtgtggtatcagttctctgagaagacttgggactctgaaccttgtgagactctgggccggaagatgactgcagcctaactgacttctgagcctgtggttcatgattttgctggataacttgttcacgaggcctcggatttaaaggcaaccttggagaatttactggctttggtccaacattttcaggcccagtattttgaacctaataaacacaatcagtatggtcagtccatatttgaaaagctcagcaggcacctgctaccaattattttgtaggattcttacttactattccccataaagaaaaggtacatgaacaaaaaagagtcgtgttcaccaatggtggtgttttcaatcttgactatctggtcatgaggtaaaagaaatcataatacaggtaacttaccgaattagctgtctgcttatgttgtttacggggtggacaactgctgcccgtgttaaagccagatgatttgcccatctgtagaatcacatgtaacggaaatttaaggaaaaggagataaaactgttgttggaattacaatttttatttttttagaaaaaaactcacaggataatgttgtgcttgcataatatttgcattcttaggaagatgatccttgcgatgcaactccataccttacattcagagcatgaggtaatgttcaaacaaagtaccaagacataataaaaacctatagcatgaggtacttggcaaggaactgtctgaataacatatagaattaaataatgaaacaaaaagtagagtaagagtaccttccaatcttggtaaagctgggaagtcctcattatggattctaaattcctggttttgctgaacagcattaataccaaatgcttgttgtcttagaggtccttcatttgttataaaggagaaaagttagttaactaatattatcattcagaatatttagtttgcatgtcagcattaccatataacccctgaatatttccagcagaattaggtcgcccaactaattgaggaaaatcattgatgtcaaatagagaattttcaccaaagttaccatcatgtcgcattcctggagaaccagacgaactgcttcctgcctgcaattggttcttagatagtgttcctccaggtgctgaactagagcttccaagcatattcatagccggcaatcctggtaaataaacaatttgaaacaaaactgcccttttatatataagaaatgagaacgttcacattcttactaaacacagtaagttctgcacacgttttagttgcttcgtttgattgataaatgtaatagaataagcacattaacaagatggatgagatgtcagtacagaataaataacagctagcagaactatggcaaattgcctcaacagaatggtgtacttctttaataatggacccaattaacacttccattccccagatcaggtaccggtcaaatatgtgcttccttattcttttttgctccagatgactagtgtacttcataggcttaatactcagtccttttttttatatggcgttggctagttcaaaattgaaccaaccaatgtcatataaaaaaatagggagtatgtgatttttaatattatttattttagatcatttcattatcaaatcagaaagaaagacaaattgagaacatatgcgcgtgcatttatacaaggggtttatatgtttagtatataccttgttgatgagtaccacccatttggtttgatcctcggatattaagagccccacttccagacaaattcacaggggatgcaacagtaggcatagacattccggcagagcttatggttctcccaatgttgcccccacccgcaacgctagccacataagttattcgcgggccaaaattcccacaaactggagcagctgccaatccaagagcagaattgtggttaccatctttagtcaagtacgaggaggaagcttgtattgaaccatcaattgcactcatgttaccagtaaaaacaggacttcccccaacatgcatacctcctcggttgctgagagcaggatacccgacctacaaaaaggatgaaagaaaatgtgagctggattagaagagcttcataaacagactcgagcttaggagaggaaaaaagaacctgataaatggatgcttgaagactatttggaggaaaccaagcaccagaaatactacccctaggtggttgaaccccaagggatgaactaccagtcattgaggaaccccttggtgctagtgaacctgacatgtttctaagattgagattcccatatacaacccttccaagtttttcgtgagagttagttttagaaaaacatcactttctaacatgcacaaacggactagcaaaataaacaactgtaatgtcactaaccaggatgacgaaaacctgaaactgatccagattgaccagaaaaggtcggtgtcaacggctttcctgttgagactggaaggtttgatctggcaccactactgcttgactgaaaaagtaacaagacataagttaacctataattgtgacattttaatatgcatttgtgccaaaacaaaataataggatcaaattttaattataatatagacttaaataataaatcatagctagtattcaaagctgcttttcactactctaaagagcactaataacaacaagaaaaaagtgtccttcaacagcatgattcataacactttgttttgatttcagacatagtttaaggtccttgtgaaatagaggaactaaacaaagagaaggtaagttacaagaatacagtatccagaaggatacacaaaccaccaataaagtataaacaggctcgtgagtctgctaatctggactgcaatgatttattgaaataagatataaacacgtaaaaaaattatgatagtaaggatgagggccttctgaaaacaactaaacaaggatgagagcacacattcagcgatcctgacattttgatgatgatcaaagaacaaacaggccaagagcaagtcaacaatattctaccaattccataacaccatttatcagatctagagttcaagataagacaataccctgtataggcaatcctccaaaatgcaggctatttttcaaggaacaaaagggaaaggattgatgtattattgaacagacgatgtgcaatggatgcaatgcaggatccaaaacctgtttaaaacataatcataagaagatgtaaccactctacttgggatctcatgccgcagaggcttgttttgcttcgcctgtttacctatctcatccaactgccatgtaagcttggcctgtaatatttcctccaaggtatatatataaatctctctagggttcttccaaatcccctcaaccaaattacccacaaccgccgctgccgcggacagtgtctccatgctcaactattccaagattccattgtttgccgcctgctcaagccaccctagcgcacgacacccagccggtccctcaacgcactgcctgctagctctgcccttggttccttcctcccaggcgtcggcaggtagcagctatccatggcatcagcggacggtgcagcatgcgctgactatggaggcaaccagacaaccaagcaaggtgtgaccaaccaccaggactccatccgcgcatcctttaatcctcccgatgatgattgtctctctcatattctctcgattccccttttgccttttcagattaggaccatcatgttgtcagatctagaaatctaaaatggagtattggttttcgttcatgtttaccagtaactaggcctctagttgcatgtgcttgccagtaattgttcagcttgtacatcaagcgattagcatcctcatgctaacatgtgggatttttttttgttctatttcaatgttctctttccaatccgctgaacttttgaaaccatatcgttaagctatctggcggacacataggcatgcctgcgagcacacagcgtccacaagctacagttatgggctgagttcttcacccctcatagagtaacgggcacgcctgtggacaacaaactcgcgggcgtgggcatgggtagccaatacccgtgcccgtcacacccaattgccatccctaaccctaaccctagatctatgcgttttaccgctagattagtattcaattgcttttccacggggaatcctaaatacttgtcaacgtagaccactcccgaataaatggaaaattgaggtcttacctagtatagtacatacttgccgactatctctacctaccaaacctcatgcgtaccaaccaaatcacaacaacaattaccaaaatcagtcgttgaggagttggcggaaagggaggattacctgtgtcgactttgatggagatttgcggccgcccatccttgagcgtttactttggtgagaaggttgagaggtgaaaagaccaagaattgcggctaggcataggggttcaaccccttttatggaacaaaaccgcatctatcccttgttgccataggcacataagttcaatcccatatttaccccctaatctctttgacatgtgggcccataacccacatgccattgtgagattaaggggcaaataagaggatatgcaaacttttaggggtgaataaggaatttatcgaaaggggctaagcatacaaaattgagtaaattccttatttgcccttgaaagttgatttcgtccctttttgcccttgcaaaattgccctccaatccattgaccacctttctcaacttcccttctttatttgcctattgatacatcaaaatacatttttgctctagtgaatgcccttctttctcatctttattgttccttttgccaccatggcaacacttaatcctcattttcattatcagttcaccggtgatatcttgtatcccgtcatgtcaaaaaaaatatcttgtatcccacctcttggttggttgtaccctcatcaattggcacctcctcctcacctcctcaatcctgacctaccactccactattggcaacatcttcctccattctcacgcagtcacacagtcacagtttttctgattttctcattaggaaaaatattcttcagcatattcgcagaatgaatgagactcttaaagatatagtcttagctggttacgaactttgtaaggattgtggttttagtaatccttgttgcctcttaatctctactacttagaggtggagtcgtccgtctgccctccccctcatgacgcacagcacgagtcactacctccccaagaaaaccataaaaaacaaatggtaaaaaataccagttgtatcccatgctttaggttagacccacaccccaccatcgtatggtcagttgcaatgaacggacatattactagttaaaagcgactattggctgtcacctggcagtattctcctaaaaaatgcactatctacatgtgtttttaggtatttggttgatttagatggttgtgtatacaacttataaaactgtggatagttatatgttggttttttaactatagatctttagtatatttgtttgacatatgttggaacatgtgatcacattgctcgttatattgcaaataggcactatgtcatgcatggcaaactaatgaactgttgatggaaaaattctagaaaaagtaatagagatccataatgagagtaggtgaattacaaccagtccgaaaacccaaatgagggtgagtgcaagcaagtttaaaagtggtactttagaatatgtgactaaaattcaacctaatttgacaggcgaaaattatacttagtagttgatcactagaaggcaaaacaaaagtgctaatgcttacaaaataatttgaaatgaaagaaatataaaatgaaacaaatacttcctccgtttcatattataagactttctagcattgtccacattcatatatatgttaatgaatatagacatatatgtgtgcctagattcattaacatttatataaatgtgggcaatgctagaaagtcttataacctgaaacggaggtagtaataattaccaacactgaacaaacacaggcctactataactggagactagaactcacaacccatggaagtctaggattaacattttgtgagtagctttataataagctggtgttccaactagcctcaagaggccacgtatttatggaccttccatgtataatcctgaatagtagaattagctatgtgatactaaaccaataacatgtttggatgagcttgagatgcaaactcgaaatttccaaaagtgacttccaaaattaggtggtgggtcagcaagaaacaatgaaatttcatcagaataacacatgctcttttttcactcataggtattgcaacatactgaacaaaaataaggaaaagggactggaaattaccatattaaacgtaagcattcaaacattactctggtggatcaaattttatcaacaataagccacttgtaatttgtagtctcttgtatagatatacacaaatgggtacaaagctcattctttggctatatttagaatgcacattccaaatcctataatgacttgtatcatgtgaaaatcctacaaaactcagttgtcaggcccttactatagttagcacctttatgaaggtaagccacagatataaagttttctttggttagtttgaacaaatcctaccctatattcacactacgaactgagaagaaaatttccacccaataaaaatattttaggttcttctccctcattcaactatacaatgggtctgtttggcacagctccagctccagctccacctcttctggagctggagctcagccaaacagtttcagctccaacaaaaatgggagcggagctgggtggagctctctctcacaaaatgaactagagaggtggagctgggtttaggcagctccataactccactccagacccaactcctggagctaaatttaggagttggagctctaccaaactggcccaatatcagcacatcatctcatgcacacctataatctctcccattgatttcttgatcagatgcattgaccaaatatgaaggctacttgaggaagcaaatctatggtaggtcaccattcttttgtaaccaatttctaacatcaccttggttgcttagttttggggttgatttatttaagtcaaccaagtaaagaaagattttctatgtaattgcttctcccacaggcaccaattttgagcagtaagaacaaaagcatgaccatccatgtgcagataggttttagtttagtgtagttcaaatctcattcattaacgagtacagttacatggtacaactatagggtcggtttactcagttacctaacttgcatgccaataagagtagaaaataatgcagaattcatgtgttgtttcaatcctaaaccgtatttaattggcaaaataaatatagatacgcattactcagcacaaataggaatattattataataattattttgtatattggattaaaaggaaggtccattctggctagactctaggggagttcttaaaaggtaaaaggaccttgaatccattataagacagtaacttaaggcatacaaattaaaaaaaattgtacactggtctgtttgtggtctttttctatcatgagatgatgctaatggaacattaaattagcaagaggaagaaaaagtattgaagaaagcaacctcacattgtttagttggtttagtgtcacttctaacttcccctggaaggtaagaaatatgcagttatgcaccattgtccgaactccaaagccttttctccaagaatcatatagggagcgttcggcaggaggagtttgtgagttagtttgtttcattttccgtgcgcacgcttcccgaactactaacggtgtgttttttgtaaaaattttctatatgaaagttgctttaaaaaatcatattaatctatttttgaagtttaaaatagtttatactcaattaatcatgtactaatagctcacctcgttttgcgtatcttcccaatcttctcttttcccctcctctcaaactcacccatagtctatagtgtatgaactctgaatctcaaacttgtagtacaaaataaatctgcatggttaacacgacatacaaacagataccaatgagttgttaagccactaaaacatacaaacaatgaagatgttagaagcacaattatctttcagtggatatatgtacagctccatacgagaggattcttaattctcttgaggtagctacctgcgaaaaacatcggggttttcaggatccatcagtcaatcccctgaacaagaacgatgatgtcggcttgtcgagaataacagaacaatgcatatccatgttctccgaagattgagctccccagcttggatcaaatcgcagacgctcgcgtccgcagctgagcaggagttcatgaaacctaccaatttactgcaagaaaaaaataatctcaaaccggagcctaactggaattacatacagcatcgaagactacccgatagaccaacagaataatttgagacctgtagaacattctgtggcttgagttcattcaaaatcatcagaataaagccccccaccctatcccattccatcaatccctcccccggggcaaccggaaagggagagaacattctgcagattgggttcattcagatcacccaggctggaaactccaacgccaatggcccaagcatctctctaattcgaatgcaggaaaggccgccgctaaatcaaactcccaactccccccaaaaaagaaaaaaaatccaagcacgatgcacgactggaaactattcccctgggccgggacgaacacgccgtcggctgcgaatcgagatgacacaagatccatccgccggtgagcagcggcgcggccaccgacctaatctgagttttggcgatggcgagaccgagagttagcggcgggaggcgaggatctctctgtcgcggtggagacggggacgaggggtttgtgcttgtgcccttcgtccctgtgaacgaatcttgatgcactccgtgtaaggtggtaaggctctgtttgcgaagcttcaccttatctcgtaaaatctgaagctcttccaaataatcccactttttttttaattctaagaagttagttatagaatatggaaaatgaattagagagctgtttgggaagctttcatcacataatctcccactccctaaaccgtctatattttcacccatattctaagaatctttactcgtagaatctagaaaataaactagaaatctaaaactgaatctaaaaggctggctaccaaccagtagattttcagaatcttaaactactccaaacaaaacctagaaatcggatgctgagaaatctagcttttctaagccggctacatccagctatttcttacaatcttaaactccagacagatcctaaggctaagagaggtgcaaaaaaaaacaccaacctaccgtatgaatatttttgaaatattgagctaagattaacgaagttacgagctggtagctcgctattgataagtacttcctccgttctacaatgtaagtcatcctagcatttaccacattcatattgatattaatgaatctagatagatatatatgtctagatttattaacatcaatataaatatgggaaatgctaaaatgatttacaccgtgaaacggagggagtaccaaactgaaggaatgggctagtaaatcttgaaattaatgaagttaccatgtgactatcaattgataggtctcactaaaagagcgggttcgactagaaaaaacttgattagttaagttacgctcacttaaaaaaaccaaacattttcttgtaatgttaaatttaactagttctaatcatgaagtgtacgacctacatcttatttacggtattgttaaaacagattatttaaatatgttcctagaaaaatctccaactgtttgtaaggtcacttatttttttattttaaaaaatatttctatatagttacatagataatttataacaatactccacttaatataaatatatattaaacatttttttcattttacaagaaccagcccaacttcccaaatggccctcatcaattcgacctgggccactcggacgtttccgatggactcgtcaagcccacactccccccaccgatcagacagtgggcccttcatgggcccacgccacgccctcctccactccgtctgacctgaccatcttccacccagcgttggtctcgtctgcagcctcgccttcacctcggcgggtagatctcgcgggcgcatcgcgtcgcggggcaaattcatcaccttcgtgaggcgcaaaaccctactgcccttgacccctcccgctcccctcagatctccccagggtccaccgatccaaggtgaggcggcttcgtgctcggtcggtgtgtgcgtgacgtgaggtttcttgttcttgattttggtttcttgagttttgaccatggtggatccggcggtgtgtggtggtgtgtggttgcagatggcgagcacgggggggaggtcgatggcgctgtcgctgctgctgttcgcggtgacgctgtcgctgctcgagatgtaccgggggaggttcgcctcgtcggagctcatgaccatcgccggcggattcgtcagctccctcctcttcctcttccttctcacggtgcgttgaatcgtccgctcccaaccctcctcttacgatcttataccccttaataagtttttaagttttgctcgtgatgccgttgtttgtccctctttctttttagctaatttgaagtgatagaatcacatgagtggtaaaattttcgttttattattaatttagacaaaccccgtagcaaatggagttgccaagatgttgtctctcgtagcttttgtcacatttgagtgattcagtctgtaggggataaacaccatagaagaaaacatagttttgctctgtgcagaagtgggtagtaacattgtgcttctctgaattgtaatatccgactaggcgcataagcgagatttcggcttagaggacctggaactagtttattcaggttcagttttccagatatccacagaagaatagcttctgaaatatcatacaccatctaatattaagttcactctctacacaagaagtcaaggatggcttctgaaagagaatagaacatttaattttaagctcacttggtactatgtaggctaagctatctgctagtatttccatgatgctatcataattcttgcaaagggcatgttaagtatggaacctggagcttcgaacttttaaccttttgagccaagataatagaactaaagggggttttggccaaaagcatgctaagccccaagagcatccagcagaactagcagccccaatgtccatactactagtcttatctgatggtcaaagaaagtatccttgaaatggggtacttatcccagctttctgctctgtaacaagagaacagtgcaagcagacccttaggaaggcaacaaaacttagcaaaaacaagcacataagacatagtgagcaggtggtatccacatttgattttcaccttttatggttgtattaaaagatcagtgagttttgcacttttttaactgtttcctctcaacattaatattagtatatgataatttgatatacttttgcagtttattggcaactatcaggaagctaatggagttaaaactggatggggtgcaggtatgtatagtcatacgatctcattcttgctgcttccccctgatttttatttcgactttctttaactgtctctttctttgcagttgttgtcgcggaacttactgcacttattgttgccggcactgtccatcgtgtttgcatcacaacatggtatgttatctttaagacactttactatttctttctacggacatttagaatttttctatatggtcccattaacacatccatagatctgagtgtttgctgtttgctaaataagaaaattcttggattatccagagatggtaatctcagacatactagtggagtatttgcttatgaactgttgctctgtttagatgggaggaaatgaaactaacaatttaggcaaaaacaagatactccactcctttgtttgcaaggagttaaaacttttttcatcctgttgaatgtgatatcattcaagatagtaatgtgtatttcacacaagtattttttacctatcttaagttgtatattgttaacactaatgctattggtaaatatggatttgtcacatgttgtaaaagctgtatttatgcaacaatgtcactggaaacgctatgcaatttgcagattacgctattcagaattatggcatatagaatgggttactagtagttctgttgaacctgtctatataaaatatcaaatcaattgcccttttatagcctattatgcttgcggtctaagtcccgccgctacttggcatttttttaagcaacttgacacattgtggataccctcataaccatgactttggagagttctatgacagtgagaaattgatactttggagagttctttgacagtgataaattcatattattaacctttggtcagtctgtgcacccgttgctgcagtccttgcgaatgtgttaatcaatttttatcaactttggctgcagcttcctgttttctgctggatttctctacgaggttgataagctctctggaatgattctcgcgaagagcgagtctaaagcgaggcggcactaggcttttgtaccatgtcatattttgtagatcaaatcaaaaactaatgttcacacccttcatggaactttcaacccagctagctttttcccccaggcatacgtataccatttgaattatgaattcctctagtgtgtttgcactgatgtcacagttcggcttttatgagttttatctaatgagaatggtgttgactaggtgatttcgatgtctttttgacagtctcctggtgacatcagttcatattttttgcaaagcaatgacacattttggcattttagacgtgccctgttgcaaacgttgaaaacattgtgaagtggtagctgtggttaagatctgaatttgtcaagcatgttgcttaacgttttatctccatcaactctggggttttcttgtttgcaaagcgcggcacgacaatgggaaatgtcaactagggacctctggaattattctatgggacggggtcatgtagtctgctttgagattggtgttgaaatcttccccgtggattatttatttatttatttttaccttttttatttaaaattttagaaataaaccattcaaaacttattttcaaatctaaaactgttggtcacgtggcaagggttttatcaatccagctagattgatttggcgagacaacagcccactttatagccattatgggagacgtagcagagttgttttgtcaagcagtgcgagatgacgtggttagaccaaaaaatttagatttgaaataagttttaggagcatttattttaaaaactacaaaaggttcgaaaataataagaattcacgtccatgcagggcgatgaaagcattacaaagccaaagctgattttaagttttaaaacttttttttagaactaattccgtgtgtttcttcgccgctttcattgtccaacctttccgtgatttagtgcaaaattattcctgagaattaagtaatttttaagaattgaaaaatcagctaagcatgcactcgtttgccgctttttgcatgaatctagtgaaagatcgcgattgacatgaacgtgcggcaatttgaccaaggctctccctttcccagccactctctttcaggtccacaacagtagcacaatgcaaaaaatcacgagcaaatcaaaactcgagataaggcatgacgaccccaattggcaacttgcccttttctgcaaacttcacaccgcgagcctgacgcggttgaagaagtatttattaaccctatttaattagggttaattgtgtccggccgacctatgagcacatgtggagtattaatgaaggtgtttctatgtttcgatccggaagttatttctgctaattttagattgacctaattttaagaggatgaaaggtactcacaacaactaaggtacaaatttaccacaaggattctcgtcgtaatcaagaagacataagagatcctagaatcatatactctctctctctctctctctctctctctctctctctctctctctttctgttctttgtacttgatgcatttatcttaaccgtggattacatggacagattaggacagaatccacaacgacgattcctctcctgcattgtcaactatcaactgcacgggcacaaatgtactccctccgtcccattttaagtgcagtcagccatgattttccgtgctcaactttgatcgtccgtcttatttttaaattttttacataagtcacgcataaagtaatattcatgctttatcatctcataacaataaaatactaattataaaaaaaagaataagacggacgattaaaattgagcacggaaactcatggttgtatttaaaatagaataggacagtgggagtacaatccaagacgacgactaacctgcacattaacctaggcaccttcttcctaagatatagatataccagtactagtataataatgttaacaaaaaggaatatcaaaatgtgggttggattaagcctcacgatcccatttcgcgcgcccgacggccaacacacaaaataataagaaatcatgcccgcgatggctacctgacaccaacagccgacctgattgagagagatcaattaataaactgaacaacaggttaaatggttaactaatccaagtcgacactaattactctatattagcgcaggtctttttttctttttcaatagcactgcctccaacttctaatagatgacgccgttaacttttaaacaaatatttgatcattcatcttataaaaaaaatttatacaaatatataaaatataaatcacttaaagtattttgagtgataaaacaacttacaataaaattataactaattaatttttttaaacaaaacgaacggttaaacatgtgataaagagttaacaatgttatcttttaaaaacagaggtactaatattgattaagcataagcaggtcggctctttgaccaaacggcgcgaggaaggagcagaggcgggagggaggatgtctggctgtctgaacgcgtgaggagctcacactctgatcatccatccgcgggtgggttgacctcttcccggcggcgcggcgagagaagggaagacttcaacccggccgcggttggtggcgccatcactccccggcccccgcgcccaccatatacaccgaggcgtcgtcgcctccccgcaccttgcgcggactcttctcctcttcttcctccacctcctcctccacgatctccggtcaagcagagcacaagcgtgtgctagctctcccggtggcttgcctcgccggcgacggcgcggcgcaggatggagccgcgggtgttgatggctcttgcgctggtggtggtggcggcgggcgtgccggcggtgttgtgccagaccaacgcccaggacggtgagtgctcttgcctcgccgccggcgatcacctccgtttcttccatagatgattctaaagtcaggcaggatcttcttgcccggagaagaatcgcttggtttttgttgctggtgttgatgatcttcttcttgggcatgcatgcgtgcagctgcggcgctcgaggggctgaagagccaatggacgaactacccgttgagctggaactccggcgacccctgcggcggcggatgggacggcatcatgtgcaccaacggcagggtgacgacgctgtaagttacagccatctccttctcctcctaccaccaatatcatgtgatgggccttcctctgaaatcgtgccatggatgtctctggtttttgcaggaggctgtcaagcgtcagcctgcagggaacactgagcagcagcatcggccagctcggccagctcacgtacctgtaagcaccttcttctatcatcagttcatcacccagcttagcaaaagttcaaaacagcatgattttgcaggctatgaacttgggattttcgaaattttgttcatgcttctgtagcagttcagattgtgaattcaggcaatcaggctaggaacttctgattgaaccagtcaaggggcagattgtcagaacagtttgcttctagtttatgaactctgcttttttttttcttgaggcttagttcagctgaccagttcatgtttaccaatcttaagctttgactatttcggcaatgtgacatggattaggttcatttcttaccaaatgaaagaaacaaagatatgatgccaagttacaatagtaaatagatctggatgaaatatctgaagctttgactattttcgcaatgtgacatggattaggctcatttcttaccaaaagaaagaaacaagatactacacttgaagttaaattatcaatagcaaacgtacctggatgaaatgatccgtgacaaagttctggagtacaactaatttgtctaagaagaaatagtctagtagtagtagctgataacagaaacacttgcagggatctttccttcaacatcaatctcggtggtccgctgccagctgagattgggaaccttggggagcttacgacactgtatgcgccgcactgcccattgttgtcaacactactttttccaatcagaaataccaaactttcttactgatgtgcacaaatgctgtgtaattgtcaggatcttagctggttgcagcttcactggaaacattccaatagcaataggcaacctgcggaaacttgggttcttgtaagtggatatacctggtccacagtttcagatgataaaccctttttttcttttcttttgagtggattgacataatgaattcgtgccattctctatagggccttgaattcaaacaagtttagtggtggaataccgtcttcgattggcgtactcacaaacctcttatggctagacctggctgataatcaactcactggatctgtccccatctcaacatcaacatcaccaggcctggaccaacttgtcaaaacgcagcacttgtaagtaattttaatcttactttatggtattatcaattgagaaatatcagaatatgtaagtacttacaattgattgttttgctccaaacttcaaattgatgaacagccatttcaacaagaaccagttaactggaacgcttactggacttttcaactccaatatgactctcatacacatgtaagggatcgacaaattttcatgtctaatatgaataccgaatagatatatcttgctaacatctctccctatctcgtcagtttgtttgatagcaacaaattctcaggctcaatcccagctgaggttgggactgttagtacactcgaagttctgtaagtatcttgaaagttcacataggtggaactcatccttttattttctccaaaaaaaaaaatggtcatatctttgacttgcttttgtatctttgacagccgattggataggaatggttttacgggagcaatacctgctacaattggcagtttggtcaaactgaatgagctgtaagtgacatctgatcttaaaggaagagttatgacacttgaggcacctctcttgaaaatgttatcttctgcaggaacttagcaaacaacaagctaactggatcagtgccagatctcagcaacatgaccaacttgaatgttgtgtaagaaactaaccacccccatgcctcatcatccaatcatataatttgtctgcataactaaagattccactcttgaattgccagggatttgagcaacaacacatttgatccttcagtggcccccagctggttcacatctttaacatctcttgcttctgtgtgagttatccaaaacttttggaattttaaattttgtgtcgtcttgtgatgacaatttcatactcatctctatatgttttgatcactcagttcaatagtttctggaagtctttctggccaggtcccaaaggggctcttcacattgcccacactgcagcaagtgtaattttctggtaacttacaactcaacatat

SEQ ID NO: 71587 - DNA, 10651 bp, Oryza sativa
agtggatcccccgttgtttttatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgtaggagaagatgcgtgcggtcatgcgcgtcttctcctgtcgcagcgccgtggacgtcgtacctccagctggtccggtacaactacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggcgcagggtaggagggacaggggtaagaggcctcgtcagtagtgttctacctcttcagtccttatgtgactgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattgataatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgagtacttccgtcaattttcaaaatggaaaattatttttgtaaaacttttaataaaaaaaataaaaaataaaaaaaattctgcaaataaacgtgtgtgggcattaaaccgaagaaaattttcaaaaataaaaatgtttaatttgttcgaacttggtagatctcataagaaaacttagtaacagaggagctctagctgatgaccgattgctcaaaaaattttagaatacaatataataagtaagcacaatacatatattacaatttgcaaagtccgtagcccctatacatatactagacgccttctcttgcattcctcgtcgaagccgctggcatgatcggcttgctgagcggcacacgcaagcagaggcctcttcggcgccgccaccgccgcgtccatctgttccatggcgtcgtcggcgaggacctgctcggccagctgcgccacggcgccggctccggcgttggcggccgccacggttctcttgacgcggagcatctcccggaacgtgcactcgtcgccgtgacgcacctcgaagtcgttccaccgcctccagaagtcggggtgagccgtcgggtcggtgaagccggaggcgtagacgtacagcgcccgtgcacggtgggcttcgccgaggccaatctcgaggtcggcgaactggaggcagagcaccctggcgtccgcgtccgggaggccgccgccgtggaggatggcctggtggtatatctccctcgccttgagtacgccgaacagcgcggtggcccgtgcgacgtacgcctcgtagacggcgagcttgtcgccgccggggacggcggccgcggcctcctcgtacaccttcaggacacgcttggcgaggccgaagtcctcctcgaacctcgcgtactgcatgtacacggccgccttcttctccgccggcgcatgccggacggcgtcgtcgaacaggtccctcacccgctgcggcttgctcgcgccgtgcctctcgacgaactttgtcaggtacgccgcccatattgcctcgtcgtgcgggtacttgaacgtcctgacgccgcgctcgtagacacggaacgcgtcctcgaatcgcttgtgctcttggaggagggaagcatggcggagcaccagcagcggcgtgatgatccctagctcgtgcatcctatcgtacacggcgcaggtggattccggcgacccgtgcgtctccatcaggtcggcgtagaagcaccacagcttgagagaccgatgcagctttgtttggacgacggtctcgccgacgccggcggcgacctgcctcctgacctcgagcgacggctctgacgtcgcctgccgaatgagctcgatggccctgttggcattgtgctgtctcagctccatctccgcccactcgcaccaaacggcggcgaggtggtccgccgccttgaagctcgcctgcgtggctctccgcaacacctcccgcgcgctgtcgaggaggccgcggtcctcgtacatcttggcgaacgcgagccagagcgtgtgcggcggcggcttccccgtcgccttcgccgggtcgacggtcttgacggcctcgacgtaggtggctactttcctcgcggggtcctcgtcgaacagcttggccctcgcgtgccacgcctgcacgtcgtgcgggttctgcctgagctgcacgcggttgagcagctccggccggcgttccagaagccgctcgagcctcgcgagcgccatgtcgccgtcgtcgcggtcggccagccagcagccttgaccgagagtgttctcctctgcgtcgccgtgctccccgagctccacgtcaatcatggcgttctcgaagtgcaggtacgcctcgaacaccaaccggaagtccttgacggtggtcgccgtggcgacgccctcctcgaacacgtcccttgccttgccgtggagacccacccgcgcgtagtggccggccaaacacgtccacagcgcgccggcctcgtcggggaacctgcgtacgctgccgcggagtatggcgtcgaccggtagcccggcgacctcctccgggtgctgcgcgagcaggtggcacagatcgagcaggagctggcgcttggtcctgcccttggccgagacgaagcagtcatcgttgacggccgcggcgaggtgatcagcggcttctcgccatcggccagcggagacaaggaaggcgatgaagtgctcggcgtgggcggggtcgaattggaggtggcggcggaggacgcggatggcggtgggaacggggcagccggggagggaggcgaggcggaggaggagcggccacatgcggtggtgctgcgtgacgggcagcgagcggagcgcgcggtcgagggctcggcgagcgcgggtgaggaggcgctggtcgaggagagccgagaagtacatgtgccacacgcgcggcatccgcgacatgcccgcggcgagcgagcgctcgaaggcggagttgagggcggcgtgggcgcggtgggcgacgggcatggcgcgcgcggcgtcggcgagctccgtgaggtacgcgtgccacagcttgtaggagcccgggagagcccgcagagcgcgctcgtagatgaccgagcgcttcgccagcggcgccgagcggatggccgacaggtagcgcgtccagcaccgtagccggaacggttcgcgcaggacgtcctcctcgtatggaacgtcctccggcgagatcatcatcgccgccaccatctctctaactcttttgactgatgaagggccggtctatcttctcttctcgtctcgtctgatcgttgcgttgcgctggatttggatgggcgattgtcgacgaggcggcacgaaccccagatttatagagaaggatgaccggtacgagcccgagtcggtttccacttccagcattccgcgtgaacgccagaagcccagaagtcggtgcccccctcggggttgcgaacaggagtcgtactccgactcgctggcccatgttccccgttgccccgctcgtcaagtcgtcattgggcagtacaaatatcaaggcaaaagccctgctaatcagctaatgtaaaatcttattttaatcttatcttatcttaatctatacctacacctatacctatacctacttttttaattaaaaaataagctaatttttcatccgtcattaaaacatgggcccacgcgatatttcaccactaagagcaagtttaatagtatagctaactactagctctaattcatttatagccaatctaacagctcatttatacaatagttatatactacactattaatatctggtcccacttgtcatacacacactgcgtcttggagtccgtactacagctagctacaaatctgtagctcgctgcccttctctcttctcatttatctacttaaaatatatttgcagctggcttatagcctgctattgtacttgctctaatccgcgagtccagacacgtgacagcgatctctaagggagtgtttggcaaatgggaaagggaaatgatttcccacccatctttaaatcttaaccattcattctcccttttccatttaatcctaacccttcattcatttcccaatcccaatctcaccccctattttccattatccaaacacatcctaacgctctgcaaataaaaagaggaagctggcaagtagctcggccaaagcagaagcagaccggcccaacaaaaaaacaaacatagcccagcagccagcccacggagcagaggagtagcaacccagcacagtactgcgcgacatgtagcaaccgagcattgtagcacgaataataccacctcacttatctagcttgggcagcactagattaaataggaggtttgccagaggctactaacactgataaagtttggaaccatgctgtcgagcgagcgattgctcggacaacgggcctagatcagtgcatcaaagcaagatgtttttgttgttttccctagatcagctagatcagtgcatcaaagcaatatcagatccctagatcagtgcatcaaagcaagatcggatctgcttgcacggcgtgtacggcgtagaaagataacaaagtagatcagtgcatcaaagcaagatcggatctgcttgcacgcctatgtttttgttgtcttcccaaggtcagtgcacggcgtagaaataaagagatcaaaatatcaaagcaagattggatctgcgggaccctactcctgtgttttgttgtcttccctaaatcaggttttgttgtcttcccttgtgttttgttgtcttccctaaatcaggttttgttgtcttccctagatcagtgcacagcgtagaaagagatcaaagcaagattctgtgtttcgttgtcttccctagaacagtgcatggcgtagaaagagatcaaagcaagatcggatctgcgggaccctactcctatgttttgttgtcttcccaagatcagtgcatggcgtagatcagtgcacgacgtagaaagagaagatcagtgcacggcgtagaaagggatcaaagcaagatcctgtgttttgttgtcttccctagatcagtgcacggcgtagaaagagatcaaagcaagatcggatctgcaagaccctactcctgtgttttgttgtcttccctagatcagtacacgacgtagaaagagaagatcattgcacggcgtagaaagagatcaaagcaagatccagtgttttgttgtcttccctagatcagtgcacggcttagaaatgtgttagtgttttgttgtcttccctacatcagtgcacggcgtagaaatgtgttttgttgtcttccctagatcagtgtactcctgtgttttgttgtattccctagatcagtgcacggcgggaccctactcctgtgttttgttgtcttccctagattagtgcatgacgtagaaagagatcaaagcaagatcggatctgcgggacccgagctccgactagggagacacaggaattatgcaggttcagccaaaggtgtaataccctactcctgtgttttatgttggtgtagttgtcttccctagatcagttgaatacaatacaggttcagccagaggtataatattgtactcctgtgtgttttgtattggtttagttgtcttccctagataaggaattatataggttcagccggaggtgtaatgcctagtcctgtgttttgcgttggtgtagttttcttccctagatcagctaaatacaatacaggttcatccaaagatgcaatatcctactcctgtgttttgtaatggtttagttgtcttccctagatcgggaattatataggtttagctagaggtgtaataccctacttgtgtgtttcgtgttggtgtagttgtcttctctagatcagctgaatacaatacaggttcagccagaggtgtaataccctactccatccggctgctttatttaacatgactgggtgtcgtcgcgcgccatcatcggctttgtctatcacccgccagcatgccacgcggagggcgggtccaccatgattcatgggtattcagttgaatacccaaaatttttgacaaaaaaaaattcatatatgtaatatatatttcatatgtatatgaaaaaaaatatgtaaaatagacttgtttcttcagagaagcccgacttagcaccatcccatcccacctccgtcctctcctcggctggtcggcccattggcccaatagcccatatcagcaaaagggaataatgaaaccctaacctctccttcccattcgatcttctccctggcggcctcccgaccctgattcccgactcccgacggcgcacgggcacagcgacagcggactagcggaggcgcgtcggggtcgcagcatcgcctcccaaccccgatggcggcggcgcccagctggctgccaagctgctgcagctccacggctacccagtggccacgcccgcgcccccgggctgccgcctgccgcgaagggcgccatccgcccatcccctatggcgcccacgcgccgccgcccctgtgggctgtggcgcccaagtgcccacgcagccgcgctccgtgctccggcctcctctgtcctctccaccactccaccgcgccaaacgcccagacggctggacccagatgaaggtaaaactggttaggaacattttggtaattaggttcgaataggatttaggagtttcggatttatagttcctagttgaatccaggatggttcattttatttaggatttgaatccagccatacagggatggttcatggtttatggatgaacaattgaactttgaaacttgtgattcactgatttgtgaggctttgtagcagagttagtgcacatatttagcagagttagcatggttaatacttaaattagaagaccgtagtgttgttttgtaggtttgaaacatgaagaggaaagtgaaggataaagacatcgtcacttattttcaaaatatcaagaaacgaaaagtctctctaaattgtaagatttcttatcatttttccattttctatgctttataaatttgacatgttttgtcaattaatactttagtactgtactttaaaatatgcttaacatatttaatttatggtcaattctatgaatctatgactttacaactcgttcgctcactacgaagaaacatttcatctagttgacttgaaccccattcaactcaactcgatttcaggttttgaataaatccctgatggacggaagggagcgggagtcagctcccttcctatgaaagacacgcatcatgcttataccattatatattatacaactattagactttgtgttggaaaaaaatatctcttccaatttcgaatacccaagttgaaaatcctgggcccgccccacgcctgacatcgcgaagtggcgaagatgtgtgtgcagactcaccgaaggagattcgtccctacgttttgccgtttggtgattctctgaggtgacaactgacaacaagtgagtggccctcctgtcacatcggatgtatagacactaatttaaagtattaaatataaactagtaaaaaactaatttcataaatgagagctaatccgcgagacgaattttttaagcctaattaatccataattagcaaatgtttactgtagcatcacataggctaatcatggattaattaggctacgaattagctcaaggttatggaatgtgttttgtaattatctatgtttaatactctaaattagcgtcaaacatccgatgtcacagggccgtatcgaacggaataatgtaccgaggagctaagcaatttcagaaaacaaaaacatgtgcatgacaaaaaggaaataataaattttaagtggcctagcaaaagtgcctgcgcgatgcaacaagaacagatttatgattgcaatcaaactccacatactccaataaattcaggtttctgtaattcttttaggtgatgaaaattcaggtttctgtaattcttttaggtgatgggcagcggcttcagtaattaatcaaactctagacaaaaaagtaaacaaaattcaagcataatcctcacagttaaaaccaaaccgagatcgaagctgtggttgtttatagggacaatttgaaccaagccacacaaattttgcaaaatttgtgatatgccaccctaaccccttgtttataatttataatatattgcagtactggtctattcattccactagagcgaatcaaaagatataaacagtgctgtaactgaatgcaagtttatgtaaggcagacaacttagggttataagaaaaatagcactaaatttcataaaaccccacctaatatgattcaaatctctactattataaaaatcaaagatatttttgccggtattttggtacgtcatccgtgtatgagtcggtttttaaattcgtttgcttttggaaatacatatccgtatttgagtcggtttttaagatcgttcacttttggcaaatacagaagaaatcatataagaaatctgttttaaaaaactcgcatactaacttgagacgatcgaactcctaactacagctcatgattttctaaaaatatatatccaagcgaacttccacagtgaattttatctttactaaaccatataacaataataaaattaaaatagacttcacccgttgcaacgcacgggcattttttttctagttacataaaaccataggaattttgacatgtgacacataactcagggaattatggtcctaaagtttcataaaaccatatcattaactattttgacatatttctatatcaaaattttataaaatagatgtaacattaatacgatggataatttgtcataaatttgagatgtgattgtacaactcaaatatgtattagatcaaatttaaaatgattaatattgtggtttgtgaaactttagtatcataatacctaggttatgtgtcacaagccaaaatttctatgattttatgtaatttggaccatagtatatgtggttttctaaaatttacgattatatatatgatcccagagggaagagggaagatgaaacaacagaaataaagaatgaagagtaaatttcacaaaactacatgttttgtggtccaagttgcagaaaatcacacgcactttgacacttggcacttgagtacatatattttggttgtgtagtactacactatcgatgtatagatttacccgcgagatgatgtggttgtttcacctaggacgaggacatggcatcctattaccagccattgcacgaaattaatatgatgccacggc

SEQ ID NO: 71588 - DNA, 3379 bp, Oryza sativa
aaagaataacgacttacacaaacttgtaccttgtttcaaaagtttatattttcatttcttagagtacagtttgagtctgagtcggtggaaactcgggcacatcttctaaagaacccagaagtacatctttctcattgtcagcagtaagtctaaaaggttagtcgatgcttctttcaagtggcataggaaagtgcatactgggtaacattttctagatatttttccaattccttttctccactctcaagagtctcccaaagtgatttcctcaattcctcgtttccttgactttttgtaacaaggtcataagcatagcgcataacatggctgcagtatgcagcttcatcatccatacattcttgataggatgattcatattgctttggattaaaaacacacttcttagcacctttggtccacctcttcagtatataggtttctggaatactgcacacattcttgatgctaagagctttaagagcatgtggacaaagcaaacccattgtttcaaacttactacagctgcaattgagttgcattgtcatcatatcaaaatgaactgtgcagactcttgatcctcgcccttgcattgtcatctcaaattgatatctgttattgtcttcgcaatgaagctccttgaattttgtggctccacatccatcaagaaaatacgtctcaaacaacttgtagattctgtatgtataaacttttgctgcatgattcaaaatatcactgtgctttataatacaagcaggaggcttttggctgcaccgcgtgtcttcatcgatctctttttcacgccaatcttcagtcaacttgttcacaacaacaacaattgtagacggagaggtaaatttctcggcaatgcagttaaagatgttactcagactgtcacattgtggctcatattcaaccccaccatcaaaagtgtgtttgttgagagcaccacaccacttctgcttgagtttataaagtttcttaagccatttgttatcctccaacttaaactctctgagcatcccagcccatgtttcctcaaactcagcttctgagtcacatccctgcatacacttggtgaacagcttattaaatgctttggaaccattaagtgtaccaagacgagaagcagcattcttttgtatgtgccagcgagagatgcgatggcatgtatttggaaatacttcctcaattgcctttgacataacttgatcttgattggtaaaaatagagcgaggatgccgattgcccattgcctccaagaaagatttaaatagccacacaaaagatgacatagactcgtcagctaatagagcacagccatacatggtgttctgccaatggtggttcacaccaacaaacggagcacatatcaaattatgtttgtttaagcgataagttgcatcaaacacaacaacatcaccaaaacagtcaaagtcaatcctgctcctgccatcacgccagaaaaaattagtcatccgaccgcctcggtctatttgaacatcccaatagaacataccatcttcatttgccctgctcttaaggtgtcttacaaggttctgcaaatctgcattccctatggcaagtgtccttgccatactaatgtagcatgagagtgaatcttgctttgacgtctctacagaacttgacctccctgctataagtgatcttgcagaccgtaaaagatgtcgttcttcaggtcttgccaagttgtggttgtgatcagagaccagccggataaccttccactccccgtggttattcactctgaagcgaaccatggccttgcaattcgtcctagtatgtgggtcattgaagtttgcatcagtaagcctctccccttccttcaggccctccttggagcagaagtaatccttggtcctgatccttttcgtgccagtaaagtaggactgcttcccctttcggatactgaaccccatgcggtgcccatagtcacagtacagcttgtacgccgcctcctcgctgtacactaccttgcggagtagttcctcggtgccctccttgctgccatgaaccgttgctgcctcttcagtctcggcttcatcaccatacgccctcatccccatttcatcaccagagttagtaaccgccccttgtccttccatgaccctgtcgccaccagcatcgtcatgctgcgacccaattccttgatctacaccaacgcccgtctcaactgcgacgatagcattatcgtcaacacacatcggatctccacccccgccttcacagccaccttcaccgtcagtgttcaccatcactgcaaaaccccgagataattgggatcaatgtgtcaaagccacatcataaggcaagtgtaacaacgacacacctatcatcattcctatatatcaaccgaaaaaatcccaaaccctcacatagatagaaataaaataaagaaatgcagcaccttcctaacggacatagtggcggatctaacataggacatggggggttcagtttttgggaaaccatcaaactgttagtagtattaaggttaaggcaaaatttctagaacagaagttagggttaacgcaaattcgagaaaacaaaagtgcgtgggtagagagagagatgggagcgtaagcgtaacggatgcggcggaagcagtgggacgagcgacggcgaccctgctcgctcgctcgctggctggtgcgacggatggggatcggcgcaggcggcggtggcggaggacgtgctcaccaggatggatgcggcggaagcagctggacgaacgacggcgccccctgctcgctcggcgggatggatggggatcgccggagccggagccggaggcggcagcggtgggcaagggcaaactgacgaggaggcctctgtcaggattactccactcacgctgtcacgcaagcacgacagaggcgtcgaaatggcgagggtaacgtagtaatttcgcctagcactcaatccacccggattgcttgcacaccccaccaccactctacccaaacggtgaaaatatgaaaaataaaaataacggaattgctaaacttcaatcgacagaaaacctacctccaaatcttgcaaattttgcttcactagatatgcttcacgattcgtgctccagctgcttcttatccaactccgacgaactcctcttcttgtctggtgccggcgacaacccaatctccgacgaattagggtcctggggtgagatggggtgggagggggaggggaagaaaggggagttcgccgggcttagagggatggtcgtgggaggcggcggcccggcggtgggcggcagaacgggtgggcggcgagcgtcggcgccggtggcggagccgtcgggatcgaggagggtggtggccggtgttggtggcggggggcatagcgagcttgtatcttg

SEQ ID NO: 71589 - DNA, 36991 bp, Oryza sativa
ctggttctggaacccggccgtgtaccacaggcgcggcgaggtggtcggcgtgcacgcgcacccggagctcaacgcgaccgagatcggcttcacctcgccgtaccgggaggcgttccggagggccctggagcggctgggctccgacgggcggcggcggaccgtggtgctgggcacgttcgcgccgccgcacttcgacgggaagccgatctttgacccgacggcgtgcacgaggacggagccgtacagggacggggagaaggaggtggggagcatcgagagggagatgaggagcatcgtgttcgaggaggcgaccgccgcggcggcggcggcggcgacgatgagggtggaggtggaggacgtgacgaggctggcgacgatgcggccggacgggcacccgggggtgtacatgcaccgcgacccgttcgctggcggcggcgcgcggccggagcggatgcagacggactgcctccactcctgcctccctggcccggtcgacacgttcaatgagatcttgctgcagattctgagcaggcagcggtgattcgagccagtgcgtgcgtgcgtgcgtcggtgcgtgcatgggcattgtttaattgtgaattgtgactgtggtgtgtacgtgcagttcaatttctcgtttatttcgtcctgctaattgtaacttctgtgtgttctggtcaactctgaattaaccaatttcatggcaacagaacaattcttaggctgtgttcgcttgtgctggctgagaatctttccttccagcatggaaaacacatgattaattaattactacctccatattttaatatatgacaccgttgactttttatccaacgtttgatcattcgacttattaaaaaaattatgtaattatcatttattttattgtgacttgattcatcattaaatattctttaagcataacataaatattttaatatttgcacaaagattttgaataaaacaaatggtcaaacgttgtttaaaaagtcaacggcgtcatacattaaaatacggagggagtattaactaaaactaacttgagaaatggattaatataatttttaaaacaacttttctatatatatattttttaaaaaaacacaccgtttagtaatttgaaaaacgtgcgcgcggaaaaggagaaataagagttgggaacccctacaaacgaagcacccttagaaccgttaaatccattggttttggtgttggtctacatgctaaggacagtctcaatcctccatcttagagcaagtataattgtaggttgtaagccgactaaatgctgagatggaggagagaagagaggagagagaggagaagcgggctgtaaacttacagctggcttgaacataaaaatcaagaaactctatgagagagacaagtggatcctatattaattgtaaagagctaactattatatgggtgggttgagagaagactgaaaaacctttatagccaacaagttggctgtattattagccttgctcttagttagttttcataacattaaatataatgccatataagcaaataactaattaaggtagctagagaattaactaggcgaaataaaaaacgtgaagaaaccatttctcatataagaaaccaaccctacgtagaaaccaacaatgaaaacaacaaaatacatggatgaaatgagagagaagggagatgattggatagagtttattttgaagaaactactcattgagtatattttttttatacatgatatctaagtgacatgacgagtatgaaaaatattcgatagtttttgggttgggattgtcgtatgttttggtgatgtggcattcaagtgtgtacaaacatttgcttcattataagggaggagtagaatgatgagaggacaaaatttagtgatatgggagctaatgtatgtgccatgacaccgaaatcacggtggttttggttctacgctttgacattatcttttaaaaaaatattgtggagctgtgggcttaactaatttcagcatcaataaatgtcaagtgcccaattttgtagtccatgaacaatttgaaatgaacaattaatttcaagactacggttcatgaaacagatttttcgttcatgaacgtgttacatattcatcactacttcaaaagaaatagtttttgatatatttcagaaacaagcaaatgactaatttggatatatatatttaaaacgaaccgccctcaatggcgtgtaatatttccctaaatggaatgatacaagaaaataggctcgctagttggctcgccttgttagttagcccgtgcatataactttagaaaattcatacccaacatggtatattattttctatttttgtgtaacctaaagcagataatatttccccttgtcctatgcatattgtttagggtataatcattaaaagattgtgattctgcgttttgttgaaacacacttcatttatgtaaaaagactatggttgtatattgactaataccctcgtttcaatattgaaagataatatttgcctctttttaattaatacatactacctttcccttgtatttaattgttttaacattattatttatttttgctgtcaattttttaggccagtttaaaattttatttggaaatagaagtgttggtattttatttgataccaacattttttatcataagatgaggatattggtatttcaaaattttagaacacagagaagtgtaataacaaaaaaaaagaaggaaaaagaatgaaattggggtgggagtttggcccaagccagataggcccagtgcctctcctctgttgttgggccaaccaagttgcagcccaagtggccagttcgattcgcatgcgcacgacgtgagtaggggcaggggcgcgagcacacaatggagcggagagcacgcgtcgtccaactattggtgccacgtgtcatgcacttttgcatgaaaacccgccggctttagaatattagatatgcacaaggaggccacgattgattcagaatggttgaccttaagaaatgggcctgttttatttgctaataattgaatggctgaatttttagataatggaatgaaatattccgacagccaattattacaaggttcgcacaaaagcaaactcacactgtgagtatgtagccaaagtaacaaaaccaaaagtaaaagcaaactaataaaaaccaagcaaggtaaagacccaacaactattgaattctattggtgaatctccacccgaagttggcaaagagctacatgatcgtcgactcaagtttacgacacgtatcctttattagcttgatatgatcatcatacctttgtagttaagcacattcccgaaagtaatatgttgccctgaaaagaacctgcaaataatgaatagccgaatgttttaatttgtcagtactatttgagattacaaatgaataaattagctatcataaagttgaaaataaatttaaaataatagtttttttttaaaaaaaactcatatatatatttaaaaagttcttgtgaaaatcgtgtgtcatattaacccattatttccttttattcattggaaaataattgtttgcgtcacgtgtggatatccgtgtgtctatttttctttggttagctctagatctcaaattaatgactacccctgtttttctcttttgctcgatgagtttattttacagtttttgaaaataattgaaatgcgaccttggtcattactttttataactttgcactacgatacagtagcaaaacataatattatgaaaacattattactgaaaacctagatgatttcagatatactagtgatcaaacttcggaaaatttgatggcaggaatttttcaaaacgtcaaaataataataacaaaaagaatgacagcctagcttgtagtagtagagaaaaataagagtcgactaatactaaatcaggtgattacttgtactaatttgtaaaccgtgtgagcgtccgagcgatgatctagccataaatctttccgttgactctcgcgattccaaacacgatggcttggaattggagctcatacttcgatccattccgttaattaatccagaaatactccattaggcacttcatcattctccatttttgtttgctcctacaagaataatcagtagtgttgtgatcgcatcatcaattcattattcatcatacagcaatggcagctgcagaagtagaacacagcggcagctccctccccaagaagctcgtcacttttgctctctgcgccatcttcaccttgtccctcatctacttctcctcccctcctctcatcatctcctccaccaccaatcttctctcccaattccaaacacgcgcacgagctagaaccaccgatttttctactcatctcccaggtaattattaggatttttttttctgagctcaattgagcagcatttcttgcgatcttgattggtttcttgatttgtttttagactcatttcccaggtaattattaggattttttctgagctgaattgggcatcatttcttgcgatctcgatcgattggtttcttgattttgtttttagattcatctcccaggtaattattagattttttttctgagataaattgggcagcatttcttgcgatcttgattgattggtttcttgatttgtttttagactcatctcccaggtaattattagatttttttctgcgctaaattgggcatcatttcttgcgatgttgattgattggttatcttgattttgtttttaggggtagctgtttggaagcaatgcgactacagtgatgggaagtgggtgtgggacggcgaccatggcggcgccgccgccggcggcggctcgaggtacgacagcgagaactgcgacatgaagatgacgtacaagtgcgtcatcaacggcaagccggacggcggctaccttcactggcggtggcagccggcgtcgtgcaacctcccggcgctcgacccggcggcgttcttgcggctcctccggggcaagcggctggcgttcgtcggcgactcgacggcgcggaaccaggcggaggccctcgtgtgccacctcgccacggcggcgcggccggtgacagtgcggcgcgacgaggagcggctggggcgcaagtctggcggtgggcgttcccgtcgccgcacgacgtgaacgtgtccacgtactggtcgccgttcctggtgcggtcggaggggcactcggaggactacggcatggcgcacgaggtcgtcgtcctcgacgcgctcaccgagccgtgggcgtccgacctcgccgccatggacgtgatggtgatctccgcggggcactggttcccccacagcgccgtctactacgacgacggcgagatcgtcggcgtgcacggccggccggacatgaaccgcaccgagatgagcgccccgtccgtgtaccgcaaggtgttgcgccggacgctggagcacgtgatcaacgccaccatggcggacaagctcgagctcgtcgtggtggagacgatcgcgccggcgcacttcgacggcaggtacagctggaaccaccgcgacgcgtgctcgcgccagaggccgtacgacggcgacgtcgacggggaggcgaaggtgggggacaccgaggccgagctaaggaaggccgtgctggaggaggtggcggcggcggccacggcggcgaggcggcgctgccctgggctgcggttcgaggtgctcgacgtgacgaggctggccgccatgcggcccgacgcgcacccgggcgtgtacatctacaagaacgcctacggcggcggcccggtgccggagacggcggcgaacgactgcctgcactggtgcgcgccggggccggtcgacacgttcaacgacatcctgatgcagatgatcgccggcggctagctggccgccgccgcccgccgtcgtcgagctcgatccggcacgtgcggcgcggtgtgtcgccgcacgccgcgttgcatggtctctgcgtctgcgtggatggtggatcagatcacgagaatccgaagctgtcggttttgttctgactggttcttgaatcctgacaattgactttggtatgcgttttttataagcactttttcagttccataaaaaatatttcttcaaatacgtattactagagatatataagaatatgtctatattcaatatgagattaatttttgatgggacgagattgatttttgttagatggagggaatgttcttctgccaatgggattcagaatcgcagtttgcagatgcaacgtgtgctgacttcaatctcgatgccattgattggcacagtgtacaatggtctatttcaccttgaatataagcatttttatattatttagcagttaaggaaaaaaagcgtgctgacttcaatctcgatgccattgattggcacagtgtataatggtctatttcaccttgaatataagcatttttatattatttagcagttaaggaaaaaaaggctttagagtgtttgtacttgtagacagaggaaataggatatatacggccattgaaatagggaacttagccctgcaaacaacccaatctgaaatataagcatttttatattatttagcagttaaggaaaaaaaaggctttagagtatttgtacttgtagacagaggaaataggatatatacggtcattgaaatagggaacttagccctgcaaacaacccaatctgaaattcgctccataggagatttgagccctgcaaacaacccaatctgaaattcgttccataggagatttgaactcaagaccatagggtactactcaggtcactataaccactaggctatatccctttcgtatatattttattgagtatgtggtgtgttatggtgctgattttattgcaaggaaatgttacaaatttcaatagagaagtgctacacgaagggatccttttctatctcgtcctatacaaagggattgctagaaatataccattgtcacgtaataaaagtgcgagtacgtgtgatgccacgcggtgaggacgtgagaccgcttaatctcgtgcaacgaggatgcaatacggctacttcgcatccctaagagtatctccaacagcttcttcaaatcacactctccaaacacccatatagtcagctctccaattgatttggcaagccaaactcattcctcacttcaacagcctctccatctacactctctattatgagcctacgacactgagacccgcacatcagcctttattattctcatggttgtgtaggaggcagcatccttatgcgccatttcgtcgaacaggttgcaggcaggccacatcggcatgcctgggcatgtatctggtaggccaagcgggcatcgcagtagctgaggacggagcaggtgagctcgttggcggcggcggtggccgggtggacggtgagagcgcggcggagggtggcggccctggatccggaggcagagcaacggaggcaaatatcaatcgatcggtatgggttcatttcatgggttgggttcggtgggggattgcaatgcagactgcaattcccttctctctctctctacactttcctcttcctcttctctcttctatgcagtggcacggattctatgtggcggcggctctcttcggaggaggattctatgtggcggcggctctcttcggaggaggattctatgtggcggcggctctcttcggaggagaggtcgatggtggtggtggcggtgttgttctactgggtggtggtggtgaagccggagaggatgtggtaggcgggggaggacgccgacggggagtaggagggcgccagcgcaggaaggggaggggagcacgcggcggaggtggagcgcacggcggaggagcgtggccaccatggttggggaggcgaggtgagaggagaggatatgggaggaggatgacgacgcggcggcctcgcaatcagacgacgacgcggcggagggggggcgccggcggagggacgcggcagagggagtgatgccggttgtggctggggacgttggcggctatggatgcggcagcgccggacttggctggggacagaggcggcggtgccggatgtggacacggacggaggcaacggcggcggttgtggccggggacggaggcggcggggatgggctgtgcgggaggcgagagcgaaggaagaggggagcgagacatgtgggagggatagtgcgtggggccacagttggccagttccatgggatctttagctagccgaatggcttggccaatcaattggagagtatttttttttctctatgttagctataatttagcttggagagccatttggctactctgttggagttgctctaactagctaactcagtgattaatagattaatttgtatcattagaaattaattaattaatgttatttctttaataagcatcattagtacttaattaatcgataatatggttgattaatcactaatcactataccatcctgctagttggtgaagtgagactgcactaattattgccatttattaaatcaacatcattaataataaattaatcattaatctggtcgattaatcactatcattgtacaatgtcgcttgttggtgaagcgagacctccctcgcgccgcgggtgtcgtcacgccgtcgtcattttcaggcaactgtttaacgatatcatatcgttttcgcactttccctcagcaacgatgatatgttatatgtttgtgccaaaaaaatatacccctttatatttctgaggaaaaatagtaaataaaaaatatattttcaaatttaattataaggtattacactcggactagagtgtggtatcctcgtcatcaccttaaaaaaaggcttctatgactatgtcctttttttttaatcttaaatgtgctctttattagctcgttggtttggtacgatcacgagacaccagtacatttacagactctgggagggggtcagcccaaacatacaagtcccaacccacacttatacgagcaatgtcaattttttttaatgtctcacacgttgtattgatagagcagaaaaaaattacaagattacaaccctgaagggtcgtaaccaggaaaaagaaaaaaaatataccaccacccacacaccgatagcaccaacacacaagatcgggagaaggctaacaccggaccagccgccgctaaacgtgaccgaccgctactagaccaacaaaggaacacatacgagatcacccaaaagaacgccctcacaaccaacgcaaagccaactcctagagtgtgcttgcaccaatcgttcgagaggcttcggctagggtatgccaaaacgacgtcttcaagaagagaagcgacggaaaaccgccgccgccgtcagtcgggatcaaaaggagtcaagactgggctttcgcccggcaaccacccttgagggatgagactgcatgacaatgccctcaggagggggaattaaccatcgttgtcggtccggccaaggccgggctgggttttcacccgctacttaccacctgcgaatccacggctgatgcaccgatactccaccaccactcaacctctgccaacatgtgggaccactacaccgacgccccccgccggccagccttcgtgtgccgaagaccacgccacattcattggcagctcctcctcgctccgaggtcgccttctccaccgccggccacgcctctcgcactaagccggcctcctccaccggatgtgcctctcgcaccaatctggcctccccccatcagccgcgcctctcacgccaagccggcctccatctccaccgcctgcgcctcttgcgccgagccagcctccgctgccatcggctgcgcctctttgcgccaagccggtctccaacccctcctccaaacgctgtcgcgtcggccagatgcagtcatctgccacgccctcggctagccgtccgaggctgccatgcctcctcccacctcagccaccgtgcctcctcccaccgccgtctgtcgctgcagccgtcaccagccgccgcagccaacagctgctgccgccaccgccgtcggcagtcgtctgccgctgccgccgtcaccaaccaccatcaccagccgccgtcgccagccgccatcgctagccgccgcagtcaacagctgccgccgccaccgccatcggaagtcgtcatcgccagccaccaccgccgctagctgctgccgccaccgtcgccagttgccatcaccagccgccgtccgcacccatcactgctggccaggcagtgtccgagacagatccggcccggcaaggctggatcccaccgtgtgggggccggatccgtggccgccctcgccggggcgtgccgccgccgacgagcaatgtcatgagcacaactattacaagaacgacccgcaaaagacagcttagcacttgggaactctaaatggagcagagctctaatatgcctgaagagcacgccacccggagagcagtcaaaatctgttgatgacaaggcacacagcaatgcagagtaatcagtctgatcaaaatgcgagaaaccatggtgagctgtgatccgtagagcatgcagacaagcttcattctatgactatgtctcgacgcccctggacatgtccaacccggacggaatagtcaacaccagccacaccatttattcatgctggggtcgtcattggcggggagcatgttacggggtaagaggcgaggaaaaggggatcgacgatgaaggtcatctgtgccttgggaatcatgtttggtacgacgattctcaaaactattgatacctggtacttaaaaagcatcagactcggtacttggtaggtactccctccgttttacaatataagtcattttagcatttctcacattcatattgatgctaatgaatctaaacatatatacctatctagattcattagtatcaatatgaatatggaaaatgatagaatgacttacattgtgaaacggagaaagtagtagcgaatatcaatcctaatatatatctggtattcgactagtactcatccggtatcatatggttttggaataagatcttgtacaaatgtacaataacaactcttatttcaaaatcgttaataacaacagcttatatagttatacagaatcaagttgctgtaggaccaggatgtcagatcaagcgttcacggatccaggccatgtattatttttccaacgagaagtgcacaaaagggatgtagtttttcaatctgccaagagggctttcttaacccatctctggatattttgcagtgggaaaaagtatatcgaaggtcacctcatcttgtcatcatattacaaaatcatctcccaaccgcaaaatcagatatatgtcatctcttaacttataaaaccgaatcatttttgttcaatgtggcagctgagtcaacgagggccccacatatcagtgaaacccaacctcttcctctcttcctctcttcccatctctttcccgtgtgagagaccgacgggaaacgatagcgtgggcggcgccccggcagggagaacggcaacggagaggagatacgtagcagcggcgcagacggagaggagttgggtggtagccgcgagaagctcctccgcctcccaccacagctaggatcactcccgagctcctctagagccgcctccaccacggcctccatatgcgtcgcggtggccccgcgagcccatggtacgcatggaggaggtgaggctacccccacgccgatgctgccgccgagttcaacatcatcctcaatgcccatctcccttcccttccccagtactcccgcaaccctacctcgaacgatgcgggaccgtcactggctcaaggaagaagggacaagatccccgcgtggctgcggcgtgagggaacagacacactgccgccgtcgccatcgtcgatgacctgaatgccctgagacatggaggggatgccgaaggtgtgatgggcgtggagcgggacgttaagctcggagacgacttggagcatggagatgcgattgtggaggtggtcgatggcgtgggggcgtggcgaccatggggacggttgggtggagcgtgaagaaggcgtccagttgcccgcgcccctcctcgccgtacaacttgtggatgaggaggtggaagggcccctgctcggagaggggccgtgacgggtttgacggggacaaggtccataccgcgcctaccggcgcgcatcactagcgacggctagttgaagcttcgggatgacacgcgctgggccgccgctcctctcctctgaccacgactcctctccccactcattttaaccatcgagggctcgtcatcgggcgcgcctcccctgtcgttggtcgccaagaagagagaggaagtgaggcggtcgcgtcgtgctcgggggcggcgcccgtgggtctaagccgacgcccaactcctctccgctggtgctggtcctctccccgctcgtcttcaccagcaagcgcccccaccgccaactcgtgcgtctttggttctccccacctatcgccgccagcgctctccccctaccgccgatcactaagaagaaaggtaaaaagagaagggttagtcgctgacatgtggggcccacgtgggttctaagctgacttagctgccacgtcgcacaaaactgggtcaaaatcacctaaggaccaaaagtgatacggttttataagttaagggatgacaatgataaaatgagggaccttggatgtactttttcatttgctgtttaatagtccttgacactttggtatgggcctaaagtaggtttccaaagcaggcctagtgcttgactatacgagacaatcgttagttccatacgtcacaccagataaatgggagtaaaattgctaactgttgatatgttttatcttactatatgttcaacaacaatacataattatgggaaacatattatatgcacataagttttctgtgcacaccaacaaataaatatcacgtaaaattctagaaaaaaataaaatgtactttcaatagtgctatttggtaaaatctaaaccgagagcgctctcagattaatattaaagagcgacgcatccgtgagagagggttcacttgcaactagtacacctacgtgagagatggtctagttgtttactactgcataaagtgtatctcttttttttcttgttatggacttttctcttaaaatatttattcaatctacaatctaattacactattatgtttgttgtaattaaatctttataacaagattttacatgattatattataataaaaaatatttatgttgtaaattacttttatcatatatgtaagttacttttatcatacatataaattacttttagatttgattaagttacgttttagacattcagtgaacaatatatatactttactttatcgttagttctatgatatgttgattagatttaatttctagataaacttaggtttttaccctctataatagatttacttttgatatcgtgacaagttatttttttaagttacttatattaaattacattactatttattgaacttacttttatatgtctaagaagtaatttaatgaaatctaaaaagtaatttaatgaaatctaaaagtaatttagatatattataaaagtaaattgtatttttcataaaaaatataaggcaaattttgctacaggacatcgcgactttgtggttttagctccaggacaccgcacgaagttacttttagggaaaaacactctcaaaacatggctatttgccagtggacaccgcgtctattaaaataataatttctggttgaagagaagagagaaatcgtgtgaaatattaaaaatacccttgaacccatatgtcatctctcttatctctcttctctttttctccctctcccctcaccgacagcagctagccggcagcggcggtagcaacaacagcggcagtagcagcagtaaacggcagcggcagcagcagctggcagcggcggcagcaacagcagcggcggcagcagcagtagcagccccagtagcaagcagcagcggcggcagcaagagcgccagcagctagccggcaacggcggcagcaacagcagcggcagtagcagcccgctccacgcaatattcaacgggatttgcacggattggttagagttcgccggaaaaataggagatgaaatccgcttcgaatccacgcaatattcaaagggatttgctccaattcttgaggggaatgaaagaggaggataagacgaagaaatcccctcaatcaatgtttgaaacgagcaacgggattggccgaatttggagggggaggtggcggtgtggcgcacgggcatgagagctggaggttgaagacgttcagtagcgcgagggagggaaattagactttagatgtgcagggcaatttggtccggtcgcgtcaaaatatgggcccactcaagcctagtcagcacgaatacactaaacaaatgggcgcggtgtcctctggcaaatagccatgttttaggagtgtcttcccccaaaactcacttcgtgcggtgtcctggagctaatttcacaaagtcgcgatgtcctgtagtaaaagttgccaaaatataatcatgtgagatcttgttgtaaagatttaattgttacgaacataacggtgtaatcggatcataaatcggatgagtgatttaagagaaaattctataagaagaaaaaaaacatgcactgttgggtgtactagtagcaacaagagaggtcgctggttaagacaatctagcttacatctcgttgtagtcatgtcctatttatatctatgaaatctcatgtttaaattcattatattttagccgtatagaaggtaaaattctgacaaaattttgttatggcaagaatataacaaatttaaatataagaatttacaaacttttacttttataactatcagatttttcatttttatggcaagaatataacaaatttgaatataagaattttgttacatctaacatgcattgaatttgaacatgagatttcatagatatgcataatactattaaaagtacatgtcagattttttagaatttttcatgatatttgctagttggtgtgcacagagtgctcacgagagaaacttgtgtgcatagatatgtttccggttatatgttcggttatatgttgctgagttaattgctagagatcctgacacgagatttcgttgttacaaggttattggttggactgctagccagtttttagatatctgatgcatgcatacatagaggagaaagtttatttgttactcaaggtcaaggggacgtcccccttcattttacatttggtcctatagtttgaatcaaataatttcttgttaatccagtattataaccggtcataacatacggttgcgattgttgctgcttgggggatatgtcgaaaagttatgtttttattgataattgttggtagcgtgaaagattgaaaaagccgtcaggtgtgctcatcaattagattaattgaacatcaaagggccatgatgttcggccacctgtccattccctgcaacaactgaagtactgaactgaccccttttcttctactttgtgttcatcgactcctgtaacatagctcaatgttgaaggttttccgttctgtaaactgcaaatttcaagaaaccaagagtatgaccattaattgcaatattcagaaatttctttcagttgttgaaacgttgtacgatgaaaaagaaaaaaaaacattgtaagaacaaatattccattggagttcgaatagtattacacttgaaagttcaggattttaggatatctggatcactgtttatatattcagtactactagttgggaaagcattagcactatgcctatataatacatcccattccaactgataaaaatcgacaggtgagacctttgcttccatggaagctagcatcaggtcagcaaaaaacaaatgacgccacctgccatctgttagccagcctacctcatcaaccatccacgggtcatttctccctccatatccaacacacatttttgtgcatgctgccatcccaagctttctcattttctcagatcatgacgcatatctatttttttgatagtggaattcttttcagaagctatagccaattattatagagtttacgggacggataactacaaattacataattcaagacaagaagacaaccataaagatacaaatcttcatctatggttgattagagtatgcataacctaccaacaacttttaagttgtacttagtctttgcgaatggcatatagtctagtggttgcaatgacctgagtagctccctaagattctgagtttaaatctccatagaagcaaattttagattggtttgtttgaaggggctaagttcctaattaaggatgtgttctttccggtgagttcccaactcacctacctcgtttttcgcgcacatgtttttcaaactattaaacggtgtgtgtttttgcacaagttttctaaacgaaagttgctttaaaaaacatattaatccatttatccatttttcaaaaaatagtaaatacttaattaatcataagaaaatatgtcggctccgttttacgtgtgcggtctcacctcccaaacacagccttaaaaggttccataggtgcagatttcagattgggttgtttgatgggctaagttgtcaatataaaaggctgtgtatattcggttggatatagaggccgggtaaaaaattctcttaaaaaaaaagttgtgtttagtctttatttttctcaaaccagaaaagtggaatctaagaaatcagcgaacacatataggcatatagctgatgtaaaacacggctcacaacgatcatcatcagctcgtcacatcacaatctcacaattctctcaggattggctcaaacacggcccagcaaaagtacagcatagtgacatgcttccggctgggcgtacatatatacgatctgaactctgaagtctgatctgcaactgagaagaaaccaatgcaaaaaacaaaaaacaaaaaaagaaagaaagaaaaagctagctactagcctactactacctaatggttaaaatcaagaactctttgaagcaaagtgagacgagacgagacgagctactgaactgaaccatcggcagaagtgtgtagtttggtgagctactagtgtcacagcgtgacagtgttaggctttaccagaagtgatgagccatccagcagccagcagtgaccatattattctcctcaaacgtccaccaaacactgcaatttcaataacacgtaaccggtcgatcgcaagtactccctctgttaaaaaaaacaaacactgattttcgtgtctaatgtttgaccgtccatcttatttaaaaaaattaaaaagacaagtcacgtataaaatattaatcatgttttatcatctaacaacaataaaaatacgaattataaaaaaatttcatataaaacggacagtcaaagttgaacacggaaacttaggatttgtctttttttttttttggacggaaggacgcacgcacaaatccttcaaaaagctggctgtggctgccggcattttatcgtcgtcatcgtccacacgtacggtgagtcgagtgagctagccatagctagctatgaagaaggcggccgccggcggcatggcgcctcttcctccgtcgtcgtctcctccgtcgtgcaaagccggcggtggtggtggcagcccgaggtggtcgttgcttcacggcggcggcggcgagtggggcgtcgtggtgcggcggaacgtcgtcaagtcgtcgtcgctgctgctgctggtgttctccaccttcttcgtcttctccgtcttgcgctcgtcgcagacgagcttagtcccgccgccgccgccggctgctgccggccccggcgagccggcgctggcgcagagtggtcacgacgttgccggcgatgatggcggcgaacatgtcgccgtcgcagtcaacaatgtggcagctgagacgcagagcacgccggatgacatctcgctgccgtcgacgaactcatcggctgcagctgttccaacaacaacaaacaaagctgaacaacaacaaacaggtgatcctggtaggtgcatttcaatagtgtattcattattttgaagcaataaacactaagataaattctttgtaagcagtggtagagccaaaaagtatcgaagcctaaagctcgaataggactcaactaatgagatattattttttttcaaaaaatatacatgatgatttaagagaatttaaacgtcaagccaagctatcctaggtttgcctccccttctagatgtaaaaccacataaatcttgatgcatattctctcgtttcttacatgtcacaacttctcgttatttcgagggttaaactttttggtttagccgatttaatcagatgtcaccgaaaaattagaaatttcggtccaaaattttaaacaaaattcaattgaatttgaacaaatattactaaaatttatgaaaaaaattgaaaatttttggccgaagtaatatcgtatcggagtggtccaaaattaccgaaatcagtccgaaaattccaaccatggttatttggacgcggttggtaaataactaaataagggatcaaagtaaatttttaccacgacaaatgtgaggcatttaactttgtgatgtttgatgtgtgctctggataatggcaggagcgaacaacatggaggagaaatgcgacatgtcgatggggaagtgggtgagggagcccaagggcccggtgtacaccaacacgacgtgcccgacgctgccggacttcaagaactgccagaagcacggcaaggatcccggccacctctactggcggtggcagccccacggctgcgacctcccgcgcttctcgccggaccgcttcctcgccgccgtccgtggcaagcgcctcgccttcatcggcgactcgctggctcgcaaccagatggactcccttctctgcctcctctctcaggtatatcatcgcacaggatttgaaatttcggtaatttcgcccccaccggtatgctcaaatctcgcccgaaattttcggctttttacaaatttttgtgaatctggtcaaattttattcaaattcagtcaaattttcaaataatttcggccagaaacttctgaaatttcggtaattttggtcacccccgacataaaatccaatttcaaaattgaaaactatgtcattgcaccggctagcttccaatgtcttagcaatggcggctgccactgattaatggcccgtgtcgtgtctcgtgtcaggccgagacgccgacggaggtgtaccgcgacgcgcacgacaagttccagacgtggcggttcgcggcgcacgagttcacgctgatggtgatgtggacggagttctacgtgcacgcggagccggtggtgggcgccgacggcaagccgacgccgtcgttcgacatccacctcgacaggctgagcgccaactggacgcgccgcctgccggagctcgactacgcggtcatctccggcggcaactggttcaaccgccccaactacctctgggagggcggccgccgcgtcggctgcgtcaagtgcggcggcgcagccaacctcaccgacgttggcgtcccctacgccgtccgccgcgtggtgcgcgccgctgtcgagggcatcgcgcggtgcaccggctgcaaggccggcctcgtcgcgttcctccggaccttctcgccggaccacttcgagcacggcgcgtggttcagcggcggctactgcaaccgcacgcggccgctggaggaggacgaggtgagcccggacagcgccgcgtgggagctgaggagggtgcagcgagaggaggtgatgcgggtgaaggagacggcggcggcggcggccgcggcgagcgggaacgcgaggaggttcgaggtgctcgacgtgacgaaggccatgatgctgcgcgccgacggccaccccggcgcggccatcgacaagaggtggcagaagaacatcgtcagcgactgcctccactggtgcatgccgggccccgtcgacatgtggaacgagatgctgctccagaggctcaccgagatctccacgctggaccaggatgcttccatctttgaggcaccttaactttgtcacttacatgtaggtccggatcattaatgtatcactgcatacaatcatacggggaacgatgcatgactggtgatgctataggggaggtcttcctatccattgagaggacgtgcatatctctcaaatggttataaattttttgaaaaacaatctagatcaatatatgatgtatcactttataaatatgtaaattaaaacaaaacgaacaacaaacaagagactaccaatccatcagttagacgaatgtttgctacaaaaggatcaggtttttcaatggctaggactattttaagattagtactacttctattacctaattacgtccccgattaaattgacacaaacataaagctttatatgccatcacttccctccggctaattccccttaggccctcacttccctcccctctcccccactctcgatcactttgccagagccgtcgttgttattgtcttttcgatttctgatgtcattctctcgacccacgtctcctccatctctatcggatcgacggttactgccaccacctcttaaccacatggtttttccttgccctgaccccacccaccgtcatcctcaaatccctccttccattaccaccaacctaaaaaacctaatataacaaaagcttttttagtccaaaagtcgccaaaaatgagagcttgccaattaagtcaccatcgacgtttctattaccatagtcacatgtgagtacttgccatctttctcctcatcacttgctcttgctagccctagatctttaatccaatggtgttcatcaatcgattgataaatagcaaatcccaacgaacaaatatgaccatgaacaatacatatatagttagtgcaatttcttctttcttttaacttgtatgtttttaatttatcataaaattcataatgatttagataacatggatgaaaaaaggggcataccctagagggaaaaaacatctcctgatgctttggtttggtgatggtatggtcaaaagttttttggaagaaaatttagtccaaagttttcaaagtaaaaggatgttaaatattgtctttacataagatgaagatgctaattaaattcccccacagaaacttatcatctaaggaaggatccatgaaaacttatcatgactatttcaatgacttggcaaaatgagggatatcctcgagaggaaaaactccactttccttctttaatctctatgaatgatgaactacagaagtgaaaataattactcgagtaaaacaacaagaaagagatctactccctccctccgttttatattataagactttctagcattgcccacattcatatagatgttaatgaatttagacaaatctagatattagttcttggtacgccagatattctattgtgcacatgcaaattgcaagaggccggatttagtcgtacaatggaagaacggcctagatttggaggaaacgtttattatttctctggtttatatggaagagaaagaaaggaatgtattcaaggcttgatgatgcttgtgcaatagcaaaacagggatgagtacagctactccatttaatgctatggttatccctccaggatgaaatggatatcttcttattttggacacacataaatatataccaaaaaagttatctttttttttatcctcatgggtcattgaccctaagaagaaattaaggtcatatccataaaccttaccaatgtcctcaccaacaagtgttgttagccttagccatggcacaggcaagtggatgctgcaacaacaacgttcggaggcggtcgaggaggagaagaagaagcagccatgggcggtgggcaagaacgccgcgctgttcgcgttcttcgtcgtcgtgctaccgacgatgatgatcctggccggcgtcagccacacgccgccgccggcggcggcgacgacgaggctcggttggacgatgctgggtacctttacggcacgaggtatatatatctcccccggtatctgtgttcgatttcactgtccacaccaactcaaaagttatggattgtttggtttaaggaatagagtttctctatccgtttttccaccttgaatcaaaagctctctaattgaccaggataattttaaactttgatcattaataagttctaaattagcatattttctttaagaaaaattatatggctatgtttaatgtgcaacatactactataagttataaaacccagtgctttgctgtgaaaataatgtatgagtatatgttcaatgtattatagaaatgataatatttgatttttttaaacgatgtgaagaagatggtttgacatacttgaatattgagctcttcaatattatattccagatgatatatcatctttcatgagatttaagatgctagaatagcgatagttagtgggtgataatgtggtatatttagcttctaataagtggatagcaattatataaaaagtatagataattttcaaatgttcacaattacgtggataaattaaaagtagtaacagttgaaatgtaaatagtgtctcatgacaagtatttaaagagggggtataccatctaatctagttatactgccttatggttgacattgctttctgtttacattttagaatttgtctttggatggtttgttgtcaattaacatcgcccttaatagcttagattgacttcggaactaaagtggatctattagattcctacgagaaacttagaaaggggcatcacattcagtgccaagtttaatgatttaattaccatatacctcattgattgtactatgagttcgtgttacaatagtgtagattgatcattataagtatataacaatattcttttttttgaaatggaaccaacccatatagttctattttcaactaaattttgtgtagttatcgccgctcaatttgtacagaaaattatactagccatgtaacatataaatgtatcaacataaacacatagctatatttgtggatgttttctaacaacaaaatctgttgttgtttgtcgccaagccttaaggcttttttttttttgtgggcgcgcgcgccgtaaaaaaaaaaagtcaacttcacatccctcaggtagagttttattaacatatgtcttaacttttaaaacctaaacaaattgagtccttagaaatattgagaatgatttcggatgaagtagctcagcgtcggagtagggacatgtgacaatttgagcttgctgaggtgggcgagcggatcgaggggcctcccctttcgcaccatcacaacagggtcagcttgacctcgaggacaggatgtagtcggcgatggcagagtggatcataggggcaatgatggagcgggcgcgtggtggccttgttggcagcaacggcttgggaataactatttgccacttttagatttgacaattaactattaaccacccctatctacatgtgtctataatatgtggatacacatgtgtctatgacatgtaggtccagtgacaaatagttaattgccacatttaaaagtggcaaatagttaaatatatctgggaatccgggagaaggggagaggatgcacggtcttttgctgacacgtgggacccactatctttttttttatttcttttggctgactaggacgtcgcacatgacaaaaccaccataaaaaatatacaaggacgtaggctgatcgggttttagaagttaggggcacttcgtacccagtcttggaatcgcggttgaggacgcgtacgaaactcgttgagggaccataagtagactttctttacctccgtgtatgtgtcctgggccataaaatcatcgatctcacagaataagttcacttttgatccctcctcctcacgtcgagtttgaatcacatccctaatccgtaaaaccaagtacgacgcatcactcatctttagaaaccgatgcgaatgtagtcctaagatagtattgaaggtggctttgcccttacattctatttaggattaggaataggtgtaatcagacctacttttgacatatctatcatatccttatttgggtatcatatgcacctctttgggcttctattgaatcgagaaattggattgtacatctttttgatttttgatacatataaggtgtcctacggataatgcaaatcgaagctatttgatgtctgactcaggcctatatgaccgatcgatcgacatactccaagactccacctttgtcatatattccatatatcacattagatagatatcatattccatcatggaatatgattcactttcaagatgccttgatggtgaaatggtagacacgcgagactgaaaatctcgtgcaaagagcgtggaggttcgagtcctcttcaaggcataatacggagaatgctcataacgtggtacaagaaagaaaaataaaaaaccataaggaatatattgtatcatgttttacggtttaaggatatgacttaaactcgacgttaaagatgagagaccgcaagtgaacttatttgtttgctcactccagtagtcgatgagtcattcagtgcgttctgtgctttgctcaggtgcggtgcaaaaacgagccgaggaaaacaacaacagctgcgacacgtcggtggggagatgggttcgggatccgagtggcccggcgtacacggccgcgacgtgcccgacgctgccggcctccaagaactgccacaagtacggcaaggatcccggccacctctactggcggtggcgccccgacggcggctgcgacgacctgccgcgctcctcgccggcgcgcttcctcgccgccgtccgcggcaagcgcctcgccttcatcggcgactcgctggcgcgcaaccacatggagtccctcctctgcctcctctcccaggcggaggcgccgacgaaggtgtccgccgacgacgacggtgtccgggagtggcgcttccccgcgcacgggttcacgctcatggcgatcacgacgcggttcctggcgcgcgccgaggaggtgctcggcggcgacgggaggccgacggcgtcgttcgacgtgcacctcgacgcgccggaccccgtctgggcgagccgccgcctgcgggagctcgactacgccgtcttctccaccggcaactggttcttccgcgtcaactacttctccgagggcggtcgccgcgtcgcttgcagcggctgcagcggcgacgccgacgccggcgagctcgccgacttcggcgtcgcgcacgccgtccgccgcgtcgtcagggcggcgctcgaggccaccgcccggtgcggcgacggcgactgcaagcgcggcctcgtcgcgttcgtgcggacctacacgccgagccacttcgagcacggctcgtggttcgacggcggctactgcaatcggacgcggccactggaggaagacgaggcgccgagctgggaccagtccatcgggtgggatgtgaggagagcccatatcgaggaggtgacgtcggcgaggaagacgacgccggcgacgacgacgaggttcgaggtgctcgacgtgacgaaggcgatgatgctgcgcgccgacggccacccggggcggcactacgacaagaggtcggccggcggcggcgccaacgactgcctgcactggtgcatcccggggcccatcgacatgtggaacgacgtgctcctccacaagatcgccgagaccgcctcgccgccggcgacgaatctccggtgatgtcggcggtgatttggtgacaaatttagcaacaattgatgcaaaaataagtagcggaaattgagtggtcgtgatgtagtactgttgagtgtaagttaattacccgcgctttctattggagatgaaccaaccacccacaacatcacctccataagggacaaatgttttctatcactcaagaaaatatctactcgtttcccatctatctatctatctattatctatctatctatctatctatctatcttctattatatactaaaagtccatgaaacttcctaaaaatactctcaaaccgccacgtggcttcctcaaaaccctcctaaatcgccacgtggcattatattaaatagacaaaattccaaccattgattttcacttaaaataggtggacccattattttgagccattaaatttaagctaatccgtatcctctcatctccgaacaccgcgtacctcctccccgcatgcaaggcgtagatagctaggtacgcatccactcctctccatctccccttttttctccaaggttgttaagatacaaagcataatttattacaataagttagatagaggtatggagcctgcaggagctcgctgtgcaccatgcatgctacctaaattataggagtgatcacagtgatacacttgaactacacattcagtttattatacacttgaactactgttttttaatcaaatcaacggtttaagactcatattagttagctatattttggtggtaaagaattattacatgttgggctttttcaatttatcacatgcacgtatcattttcatgagtcctccccaaaattgaaggaaaccctaaaaattttcttcaatatcaagtctaattttttattcaaatcggtggatcaattatgatacaataaggcaatagtaactaattaactacatacgtactctctcatcctcctctcctctctcattcaattattcattcttctaatttttaactaattagcaacttaatataaaaacaaaaaaaaattagaaagctaaatgattataattcttaagttatatctggtttttaagttcaacaatataaaagtaaaatatattacttcacaaatataaatatatttagtaaaattaagatctatatatgataaatatccactcaatgttctttaaaacatcttctaaataattcaagatccatattacccatatttcactataaataatacgtcatttgtagacacctatgcgtgtcaaccaaataaaaaaaatcaaacaaactatatcaccttaaatcatcgtacattctcaatagagcacttacatgtcacgtgttacgtcttaaatttaaaaataaaatcttagaaattatagaaaaacacatttgaccactggttatgaattaaatatgtatatccattattttaaaccattagatctatttttttaaaaaaatcttaagccgctaggggttacattttaataattaaaaaaatattattcaaaattttaggaacaaaacaataaatcatcggttttcatttaaatcatttataaaaactaggaaataaaccccgccccaccccccaaacttcaccccctcctcacatatgcacaaacacaacactacccgtcccctcaccccttggctcgcactttcccctataccctccttgatatttttataaccaataaaaagagaaataatcaataatattaaaacatacatatcttttgaaccacacatctgattctaatataaattgctctatttataattaaaccaataatttaaagatccataacgcctatattttaaacttaaaataagagtagtatcaaaataaaacaagatatagaaaatatcaatatgaacattggttcctacttttcactaaaattagaacaattatacatgttcctattttttaagtgcttagatattattggttttcatgacattatgagttcctctgtacattattgtatatatataagccacacaatgtttgcggtttatagttggttgagaagttatatttgtaattattaaaatgttcagactcatattaactaggtattttttttaaaaaaagaaagatactatagatcacacatatattagggaagggagatctacgatatatctttagaaatttatatataaatatataacaaattgcgtcaataaaatatattcattaaaaaataaaatatattcattaacaataatagttatttaggattttctaaaaaaagaaagcacctaaacattttattaaacaagacaaaacatcacatgtttccaaacaaattaaatctaactcctttctagataatgaagagatcatagataattatttataggaatgtattaaatattatgtattttaaaagctaacaaatagattggaaaaattatctaagcaacactgatgagataagttatggataaacaatacttatgaaatgacaagtgtcatctggctgatattatgccattttatatatttttttcaaacataatttatagtacatgcctacgcatcgcgcgggctaccttcctaattatatctaaatggttatcaaatttttttaaaaaaaaaatatgacgagatagattaacatgaaatacattacttcacaaggtatacaaattcaaatttaactcagttttttttacaagttatagaactcgaatttcaacttgcattttgtagagtggtatatttcctattaatatgtattattaatttttttataaaaaaactttatgactatttaggtggcatgtaagaaatgagaagaccagccccggtcctatgattttgagggcctcagagtgaactcatcgcgataggccctctagactatatataaaattttatgatatatatagacgctaattttacttgcaaagcgaacacaaatccattgaaatatttaatttaacatatttgataattatcaaggaataaagacaaccaaaataacaatatatttgtgcccttggaatcaatatgattaccttaacaaagaatagaactctatcacatccattgcttcccatgaaaagatactcttcgagcatctctagggctgaggacgagacgatcagattgaaggcggcggatgatgaattgagggtgagcggaggaggaattgaggatggcgcctagcggctagcgtgaggaattgaggatggcggcgcctggcagctagatcgatctgatctgatctcctgtctctgactctctatctccgtcgcggcatttccacttccaccacaaagctgcgtccagagctggccctcctgctgcgagcctgcgactatgcatattggctagttatctgctattaggtgtgggccccgggcactggagaagacatttacttgagggatgaaaatccatctccagacaatctccacaattaattaagagataaatcaacagttaattcacatatttgggtaaggagattgaaggataaagggataaggttgaactcctcacctccataaagtgaggcaatctccttatgatcttcatcatacataaggttgaaatctatatcatgtttatccttcaagtgaagtgattgcctcaaaaaaatgaatcaattgataaggctgaactcttatcttatggtgaaataagatatttgacaaatatttattctacttaacataagagtagatgtcatccataacatgtttatccttcaaatcaagaaatatatgggtctgtgaatcaaggcagaaatctcctcagcaatgggaatcatggggaaatgggagagatgcatcggaggcagaagcaagccaatgtcgaggcagcgcacgcaggaggctctccgtcgagcacctggcgactccgaggtggacaggaaggagaagccatgggcggcgcggtggaaagcttctctgatcgcgacctgcctcgtcgcgctgccggcgctggtgttcctcgccgtcggcggcggcatgccctccgccgtgacggtgcttggcggcgcgggcgcggcgagagcaatggcggagtgcgacgtgtcgagggggagatgggtgagggagccgagggggccgagctacacgaacgtgacgtgctcgacggtggccgactacgtcaactgccagaagttcggcaaggatcccggctacctctactggcggtggcggcccgacgggtgcgagctcccgcggttctcgccggcgacgtttctcgccgccgtgcgcggcaagcggctcgccttcatcggcgactcgctggcgcgcaaccacatggagtcgctgctctgcctgctgtcccaggtggagacgcccaccgacatgcacgccggcgcgttcgtggacgcgttccggaggtggcgcttccccgagcacgacttcatgctcatggcggtgtggacggagttcctcgtccacgccgtcccggtcgtcgccggcaggcggacggggccgttcgacgtccacctcgaccggatcaacgcagaatggacgcgccgcctgccgttgctcgactacgcggtgatctccaacggcaactggttcttccgcgccaactacctctgggagggcggccgccgcgtcggctgcgtcgactgcggcgagcccggcctcgcccacttccccatggcgtacgccgtcggccgcgtcgtcggcgcggcgctcgacgccatcgccgggtgcgcggactgcaagcgcgagctcgtcgcgctcgtgcgcacctacacgccggaccactttgagcacggctcgtggttcagcggcggctactgcaacaggacgcggccattggaggaggatgaggtgagctcgggcgtcattgcctgggagctgagggcggcgcagatcgaggaggtgaggaaggcgagggagaaggtgacgacgacgatgaggacgaggaggaggttcggcgtggtggacgtgacgccggcgatgatggcgcgtgccgacgggcaccccggcgagcaccaccgcaggtggagggggaggaatgccaacgactgcctgcacctatgcttgccggggcccatcaacatgtggaacgacgtgctgctccggcggctcgccgagctctcgccgccatcggatgcacggtgagatagtggcgcgcgtggaaacagatcctctgacttatttgtcctccgattttgagtggctgacatgtagatctcataacttgtggacccacgtgttagtcacccacgttggaggagtttcttcatgcgtgcccactatgaagaggtttcctttgctagctgagtactccctccgtccaattttaagcgcaaccatgagttttcatgtccaattttgatcgtccgttttatttaaaaatttttatgattagtattttattattattagatgataaaatataaataataatttatacataatttatgctttatttattttttttaaaaaaaagataaataagacggacgattaaaattgaacatagaaatttatgggtgcacttaaaatgggacggagggaggagctgttgatatgcagttgattcaccaagttgcaatcttctgaaggttttttttttagaaaatgtgtcacaatgttgcagtggaggggactgaaataaccaggtgaattaattttagctttatgaggccattttgttgggatgaaattaagatgacagtttattaggttgtactcctgtttcatataatgtaagatattttggttttttattctaagttaaacttcttttaattcgatcaattttataaaagacataacaacattttacccaaaaaaaatattataaaaatgtattgaatgatggatttaatggaattaatttgacgttataaaatgttactgcattttaatggaactaatttgacgttataaaatgttactacattttatataaattttatcaaacttggaataaaaccaaaacaacttccattctgagatgtagggagtgctattaaccttcctaatacattacatggacaggatagtaatctactactagtactccctccgtcccaaaatataagtatttttagctatgaatctggataactgtgcgttcagattcatagccaaaagttgttatattttgggacggaggtagtagttaattgccaaacaggatatatataggttggaaatgcaactatcaaactggaacttttgagataaagcaattatcaaacacaagacatcattttgtctcacagacctctgctctgctcatcaaagaacccctcttgttcacttgaagcatactagccttcttctggacatgacacccttgcagctgcaatgccaaagaaaaaggacttagcatcttaaataaaaactctccaagaattaagcagaaaaataacagtctacatgactacaaattcacagacattgacgtgagaaagctaaaattttgcagcatattcactcacaagaaagaacatccgcgccgtgttttcttcttcttcctgtccctctgctttgttggaggcttgattactaccttgatggcagcatcaaacacagcttttacattctacatattattgatatttgttaagggattacccaagctatatcttcaggattgaaatgtaggcaccttcaggagcatagagaggcaacatgagaaattaacctgctgtgtctttgagctgcattcgatgtaacacgttgcgccaatgtgcttgcggagttcctctccctgcaagataagcattgcaggagaacacagaaatgtaagatgctggaatgcagtgatatctcaaaattttgcagagatttactgtgaaattttcagtcctcaggtatgcagagtgcataggtactggagaataatacctgtgctgtagtcacaggcaccaagctaggatggtcaagtaagtagtgtttatcttcacgaagatctgtatggtcgacaaaagttgtggtttaattgaacagtaactgattgagatttgttgcaagataagattgtaggcttggttttcaaaaaaaaaataaaaatccaaggcgaaatgcaagaaacttgaaaacatgatcagcataattactaggtaaatttcactagcctatttcattcaatattactgaagtgcaaccttccttttaaaacaggtgcaacatttattttacttaagtatttagtactagagaattatcatctgtttaattaattgtagtggttactatgttagatgattaactgcaaaggaatatagtgtctcccatctaggtaagagcttggaactttgagttccggaaaccgaattcttgcttcggtaagttactaacaaataagcttcaatttaaagcagaaaaagtccaaataaacccctaaactttcattgaaagtccatctagaatcctgaagtttgaaatcggaaattcaaccccctaactttacaataccattcatatggaaccctaaggtggttttacaaagttgttttatttaattggcatataaattggatgagctttgatcatgtgacatacgcatatgttaaaattttcacttaaatatttctttttatcccttgttcgctctcacttataccattgtaaaaataatatgacatcactctatattataaattgacaaactacaattgatgatacataaatgtattatataagttatttaaagctgcttgtttaagatcccaaatacgtaaaaccactattcaaaatcaccttaggaggttatataaacggcattgcaaagtttagggggttggttgtccggttttaaagttcaacgtgctaaatggacttctatcataagtttaaggaggtagttggacttttccatttgaagaaaacaagaattggtatttccaaacatcaattatggaggttttgaaattgtttgagtgaaaaaaaaagagaaagaaacctcattggctcattcataaaccttgcctctctttttttaactacgatttacttttattttgttcagagaaaataaaataatgtagtgcaactaatcttagtgaaataaaaattaagatagttccaaacaattccttgaggaatcataatccaacagtgataaggtaaattgatccgagccggtgaaatactactggcaaggtacaagacagaacgtacaaaatgcaatagttcctacttaaacatcgcaaggactaaatcttggtgagttatagtaactattataggtccatcaatatttttagggaccacacaattccatgctccaagaatgaaaagacaaaatcatccaaatcactaccagcaagtgacaagcttagacagaggatgtacagcacaccagttctattatcacagccaaggggatatgcaataaaatggaaattgtgctttcactgtcacacaactcacccaatttggtcccaaccaacacaattggcacccctggtgcataatgctgaagctctggtaaccacttcaaggggacaaaaagcacaaggtaaacctaactgaaatactgaatctctctgaatgcatccacattatgggtttaacagattaattgcaagagattttttttttctgaaccttcttcatgacattctcatagctagctcggctcactagggagaaggcaagcacaaagacatcggcgccacggtagcttagcggcctcaatctgttgtaatcttcctgccctgtaaacaatttgaagtccacactatcagcatcacaagaatgaaattttttttcagctggaaggattagtaaaattacctggaaatgtagaacaaacaaagcatctgcaaaggaattacaaaaattacctgcagtatcccagagacccaaattcaccgtggtgccgtcgaccaccacgtttgcactgaaattgtcaaaaacagtgggtacgtaatcctgcagaaggccaaacaaaaacaaaaagaagttataaacatgcaacaaatttgaattgaaatattaactgtgattcaggaagaaaacacacacaagaacagagtttttctgtaactcaacaatgataccacctcttgtttccatacaagcataccactataccagagtccccaagaaatcaagaacaagaaaggaaaatctagaagaagttacagctggagcaggcaaatgaagaatcccgaaatttcgacgaaatcaagaaaaaccccgaatcttttccgaaaggaatgaacagaaaacagataggatggagcaaaaaggtttgcattttgcattacagtggggaacttgttgctggtgtagcagatgagcatgcaggtcttgccgacggcgccgtccccgaccgtgacgcacttgatgaaccgcgacgcgctggacgccatggccgccggccgaatcgagcagcagcagcagcaagcagagacagcaagagaggggagagaacttgatagagaggaggaggtgatggcttcttggtgaagcgatggttggaggctagagagagagagagggacagagggaagtgtcacatgcttcctctctgaactgttctcactactgtctatactgattagctagagaggccatccatccatcttttatctttggcgtcctgacgccgtgttctttctcgctatggggggatctggatcatctactgttcatcttctgaaaatggggtctactgctccactagttatgctggtaggctgctagtagaattgcaagaactgtttgttgttgattgtgcatttgttgataccctgatggtgtctgatgatcctgtagttgataagttggtttctggttgtctagtgctttcagccattatatgatgctatagtattcagtctttagaaatactccttccatctctagatatactaatttttagagtttagaatttgacttgaatatagcaacctagtccttttgaaagatgacttttgttactataaactattcatattacccatactatcccttgtctctattatatttggaacttcggacttacacctcacctatcccgagaaaacaaagaagtattttacgacaatgaagtatattttaaaactgaaaatatatagaccacatggaccattataatttattcgatttaaatataatgagagtgtagattaaggcaagaagggttgacatcatagctgttctgccaaggattagcacaatttggtgcaaagttacaaaatgacagattgcatgccaattctgaagtgaacagaagaattcagacgccgacgatctgagtgcaagtagtcagtaggtcagtgtcttctcttttcgatctccatcctatggcgtagtggcttgcttagcaagcacacaagtagtaagatgttgcaagaaacaaacgcaagctgtagttaagctggattttcttcacaatttgtgctttacgtctttttctcctctctctctctctttttgccgtcttttgcttggaagtttgctgctgaaaagtatatacgcaccatgactactgattagcatctcttcgttttcaataaagcagattcttgacgctaaactcgcccatcatccaagaaaaatggagttaaattattttcgttagtgtgcttatacgatggcgaaatgaatgttttataagattgtaaagattcagggtcgattccctcgtttgctctgcggcttattagctgtaactaaaatctgaattttaaatcttaatttcagagttgatttttaaatcttttttatcacagtttatttttagtattagcttttaagtcgctaacaacaaatatatatatatttctacccacaatagcatcatggcatcatgctgtagatatgggcggatctagtacgggtgctggggggacccgagtccccttatccttctagatcaccattgatagaacgagagagagaaggggaacaccattgatagaagaaaagaggaaaggggaagaagagggaaagaaggataggagagcttgtgaaagaagaagataagtctctcctgtaattccattttagatctgcccctagctgaaggagttgatgagcagtatattatccttgtaaagttgtaatacattgactgtagatatatcacaacaaattgcagaggattaccaagcaaataactcctcaaattaatgaaaccagcatgtgggctctttgattctccagtatttttgttgattcttccaggcacgcttttgtcttccttctttggacatgcgtgcatgcaaggctgatggcccaaaagtcgatcctaatttgatcttctggccaggtgctcctctttgcagatttacagctctttaatcattgagatccacaaaagaggctatgatggttgattatg

SEQ ID NO: 71590 - DNA, 2745 bp, Oryza sativa
cccccccccccccccctaatggctcacgcgccgccgcccctccccaatcgcgcccccctctccaaccctaatctctccctctcacgcggcgccaccgccgtcgccgccgccctcgactgccgccgctccgccgttgttgcatccgtcgtctcgccgccaccgatctcaatcgcgtgatttccttttcttatcccgaaatcgtgcaaccctctcaccctaaccctaatcttgtccccgccgaccgacgcgccgcccctccccgctcgagtccatgccgccgcaagttcgccgtcgcaggccgcgtcacccggatcagcgttgacgtcgcacgccttcctcctcacatcgcccggcatacgctcgtcctcggtcatatcggcgccaccgccgtcgccgtcacacgcagtcctccccgtccacctcgccggcctcgcgccctcgccgctcccaacctcgcccacgaggtaactatagtttttgttgctctggatcgattgatttacggttgggcgtgaggggattgcgacaagccagtgaggtcactgttttggttcatatcttcatgtaaatcttgatgttgcagttcaggctgtcaggaattatgttagctcgttttcgtccatgctgttattactgatgtaaaatgattgatgggttgaaccaacttgtcagcattaacgattgttatatttcttaagcttgcagaaccaatttatatcataggccagttgatttaaaatgctgaaacaatgcgctgagcttaaatattttggttgaaatagaatcctgagggcctgctcttcctttgctagctataagaataaagctaaaagaactgaaacaaaactcaggtaaaaagtgagccaaataaataacttggagccttgaaataacttggagttctcgtaatgcagccttggaaatgagtaatgtgatctggtttttctttctaatgcagatcctactttgatatggttgagacttcataaattagtacacttcctcgatgacccttcaatgaatgcctaaatactagaggtacatatttcttaactgaattatgatcttagatgtcaatttggacatgcatgtacaatattaatggtgaaaatgctatccaatatccatagaactctagcttaattttctcgggggtagagaccagtcaatttggaacttttagcaggctttctacttggtacaaagaagattatttatggaagttcatgctttttatattataattttgtatgaagttgagctttaacaactggttaataaatctttcatggtttctttgctaaccatctttacctaatacatatttgtcctaatcttttaagtaaaagaataaaatcagatcattttggaagtgtctgaaatctaaatttactgctgaaaacaagtacttaatgattctctgaacttgagcatgtccctgaaactgaatgatatgtactgatagatatcttacgacaaagtgcacatagctgtaatgctatctcttactgatttaatgcactgatagatatctcactagctagaaggtttagtctactattgaaggctcttttctattagctaatagcttctcaggtattattttacctgttctattgataggactgatagagctgtcaatttttttcagggtttctactgctctctagggacagccatatatctttgagaatattgattttatccccctatttgagtcatatacagagactgctgttgaccttgaatttatcccacagcatttgtgtgcatggagatatactgaagtctttttttccagttattcacaaatataatctggtacattgaatattcagtttaatcatatcagattttcaacagagaatgtttgctatgtatccctaatgaccccatttcaacaaggttctgcacaaatctgaagatagagttatgattttctcaaaattaaccatgatgttatccttccttgaactattcatgtaactaatcggatagaatatatagcttctatgcacatatttatgcttttaaatcaactgtaagtttcttccttgaacagctgcattctatccttcaatgtcttcacaaaatacttttttttttcatcctatccatttttttaccgtctatttaatcaaatggcacggtttttttcgaaagggtttcaccaatccatattattatccatttactgtcattaccactaatcatggttgctgcatggaaacaaaaatggtttctctttcatgttaacagaagctatgaaccatcagtgatataagtgaaatcagtgatattatgtgtatgtgtgacaaaaaatgagttattatctgcatgtgtttctcaaatttagatagcaggcctaatcttttgtcgagctaggagaagccctgagtgccctggttagggataacctggagcttttttattattaaatgaacctggagctaaagagttttttatgttctgttgtagctgccagaatggaaaatgcctgaacattgctctgaagatgagtacatcttttgcaagtcttgatctgtgcacctcttcagctggttgtcagcatgaaaaatttatgattctgacatatgtctgtgaatatgtttgtaacaatgaattctaaaaacatatatctctgaatacgtttgtaaatttagttggattttgtgaagttttcagtgagctttggaatgattatgagatagctaaagatgactattgcttgtatggaccaacatg

SEQ ID NO: 71591 - DNA, 10624 bp, Oryza sativa
ctgcctaaggacccatggttatccggttttgtaaaatgagagatgagatatatctggttctgcggttagtagcggttttgtaatacgatgagaagatgagagacctttgatgtactttttccaattgatggggacgactagacgtcgaagggctgatgaatgacataaaatcgtgaaggtctaatggcgggtgatcgcccacaacaatcacgcacccccgcccctccgctaacacgcccttctctcatttctaatgcaccatattttttttaaaaaaaacaagttagagaaaaataaaacaaaatagaaaaaatctaatactcttaaaaatatattcatatgcatagactttacacttataaatatatacattaaacttcgtacgtataaatttcatgtatagaaatatgctatataaaaaatatttaaatccgaattcgaatttgaatcgggtatataaactttttacctataagttttaggtgtgtaatctttagatgtataaattttaggtatataaaaagaaaaaaatatatggtgccaaaaaaatggtgaaaaaaaaagatcgtccgcgggcaatcgctaattagcgatctcgcataaaataggacatcatatatatctgctccgtgctagtccctccgtcccctaatatactggattttgacattttgcttactgtttgatcattcgtcttattaaaaaaaatttagaattattgtttattttatttgtgacttactttattttccaaagtactttaaacataacttttgggtttttatatttgcacaaattttttgaataagacgagtgatcaaacagtataagtaaaatatcaaaatctcttatattaggagacagatggagtagtatttttttatagtagtatgcacatgcactgagtattggctgttatttttctctcatgtaacatgcacatgcactaagtgtatgcattgctgtaatttttttctctcttccatctaattaacaaaatagtaagcaaacttcaaactatgttttaatttcttctaaactatttatcagaactgtagtttaatttgtttgcatcaatatattagttgctcaaagtataatctaacataactatatttaaataaaaaaacatctagctataactattgaaacattgcgaaatacttattggaacattaaataaataagacacgcatcatttacaaaagtaactaacggaacatctaaataatactacgtgcaacatagtccaattctaattggaacatttgctatgcttctagcaaagtggaacataaaattttagtgattgaaatatatatttatttttcacatgaatataatcaagcaagatctcattgtaaagatttaatcgcaacaaatatagcatccacaatgtagtctaaaactagtccataagcaataaaatattccactcagccataagtccatagcaagaaaatagtgaaagccacccataagcatatgggctgcccatatagaataaaactaggtgaaaccccgcgcattgctgcgggaatttagtatgataacaataaaaaaaataatgtgtaagatagctagataacatcagttaagtaaattaatgtggtttatgataatttaaatttaaatagtatgtacaatggtgattcaaacgtaaaaagtaaggtggtatgaccttatagaagaagaaaagtagggagataatttggaccgtagattaatcatctaaaggctaaaaacaattgatgtgatatgacttaattagagggaaaaggagaaagataatttggaccatagattaatcatttaagcactaactaagtgaggatgaactttataagtatataagatatcataaaacatatacattgaagtattatgtgaattatgttggatgataatttaacatgtttgtgtttgaaaagctcttaaattataaaaactataaagatatagcatgtttgcatcatgtttaaatgtgatgattgttagtggatgatgatgtggcatcttgttaattagtggatgatgatgtggcatctttgcatgttaagcttaagtagttagtgggagatatctttatagtaataggatatgttatttgtctctatttcctctctccttctaatactagttgatatctatatacattgtgaagataacaataattatagttcatatatgggtcccatctatatgggctatttttgctatatacattgtggttaccctagtagaatcatagactgtgtatgtagttttggggaaaatgattttaaaaattgtgtttaactaacacgtgcatgcaattcataaaaaagaaaatgaaaaaatccaaaaaaaatcaggcaaagtaatttcaaaaaattttaatccgaaattttgaaccttagggtctgtttggcacagttctcaaccaaacagttttagctccacctaaaataagagcggagctaggtgaagcgctatcataaaatgaactagagaggcgaaggtgattttagactgtgctacaactccactccagtcctaactcctaaagataagtttactattgcgtgctgcgtccgctcgggcacgacaacctattgcgctgctgtggtgctcgtcttatgggtcgtcaaggtagcgagaatgtaagaagagacgaatagctacaagtggcgacattatagggcgatgccagcggcggactcatgatatggtagtggacgggggatgtgtggccagaagggaaagaaggaagaagagaggcacactgatatgtggattctatgatatcacgtaggcgtcacataatcactgcataggaacaacgtaagtaagtcaacttgtcatattggtgctacgtacgccagctaaaaccgctattaaaacagctgatggacttaatttacacagattttagaagtcggaggatgaattatacccgattttacagtttaaaaacataaattagactttcttgcactgacccacaaatattaggcccacttatgtgtagttcttgaacaaacagctcagcccatttagacccatcaaaatcgcaactaatcacgacgatccgaattggaaaaaggtacaccggaggtccctcaacttgtcgttgagttacaaaatcgtccttgaaccgcaagaccagatacaacacgtcccccaacttacaaaaccagtgtaaactaggtccctcgacagttttgactccggttttatccgacgtggcagctgactcagcgtgggacccacgtgggtcccacatgtcagcttcttccccctcacctctccacctctcttcctctctcctctttttttttctcacttctctcatcaattgagagttgggcagggctgatggcgggggaggaggccggtggaggaggtgggagtccggcggccggtgatgggcgatgaggcggcggcgagtaggagggcctctccccacgccgccgccaccaccaccgccgatctgcggccatggaccgccgctcgctagtaacgcccgtcctcccacgccgccaccgccatcggggaaggaggtgggcgcgaccgtcggtggcggagcggggcgcgatcggcggggtggacccgggcctgggcatggacggcagccgccggtggaggagttgggcggcggcggcggggaagggcgggcgcggggggccgtgcagcaactgtgacatatggcaacagatttatttgctcatttcatccattcattaaaacaggatatctcaaaatcatcaagcaatatatgggcacatctccagatatgcaaactgcaaaccatcagtaagaaagtaagaagtaatgagaatctcagaatggagaacaagcatagccgcagcaaccattcggcgttcctcagttacgcatcacaaattgtttcagacatttagcatcaccaccgaagcaggtagaatgataaaaggaaaaacaggaatggaacataacaagtgttcagatccctatgtttctgtaggttattaagcaactagctcatagaagtcatatattctcatccagcactctaccatcatcagttcatcaccaaaaaaaaatcatcaaatctttcataggctgtcgcagcagagcaaaacttcctgtgcattagatcaccggtttacctccagggttggaaatttcggaccgaaatttctgaaatttcggtcatttcggtcccctccgaaacaatattaattcggccaaaatttttgaatttttcaattttttcatgaatttgggtaatatttgttcaaattcaactaaattttgttcaaaattttggaaatttcggaccgaaatttctgaaatttcaggatttcggtgacccccgatcaaaaccactaaaccgatatagtgaaccctgtttacctcttgaggcggagaaagatcaccacggcaataactgccacgacggcgccgacggccgcagctccagccatcaccggcaatgcgacaggcgctctttgtagggccccaggtgtccaagcagctaccctcttgtcctccccagaggcaggggcagcggcggccttggccctaaccctctcggcgcggcggctggtcttctcgggctctcggcggcgacggcggcgtaggacttgatgcggtgacggtgacctcgtcctccgcgacgctgctgttggggttggtcttctcggcgacgatggcaacgtaggacttggcggtcgcacccagctgctaccccgccgcccgagcccgccgcaccgtgcccagctattccggcaccgtcgcttgtgggaaagggatgagaaagaaagatacgtggagtggggaggggaagaagaggctgacatgtgggacccacgtggctctcacgctgagtcagctgctacgtcagacaaaaaccgaagtcaaaaccgccaaggaatctaatttgcactggtttcataagttagaagacgtgttgtatctggtggttttgccgttcaaggacgattttgtaactcgatgacaagttgagggacctccggtgtactttttccatccaaattagcccacctaacattgtagtgcaaaccaacatttttgcccgcttatgtgttgttttcgaataaacggtacagcccaaatgaaccggaccgctgccaatggctaatcctaatgggcgggtgatcgctccctctcctcaccagcgatcacccgcctctcctcctgtacagtacattatctcctttccccctttctcctcccttcttctctttctactacaccataaatatttgaattcaaatttaaatttaaaaatgggtatgtaaattttttacttatgaactttgggtctataaactaatatttaaatttgaattcaaattcaaatttgaaatgggtatgtaaacttttgacctataaactttgggtctataaactattatttgaatttaaattcaaatttggaacgggtatgtaaactttttatttataaactttgggtctataaactattataaactattatttgaactcaaattcaaatttgaaacggatatataaactttaggtctataaactttagatgtatagaaatactatatataaaaaaataattgaattcaaattcaaatttgaatcggatatataaacttttgacttataaaatttaggtctataaactttaggtgtataaactttagatgtatagaaatactatagataaaaaatatttgaattcaaattcaaatttgaatcggatgtataaacttttgacttataaattttaggtgtataaactttagatgtatagaaatactttataaaatatatttgaattcaaattcaaatttgaatcggatatataaacttttgacttataaactttgggtctctaaactttaaatgtgtaaacttgaggtgtttaaactttaggtgcataaacttactaaaataggaaagtaatgcggtgccaaaaaaggaaaccaggtggagggagggggggaggggtttatcgctaacccaccgccaggcgagcgatcgcctattagcctttccggctgcgaatttcctcacattaacatagaacaacttattcaaaatttatctcatacaatataattttaactacaaacattgtctaatttattccactactttcctattttaacaatatttcacctttcttgttaatttctcttttataagtgggtgagaaagaagaaaggaaaattaaggaatctataatatactacctcagtctcacgaattaaagccgtgaacaccttctgttttcctttttcttgatgttgatgtagttgcactagcaccggcctcctccttgatttacctgcacaggagtgaattgcacaccacccgagaagcaaaagattcgagagtcaaggtggaaaagataagcatagtggtataattaatgacaagggccgacgaaaccccttcaagtgcatttgagatcaattgggctctctttagagttttgggaattaacataggaaaaaatcgtcctctctccctaacgcatcctcctctttttatttacactggtgggacttaagggtaacccagataagactaagttaatttcttactaccgatcacagtaatattttatctctctttttttttgggaagtaaactagtggaattatctcctccataattgtatcgacagtggactaaaaaatcaaccaatattcaccttttgattttgaggctaactgatgagtctactaaataaaacagctccataaggtgacatgtcacagcaacatcggacgtctctgagacccagtcttaatttagcggctgctaattgaaacttatgccccttcattgaaaatatcagtcaaggctctaacttatacatatcccggttagaacataatcttaattaaacttaatttacgagcctttagcatatgcctctacgatcaaacgcttagcataataatttgatcctgggacatatatacctttcatagtaactagctgccctggctctaattagtgaatagaatgtgctccacgatacaaagctctcagcagatcgatcaattaaatctaagaatttcagttactaattaagtttaacgtagtttttaatcgatcagctgctagtactttgcatgattgcatccaattaagctctagataagaccacgtacacaatagaattttatctttctttttcacaagaccaagctgctactccagttagtaggagtatttatttatcgtcgacgtaggttatcccacttggccggccggctgtcggtcgccagcaggtggctttcaaaaattgaagccgacgatccatatgttcatgtcattctcgatctacctgccaaccgttactcgatttttattaaattttttggacttgtttatttttttaattttattaatagacattttcaaaggaatgtttctgaaaactaaacctttgtaccacgccagcagtgttgttttgccactccacgtggcgtggcaagaggctggctgccacgacagctgcgtgtagcatgacaaagttatttggccacaccagacgggctgtcgtggccaaaaagtttggattcgaaaatactttttgaaaaggtctattaacaaaatcaaaacataaaaaagtctaaaaaaataaaaaaatttcccgttactcgtcctcctaggtattaatgctgcgagccggcctcacgatgccacgtacagcaacccatggccaacatctatatggacgttagacaaattaaagagacgatctgttcatgttggtgttttcgatcaggcttgtatgatagagcactattcccttagaaataatatagagagtttgcatacttctatttttgtcaagaaaaaaaaagaattggacgtcacacgctcacatagcactagcaatctaagtcgcgccttcgcgcgaccataacccgtcttttatttccgaatatgataatatactgtttgtaataattacatttgttaaattttaattggtctatttgcatatttgaattctattatttaatttttttatgaattgaactttgaagagtatttggctcaatgtttgagcaattaggttgagatataattttggattatgactataagtttgtttatctatttgttagttacgtatatttttgtaggtggtagatattttttatcttacctatttattcatgattgttttaatgaacggcacatccgataattttaaatttactaaattatttagttgtgaatgtaggatttgttgtaattctgttgacataaaatccatagaacacacattattctgtatgtttattaggttactttgtggctatgtaaagatatatcgagaattactttttatatgtgtggtgttttcactttatatggatttgatttcaccatatttattcatggttataaattgaatttatgaacaaattgagacagtaatggaggtgtaagtggtggccaggaatcgaaagaccgacacttttgatgtgggcccagaaaatgcattcaatttgaaagaagaatcaactaaatataagtttcacattttgatagtaaaggagtttattttgtttttattctaaacttgtctcatgtgcacggagaaaagaggatggaattgatttggccttgcagtattcttagagttaggagaggttgtctaagatactctagaacattcacacattttccttgggatgttctctacggtactctagaacattcctactccctccgtcaaaaaaaaacaaaccatggtttccgtgtccaacgtttaaccgtccgtcttatttgaaaaaattatgaaaaaaattaaaaagataagtcacgcataaaatattaatcatgttttattatctaacaacaatgaaaatacgaattataaaaaaattcatataagacggacagttaaagttggacacagaaatctaagatttgcctttattttttggacggagggagtacattttttacaactatacttaagtttcatccaatcgtaaagattgattcgacttattttgtctttaagtgcatccgacggttaatacttgttagatgacatggcatatcctggtttctttgtgagatttagttttcacatagagatatcaatgtgctaggcataaataacatgttataaagatagaaaacaatctatttggaaagaaaggggaactgaaccacataaacgatccatttgagtattattctttcagcgcgttcctctagacgaaaacaaacatcattgactagtacagattctctcatctgtgacggcccatcacatgcctgggcaatatgggccgtcagaatgaagtcatctcaattgagcctaaattaataccgttgtagatgtactcgtacatatataagcaaggtgcatataactatagcccgtcaccgatgacactcatcagtgacgggctcacagttaggcccgattgagattactacctatatctcaatcgggcataattactaggcccaacaaaggcccgattgagatggccttactgccagtcaccgatgactcttgttagtgtcgggcttctatttatgcccgttagagatagcgcccgttacagaagtcgtatttttggcccgattgagatatattttgcacactatatatactccaccagtctattatctgtagttatcccactgtgcactattctggtgggaggttgaagggtgcgattttttgtaatttttttccaaagaagaacaggaaaatcataaaagtaagtaaaagggtactaatcatttcttattaatttagtagtacttatcttataagatgttaactatttcatccgtttcatattataagactttctagcatttcccacatttatatatatgttaatgaatctagacatatatgtgtgcctagattcattaatatctatatgaatgtggacaatgctagaaagtcttataacctgaaacagaggcagtaatattttgttcatttttcaaccatggatcgaagttggatgtatatgacttctttgaagcagcagtataaggaatttgtttttgattattattctgtgatgaataattggcattggagattattggttttgatatttggaatttattttcaaagtggttttggagatgattggaattttacaggtgatctacaggtgctgctgttttgggaccggtcagaccaggcaagttttgccggtcagaccggcgtgtatcgcgcggtcagaccggcacagcccgcggtctgaccagccgacgctgtgtcggtttcgatttcaggttgtttgtttggatatccatgattgtttcatgaatatgacttctagatggatactatgcatatgtaatactgttatttgctactaatgagtcaagttggggatagcttggtcttggaatatggtttctttgtttgttccatgtgtaggtgaattgatgccgggagagtatttgcggtgatggaccgggagtcggcttggggataagacgatgtccagattggtcagagatcatggtggatactaaggctagagttcaatgcacgtggaaggtgaaggttccatatggcataggatgcggagttgaatttggaaggagtccaatttggtggaattggttatgtaaagattgtttcttg

SEQ ID NO: 71592 - DNA, 5506 bp, Oryza sativa
ctagtatgagtttggttcgtggctttaggctgcctacctcgggtataaatagagagcgagcgtgaggcttcctagtatcgcttttgagagcaattgagttgatagtttagttagggtttcgagtttagtcgaaatttttgtaaggagtgctgttggtgcactttgtaaacacagagagaatcaataaagtcgtcatccactttaagagttcttcggtttgtgttttctcgggtgcggcggtccaacctgcaggacaccagcggtcagaccggcgacataagggcggtcagaccggcagcggcagccaggcagcagcaggtgatttcggcggttcgaccgatcgatctacatcggtcagaccgacttttactaggcggctataccggcgcatacgcttcggtcagaccgcgatccatcgaatttgagggtaacttttatttccgctaaaatttttggtttttgggtataccaaccattcacccccctctggttggcttagttattatgattcgatcctacaagtgatatcagagccttgttttcttctttggattttaaccgatccaaagtttttgcaatggctaaaaagttttcaactaagcctcatgttttcgatggtactgattttgcttattggtgtgataagatgcaatcttatattatggctgaagattatgatgcttggcaaaaggttgcacaaccatatgtgattcctgaacagattgacactattgctttgaaaaccgagtctaataacaattgaaaagctcgcaatattcttttgagtggaatttctcgttcggattttgatcgtgtttcacatcttaaaactgctcatgagatttggaatgctttgaaaaactttcaccaaggaactactaatattaaagagcttcgtcaagatcttttcaaaaaggagtacataaaatttgagatgaaaccaggagaagctttggatgattatcttggtagatataataaaattttgagtgatcttagatctgttgattcttcttatgatgttaattatacacaatatgaggtttctcgccactttttgaatggtcttgacatgtctatttgggagatgaaagttacatctattcaggagtctgttgacatgtctactttgactttggattcgctttacacaaaactgaaaacacatgagatgaatattctttctcgtaaagttgattctaagttgagtgctttggtttcttcctcaacttctttggatgttgattcttcttcatcgaagtcttctgcatttgctttgtttaatgtcatgtccgatgatcaactcgaacagttcgaggaggacttggttttgttaactaacagactttcttgagctgtaactaatgtgaggtacatgaaaagaggtggaccaaatcgttgatttgaatgtggtgctacggatcacttttgttcgcattgtcctatgcttgggagaaataggatggaagataagggtgatgagaagaccaacgacaacaagccgaatagtatagttaaaggagggaagaagatcagggagactctcaagaaggcttttgatcaagtctatgccccgtttgggccactaagcgatgtagatgatgagagtggagatgaagataagggaaagaacatctccggtgtttgcttcatgccgcgtggtgaatcggatttagagtgtgaagacaatgaggtacatacttttgaggatgctattcttattttaagagagaaaaataagaagtgcgagaagatgtatagaaaataggagtttatcattgaatctcttaattctgaaattgctagattaaaatctcttattcctaatgatgatgattgcaaaagttgtgaggttttaatgaatgagatttcaaaaattagagatgtcaatgctgcacatgatttgaaaataaatcttctcaagctcttggatttgctttgcacacacgcactttggatgagttgtttttgactaaaaagttgttgcaaaaatattaaattgattttcatgctagtttgatgtttaacaacctcatgatgttttggattgctcaacacgcacattaaataagatgaaactaaaagaagcttatagtacatggaagatgttgtgaaaaccaataaaatgttttcttgccccaaatgtcgtaaaagcaaaggtgttatggtagattgtcaaaattgcgctaatttggaaaatgagtttcttatttgaaaagttatttgcaaagattttctggaggtaagaaacaacttaacatgattttggatcagtctagagtgactagttacaataggggtgttggttttagtgttcatgattatttcaccaaaaatcaaccaaatgttttgagtataactgaacgtggtaaaattttgacaaaacctaatgaaaagaaaattgtttttaaatctgctagaattttgccttctctttctgcaactctaaaagaaacaaaaacaaatctttcaaaaccatcttcttctaaagaaaagtatacttgttctttttggcaaagatggacatattgttggtttttgtttcaggttagctcataaacagaaaaaggagagagagattgcttttgcaaaatcgaagtggcaaaaatctggttttccctcaaggaaactggtcagaccgtagtggatcccacggtcggaccggcgaccggtcagaccggcagcagcgcctcggtcagaccggcccctggtcagaccagctcctatgttgcggtcagaccggccttggagaaattttttgaaaagttctcaaactatttttgcacgtggatatatgcctattggatcttctggtcgtgtgtctcagtactggattcctacatttttattatcatctaacctcagtactatggcttcgacttctgcttgtgtgtagactttggtggcgaggaaggagagcatgtggatcatggattccggttgttcgcggcacatgactggtgataaaaattggttctcctccctcaaacgggcatccaagactgaatcgattatctttggtgatgcttctactagtgccgttctcgctacaggtttggttaaggtaaatgagaaatttgaattaaagaatgtagcttttagtttcacaaattgttgatgaaaattttgaggttcactttaagaaaactggaagtaaagtttttgattcttgtggtgattctgtgttgaatatttctcactatggaagagtgtttaaagttgattttgataattcagtttcacctgtgataacatgtttggttgctaagtttgataaagatgtaatgttttggcatcgtagacttggacatgttggttttgatcatctcactaggttaagtggtttggatcttgttcgtggtttgcctaaacttaagaaagatcttgatttggtttgtacaccatgtcgtcacgctaagatggttgctacttcacatgctcctattatttctatgatgacggatgcgccgggacagctattacatatggacactgttggtctagctagagtgcaatccgttggaggaaagtagtatgtgttggttattgttgacgatttttctcgatattcttgggttttctttatggcaactaaggatgaggcttttcaacactttcgtagtttgtttcttcgattggatcttgaattatctggttctttgaaaagaattcgaagtgataatggtggtgaatttaaaaatacttcatttgaacaattttacaatgaaagaggttttgaacatgaattttcttctcctcgtgttccgcaacaaaacagtgttgttgaaagaaagaatcgtgttttggttgagatggctggaacgatgttggatgagtatcacactcctagaaaattttgggctaaggcagttaacaccgcatgctatatttcaaatcgggttttcttgagatcaaaacttggaaaaacttcttatgagcttcaatttgaacgtcaacccaaagtttcacatttgcgtgttttttattgcaaatgctttgtcttgaaatttaaataagtttgaggcacgctctaccgatggaatgtttcttggttaccccacacactctcatggctatcgtgtacttattttggagactaacaaaatcgttgagacttgcaaagttttttttgatgaggctagtccaggtactagacccgatattgcaggtacattgtcacaggttcaggggaggatggtcgtatttttgaagacgagagcgacgacgacgacgacggcgaggtcggctcggccggtcagaccaggcgctagtccggtcagaccgccggcacacctccggtcaaactggcgcaggacgtgcggtctgaccgaccagggtcgtcggctgagggttctgttgatactattcgggatggtcctccagagattacaaattcgaccagtgagggtacagaacgtgaaacaacttcagaagtcgctgctactttgcacattcaacgatgacatccgccggaacaaattattggtaatataggtgagcggactactaggtctatggtaacgactcatgatgtttgtgcaaattttgtatttgttgcttcttttgaatccaaagatgtgtcatatgcattaactgatgaatcgtggattaacgtcatgcatgaggaacttgaaaattttgagagaaacaaagtttggactttagttgaaccaccttctgggcataatattattggaaccaagtgagttttcaaaaataaacaaaatgaggatggtttgattgtgagaaataaagctagacttgttgctcaatgttttacctaggtggagggtttggagtttgatgaaacttttggtcctgttgctagaattgaagcaattagacttttgttgacttttgctcaaggttttgaagcaatcagaccggcgcagaccgcggtagttcaagtgaattgtcgtagtgtaaggaagattgattagttttctgaccgaccgacgctgtgtcggtttcggtttccggttgtttgtttggatatccgtgattgtttcatgaatatgacttctagatggatactatatgtatgtaatactgttgtttgctactaatgagacaacttggggatagcttggtctcggaatcatagttattgagaccggaccagtaatcgaactagtgaggctctcggttcaatggttcactggttcaaccagttgaactgtcagtctaaaccagttcaatacatgttaaatatattaatcattctatcctaacacaagcaacctggtagcctggtggtggggggagttaactcccacacatgtggtcgtgggttcgaatcccacccaggcatattttcgctcgtttttcctcccatgcacgcacgcttcgtcccttcctcttcccatcccacgtgcgcttcaccacgagcccggctcggaatatggtttctttgtatgccgggagagtatttgcggtgacggacctactcccatgcatgcacgcttcgtcccttcctcttcccatcccacgtgcgcttcggcgcgag

SEQ ID NO: 71593 - DNA, 5659 bp, Oryza sativa
gggggagggggagtgggaggagcccggcccgggggggtgggcctcgtcggcgccgttcacaccttccggccagctggcgaggccggacagcggcacgctggggcggcggtggaggcggcgcgctcgcgctagggagagtggcgatgtgaggaggaatcgggagatgaggtgatgttttagggtttggttgcctgcacgaatcttaaagcaatcggatggtctaaaatttgcaagatttctaagggggttttctatcaaatgatctatagacagtcccaaaaaaaaaaaaaagagtgtccatcagtcctaatcccaaattttcaaatgaagcctctggagtcttgactggctcttatgaggcgtggctttttattttaatttttatagggttgatatgataggtaaatataataggtacggttggatactgctcgattaggcatggctcatcaaacagaccgtgccctgttggcctacatgctttaggttggagctcaggcatgacctagtgagatgttgagttatgtcatttggcctgacacgatgtcacaccctgaaaattcaaaatatataaattgttgtttaaatggaattttttagaatttattttttaaaagtcttgaagagaagatctaattttaattaataaattccaatataaaatggggccagataaaatttcattaaatactttgcttaattctataattcctagatttttctgggatttatttgagctaaggaagtatttttaaaaaatggaattgcatttaagaaataatttaaattgaaaaaggttttaaaagtcttcttttggctttgggccgaaagtcggcccaaaacctctcttctctctctcctcggcccagccggcccagtccgccgcgcgcgcgcgtccgcccgctgacaggtggggcccgcctgtcaggtcgtcgtcttcctcgcgtcggccgccgcccggaaccctagcgcgccgccgccgccgttcccttccaaatccggccgctcctttccttctccggccgaattgatagaggggaaatgatcctcgggatctcctctaccttttctcctttggaaacatcggctaaatcggtttggaatgtgtttgattcgagttcgaatcagatcggtctctttccttcaaaccccgatctttccttctcgtcgccggccgccgtgggccttcgccgccgcctcctagcccctttaaaaggctccccggtgtctcctctacccgccgccaccctcgccttcgcctctcgtcgtcggaagcgccctagcgccgtgtgccctagcgccgccgtcgccgccgtcgctccagccgtgcgccgccgccgttccagtcgtcgccgtcgctcgggaaggtcgtcatcgtggtcgccaagtcgccgccgtcctcgtccgccgcttcgccaccgtcggagaccgccggagcatcgtcgccgtcgtcaagccgaagaccgccgccgtttcaacctcgtcgccgtcgccgtccgttggtcttccgccgtcgctttggtcgccggtgagttcgccgcgtcgcgctctacccgttggtgccctccgttcgtgccgaagcgccgccgttcgccggcgagcatgcgcgcccgagccgccgagccgccgccgccggtggtgacgtcaccgctgacgtcatcgggaccgtccgccgtgagccggtcgtggaccaatcgatctcggccgtccgttttggatcaagtcgatctcggccgtccgttcgcgtgaaccgccgccgtgcgcccggtccaccgcaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgcttttgctcttttctgcttagattccgtcgtttccggagagtccgttttcgccggagaagagtttgaagagttccaaggccagcaaggcaagtcacacagatcccaaacaactctttgagcatgttgatcccgtttaaagctattgtttcttttcaactattgcatttattttcgaatgtcattgggtggaattaacctattgtttgttatggcccttttgttcttgattaccttattccttgataccttgggttattataacttgactggttgagctctatatattggttcaactagatattagatataattgcttagccctgcttagaaacattagcacactattgggataacttatgactcactattatttaatgatggcttaatgatagttcacgatggtcaatcgtgattagttaattaattcatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtagtacacctctgatcagagtaaaactattcgaatagccgtgcccgcggttatgggcgggtctaacaatgtctttcgtgattagtctcacacttctcaccatagtaaatgatgctataattggtaataatttgtttagctcctggtttggaatggtacattcctggtttggagatagaactgtgcagccgggatggttgttcagaatggttgggcctatacaacagggtatgttgtatagcgttggattaatattgtttaatacttaactgttttactaaattctcaaatgtttgctaaatgctgcttttgcgaatgcaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatctttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacacacgattaggttacgttggctacgtggaggttggttagcccaaatttgatatataccaagaaaaaaatgtgaacatagtctgttgcatcctgctgcacaaacttcgatgaagctttagcgaggctctccgctcaccgatagcacattcctcttcctcatcaagaaccaccatggcccttcacttcctacttccttcgtcccgagccggtgagctcccaattgctgacatgcttagtggttgtgctcgtgaatagggttggccacaccacaatgctactatgcaggcctacgccaatgagcgttcatcattacttcctctttcctgatcccctagcttcctcgattctttagttctcatttccccctatctcctgctcgcgacatgcacttgtcgtgttggcatgctgggccggtaacaacccaagcacaacgtggctagatgggctatgccaacacaacccacagctaaatgaaatgtgttgttcttgggctgtgagttgcacatgcgtgcctgggtggacacagaaagacccaacacatttgacaacatataggaggatttggtaaacgcataaccattcttatgtttctacgtatgagatcaattaagacacctcagtcgcacctaattaatttgattagtgtcaaattaaaggaaaactattctttaaagatgttctcttccattatactccctccatctacttttgattgtcatatttccaaatctgaaaaatttatttttgattggcatatttcaattcaacaacctatcatcttaattactttctcggatttaatgcatgactctccatttttccacacaagattggctacatggatattgagaaatgtaaatattaatgaatcgcttgtttatgagggatgattagtagcatgtttaaatgaatgataagtagaattacttatccttggtctgtgtgtcaagatgaaatatgactattaaaagtagatggagggagtagcgattacgctccaactaacactaaaaaaataacactctttttcccaaaataacatgcaagcacaatataatctagaaaacatatccattttcttcttgtttttattagatcaatttcaactatgtgtccagaggcaaaaaaattatttcaatacgtggaatgaggttaaacagatctcatgcatatatacacatttgtgttgcttatctcgttggtgaaaagaaaaaatattgtctccctaaataaacacttgtcaagaaataaggtttattccacaagctatatacaaccttgctatcttaaccatccaaccattacaaaggcactggagagcctatttggtagtaataatttacggtgttaacatatcacaagataaaaaaaaagaacaggataaaagaaaaggaagacccaaggcaacaacagaaagttaaaagctacaaagacaaactaataacgaaaaggatgcgacatctcatcacccccacaactaccacaaagtacaaacatgcacaaaaacaccctcttgccggcaacagcaaagcttgaactcaacatcttatcagctcttctgcaagtcacagctggcatgggcttgcttcacctgcttggtgtactcgtcctcgctatcgccttcctcgccctcctcctcatccctgtctccctcgtcgtcgtcgggattcttaccgtcctcctgctcttcttcctcggtccaaccgaaaccggccactggagtcgacgatggaggtggtgtctttgcctcttgtacaatcttcatgatctcgtcgacggtctgatccgagaatgtacgggcactgttgtccttcttgtagtacttcgcttgcgccgcttctgtaagctcccgcggcaagttcttcataaaccaagggtggtttctgatctctcttattgttattctctgcatgacatggtggaaatggtattatgttaaatggaacataatggaacatggattgaagttccgcgaggttcacctttgcaggattcgcgacaaagattcgagagaggagttgtctacaatcttgggatatatggacgtactctggtattttgtactgaattgatacgattctctgcaaaataaaaatgtgagcataatatatttgtacattcgtgtggcgtttgaagttgga

SEQ ID NO: 71594 - DNA, 1831 bp, Oryza sativa
taatacatgttaccttgtattctaataaaccaccaagctaggggattctcaagaaataaattttttcttggctgctacacccgccaaggaaaatcttcgaaaaacttgatatatattaatccgtacatggtctttgttttaattttttatttaaaaataatcaatggatgcacctctgctcagtgctcaccctgtatcgtggacgtaggttgtcctgacggcgaaagacgacgtgcaccaagatttgacggaactcatcctactcctcccccctccccgttgccacacatgccaagtaataagctccttactgatcttaattatatatcttgactgtcagattatacagatgaccacattatcttgaatttttaggagctgcagcatgtactgtacatggaactaaatttgtttaacttttgttgcttcataggacctggagtacgtggacgccaatattggagcagacccaagaacctgacaagagggagccggctatagttacttcgatcggttttacttaacaataaaatggaaaacgtacctgcagccctgcaggagcatggagtatttccataccacgaagcagatctatacgtgtcataatgggtgttgcaaaaatctttttcttcagtttgtatgtgtgtgtatcttacgaggaattaatggattctaatctttaaggatgttcactcatgcatttttttaaaaaatccactacaaatagtcctgaaaaattatgataatgtaaaatatagtgacatctatcggtacaaaagaagtcaattttaaattcgatctatacattgagaagaaaaaaaaaagataaattcagatgtgaacaatacgctaatattcaatcatacattgaatttgtctttatatatatgtatatatatatcttcacatgtagtttggacctaagattttgtgaaagtggtatatttatatatgttgtatgactgttatccagtttttcaagaatttttgtaactgtctagatgggttttaaacaaacgatgggacatcctttgagatatcaaaataatgtccccaccctgcacccttgctcactcctttctcaattgtagcacctaagcttgttttctcttcttttacttcacatatatcactactgaaaaataggggaaaaacaacactatatgagtcgccaagtccacaaccgatacctatcgacgtttgatatcacgactacggtatttggacagtatggagatagtcggtaccatggtatatgcgagattgaggtaaaagagatggagacatgaatttttatacaggttcgggccccttatctgacaggtaatagccctacatcatgttggccgaagccgatatgctctttattaatctggaccacacaagtacaatatttgggataacctatctgactgtcgtcgacttggcggcatggataatcagctcatagtcaatgacagagtagtcttcctcctcaaatataaacccgtcgagatcagaaatggcgctagattcctcttgccaaccttcacaggcaccggatggggtatatctaggctaatctctaatatcgagatctggcggcgtgtgttggcttgtgtatatgttgtgtcttgttgatcttgtggcttgtcccctctcctcctaggggggcttgtatttatacccataggtgcccccttgtccaagtaaaactagggagaccaatatggatacaatccgattagtccttatcttttccatatagaactctactcatcattccttatctggaactcctatacacgaggtttgtttccgtataagacatggtatatggtgggccctgccg

SEQ ID NO: 71595 - DNA, 5477 bp, Oryza sativa
  unsure (1)..(5477): unsure at all n locations
cgagcgtgaggctcccggtatcgcttttgagagcaattgagttgatagttgagttagggtttcaagttagtcgaaatttttgtaaggagtgctgttggtgtactttgtaaacacaaaaagaatcaataaagtcgtcatccactttaagagttctttggtttgtgttttctcgggtgcggcagtccaaccggcaggacaccaatggtcagaccggcggcatcgcagcagtcagaccggcggcgtaagggcggtcagaccggcggcggcaggcaggcagtaggaggtgattttggcggttcgaccgatcgatctacatcggtcagaccgacgtttacaaggcggtcagaccggcgcatacactttggtcagaccgtgattcgccaaatttgagggtaacttttatttccgctaaaagttttggtttttgggtataccaaccattcacccccctctggttggcttagttattgtgattcgatcctacaaatctttcctccctcaatagccaattggatatgttgcctgaagactttgcaaccattagtagcatgagaactagaattatgccacttaaagcacccgcaatggtaaagtaatgtgctatctataagacatgtacatctcagcaatagactacattggtatctatagctctctaatccattgcctcgtttttctctatagactatctccaggttagtagatagctttgctctctctcttcatttaatctcttccaagtaggaaaatatgctaacatggatctcttgtagagagcctatagataaccattgcgggtgcccttatagtatttcttcttccctaactcctcagccgatggaattatgtgactagcaggaagttggatctgtttctccagaagtagtaaatcaaaaatcttatcaaccttggtgatatcaaagtcatatctttcttcttttccagaattctttacccattgacatggcacaacctttttactcctcacccactcagctgctgctacctcaaagtcatcttcctcttcagaatcatacatatagggatacgcttgattgactttcttgaaattcttcttagcctctgcaaacctctgctcatgtagagtcaccttttgcgccagatgagacaagctctcaaagtcttgagatgagaactctttaatcggagttatcaaaccttggaaagcaagatcggctaactgtagcatctattcctcatatctctgaaccttggatgtaatcttgcacagtttcatcatgcctttgtattgatgtcaaatcagaaagcttcatctcatgggtcccgctgtagaagtaactatgaaactgcttctccaaatgggccccaccgcattctctgctcccacctaccattgccacaaatcacccacatattttagaaaccctctattaatggaatttggtttattctttgttccaccagaaatgtttcacctagtgtactgacaatgtttcaatatgtatagatataatattacagtgaactgaaatattgcattgcaacaaaaaacccacatattttggaaaacccctattataatagggaattcgtttcattttttgttccaccgaaaaatgtttcacctagtgtacttataatgtttcactatatatggatcaaatattgcaatgaactgaaacagtctttcactatttactgaaacattgtttttatataaggtgaaacaacacccgatttaaacgagtgaaacattttcgatctactaagtgaaacaattccgatatacctggtggaacatcatgcaacatttaaaaataatttaataataagctaattttttttcgtcagaatatatccatgtgtggtcttgttttgaagatttaattgcaatgaatttaatggttcaatcagatcatgatttagataagtaatttaagagaaaaatcaatttaaagtagttttgcacgtaaatcgggcgttgacgtcatgctgtcatcagcgcccgatttttctccaaaccgatcaggcgcccgacccgtagactcgagaatgacagggatcggtctactagcggggggagcaaaaatcggacgctccccctgccccctgcaccctgcagcttngncnancncnnctgnncacgcgtgcatgccacctgggccccaccacagtccctggctccctgcccccctgcaataaaatcacccacatattttggaaaccctctattaagggaatttagtttattttttgttcatagtgtactcacaatgtttcgtatagatccaatgttgcagtgaactgaaatattccattgcaacaaaaaaacccacatattttggaaacccctattaagggaattcgtttcatttttttttctaccgaaaaatgtttcacctagtgcaattataatgtttcactatgtatgaatcaaatgttgcagtgaactgaaatattctttcgctatttgctgaaacattgtttttatataaggtgaaacaacacccgatttaaacgagtgaaacattttcgatctacttagtgaaacaattccggtatatctggtggaacatcatgcaacatttaaaaataattcaataataagctaattttttttcgtcggaatatatcactgtgtgatctttttttgaagatttaattgtaacgaatttaatggtgcaatcggatcatgatttggataagtattttaagagaaaaatcagtttaaagtagttttgcacgtaaatcggacactgacgtcatgcccgattttaacctcctcccttcggtcatccaagccggagtcacgtccagttttgataatgtgagaagagatgaaatgggttccatctggatatataaaaccatgtgtacaaggtttccaattgaacttatgtccagcatgttaatacctacgaaacaataaaataaaggaatgcatgctttatgtgctatttcaactatatatgaactataaacataacaatgaacaaaacttgcacactagctataatagggaaataaaaaggataaaggtagcaatgacaagctttcaacactacaaatgccaaaaattaatttgcacggattttgttgccatctccaccgatgttatatgcaattggggaaaaaagcgctcaccaaagtgagtactcacctatgttatgcactatatagtccggagtagtatgtaatacggaacccgacataatcatcatatgcgtactctttatcagaggtggtaaactaaagcagtatttaggaatcccacatctccaacagatgatcaatatctgacgtcgatccgggtgcaccgacagcaccgtaccgacgcctgaagggaggaggccacacgatgacgtggaacaatggagagaagccgcgcataccgccgcggcggcggcggcggcgacggcaaatgaggccgtgccgtcgtcggctaccaccgagcagcaggaggcgcgtccggatgatgagcgggcgccaaaggatcacaccggctgcgaatgcaagcccaaggtggtaatgctcccggagctactacgagccgccagtcatggcgatctccagaggctgcgcgttctcctaggtgtcctacacgacgatgagtcgccggcaccgacgacgacgacgacgacgaccagccaagacgacgacgctgtcgtcctggaggtttatcgctctgcacccctactaccaccaccctctactactgcaggtgaaggtgaagatgaagggacgttgtccctcctggagggaaccacgtttcagggggactccgcgctgcatgtggtggcgagcagcggagacgacggcgacttcttgaagagcgcaaggctgatctatggcaaggccaggcacctcctcgaggcgaccaacaacaatggcgatacgcccctccactgcgctgccagagctgggaatgttaagatggtcacgcatctcctcgagctggctggaggcgatggcgccggcgatcaacggaagaagctgatcctgaggaaaaaaaaccaccagcatgagacggtgttgcacgaggcagtccgcctcggcaacaaagatttgatcgacaagctgatgacggaagatccagagctagctcgtcatccaagcaacggcgccacttcaccgttgtatctggctgtgatcttgccaaatccacaagttgcgatgcagctgcatgggtatgataaaatgctgtcctactcgggacctgacggacaaaatgtcttgcacgctgctgttcttcgacaaagaggtacgtaattcacaaataccttgtgcgtgtactgtttgatcccacaatatataataacaaatgcatatatggttcgattcacagtacttctttcttttttggccttttgatcctggcatatttcttctttctatcaacttcagttttcactctatatatgtttcaagtagtatttcaatttgtctattacgcatgccaccagggttagcaatctccaattacgatttttgcctggggtggctgaaagaaccgaatttttttgtacttttttggccaattttttttgaaacttggatgaatttgaataaaatttgatcaaattcatagaaaatggaaaaaaacaaaaaattcaggcaaggtatgtgcttgccgatgggggcgaaattacagaaattttggaattaattttgttccgaaaaattgcaatcactgcatgccacataatacagtactattcatatatcaagagggaaaaaaaaagttaaaccaacttacaatttggaacggaggttccaaattagagaaaggaaatgacaaagtgatatctctagcatgtaagttttgtgattgaaatatacacttgaattgtacaacaactttcagatctcatttatgtggatataagtaattggaaactggaataatacaatacacatatgtaatttagtcaatatatatagagacatgtttgaagcaagcaagggtcaatataggacaaaatatattatatagtcaatataattttgagtaaatttcaaattgatcaaattgtcacaaaactgtatattttaaatgatctactctctccgtcccaaaatataagtttttttagaccttggcacggtcttcgagatgctactttgaccaacaaatatctacaaaagtaaattattttaaataaaaagagttgcatattataatagttcgtttaacaataaatatagtagcatcaaatttacatgattaatctttttttatccttttgctattagtagttaaaaattaaaatgtttgatttggcactattctaaaaatgcttatattttgcgacagagggagtattacaaagctacttatattacaaaactacaaatttaagatggatcatcgcaaaactatagaattaataataaagttataataaaactacaagtctagtgccatttaaccacaaaactacaaagtatataaactcctatctaacagcagcactgttagggatttaaactctaaa

SEQ ID NO: 71596 - DNA, 5027 bp, Oryza sativa
ggcgtatgtaaacttctatgttgtggcttctatgtcgattgtgttgggtgttgatcctgtcgattgtctcgttgtgggtgtccccctgtcctcctaggggggcttgtatttatacccataggtgtccccttatcaaagtagaactagggaaaccaatatggatacaatccgagtagtccttgtcgttttcatgtagaactctagttgtctttccttatccggaactccctccatatctgaagtcgatttccgtataggacatggcatgtggtgggtcctgccgagatgtaatcaactactattaggtatgtggtatccataaccatgacagtagcccccgacttcgatgcaaatgaacgaattcctattctcaaccgcgcacaggcattggagtaactgttatcaagctcatgtgactgttctcggtgagtttagagataacgttagacttcctttgtcagccccgtgcaggcaccgaaagggtttgtctaagtcaatctctgatgtcaaccgaaaaagtacagagcgtacgactaagtctcccgtcttgctgtagtcgagaatttggattgaagtcaagaaattttatctcggcgggtacaccatctcttcattccgtattccttgtcgagatccagcaaccgttcccgagcgatcgagaaggcgtagagtctgcgacggagccttgtcgacattggtcgtacttgccttagtcgatcttggtgtagaaccatagagacatggagtcttcatcaatgtcgaataggattttcctgaaatcaatactcagaaaagaatatcaaatagaaatagcccccgagcgaatgctcaaagcgtgacatgttataatatgtatggtaaattgaaaatgaattaaatttaccgaccaatgttttgtgtaagagtgtcttctcagttcacgactttggtcagtcgtttgagttgtacactctctctagcccccagccttgtcgtcggagaatcgttctcggaggagaaggctcttggacccttgacctgccttggttgaataagcattgatcctagcccccagccgtgaagttggaaaagtcaattttccgattacacggcttggttaatacgcacggcgaaaactcttacacaaccagatcttacatggtctttcgtctctgaaggatccgacaaggccttatcggctctgggcgtccccagtcgaagatcccttaggttcctcggaggccttgtcaagacggcgtaaagggacagcaggataggtttcaacgctaggtgtcgtcgtggtaagggatctctgggtaaaacacttggcgatattgtgtacctgctaccaactttattgaagtagaggtagtgggagaaatcggtacatcgctggtcgaggaacaggcagtagccgcaacttgaccactgaaagtggaagtagtcggagaaacgctacatcgctggtcgaggaccaggcaatagccgtaactcgaccactgaaagtggaagtagtcggagaaacgctacatcgctggtcgaggaccaggcagtagccgtaactcgaccactgaaagtggaagtagtcggaggagtaaccgtaactcgaccactgaaagtggaagtagtcggaggaacactgcatcgctggtcgaggaccaggcagtagccgtaactcgaccacttgaagcaaatgtacgagagatcactacgatcaactggttgagaaccggtgagtaggtgtccctcgatcacttggagtcgtggtaagaggaccgctacgctgctgtagtcgtaccttgaccatctgaagtaaaggtgcgagagattgctacgtactagtgcgagaaccagtgagcgagcagaattatctctcgaacaccgatggaaggtgcggtgcgagagattgctgcgtactggtgcgagaaccagtgagcgagcagaattatctctcgaacaccaatggaagttgcggtgtgagagattgctgcgtactggtgtgagaaccagtgagggagcggaattatctctcgaacaccgatggaagttgcagtgtgagagattgctgcatactggagcgagaaccagcgtgcgagtagagttatctctcggacaccgatggaagttctatctcaaccttaatatttaataaataaactaggtagaaatcttatattttaaaatagagtaatcatcaaccggtcattcatttttgatattaccaccactacacaaaacatcaaataggtatcggcactatatataggccttttcctatttccgcgggttgaaatcgaaaaaaaaacagcacctttaatcaattataagtaccggttctaaataataactgacacctattctataggtgttggtttgacacccacagaaatcgagccgagccggcaatcagatgagccgaccggcgggccccaccacaacaaggcgatgaggagataaggtttgatctcgcgtctctctcgtctcgctctcttctctccgtctccctcccttctctctctctatctatctatctatctatctatctatctatctctctatctctctcgctgctggcggctggccgatggaggcggcagcggcgaccgcgccctccgatcccctccgccagatccggcgggaggggaagcggcagtggggtcggcggtaggcggggcggtgtcagcggtgggcgggggcagcaggctcatcggtggtaggtggcagtaggcagagggctcgccagcgggaggcggtgatctaccgcagggaggagccctcccctccgccagatctggcgggaagggtggcggcagtcagcgggctcgccgacgggagacggcgcgacgggaggtggcgcgacagctcaaagatgaccaaccatgtgacggcgatgatggtggatctaaagaggtgtgtgtcgacgtttgatgtctcgactacggtatttggacagtattgggatcgttggtgctagaatatacgcgagactgaggtaaaaaaagatggagacagggatttttatacaggttcgggcccctgagttgtcaggtaataaccctacatcttgttggccgaagccggtattgctcttattcaccataatcacaccaatacaatatgtgggtagcctatctaactgttgtcgacatggcggtctgaaggtctgactcgtagtcgacaacagggtagccttcctcctcgaatccgtgtccggcgagatcagagatagcgctttcgtatctcctgacggtatccggagataccgtaggggaatagccatgcctatccctgaaatcgatatccggcggcgtgtcttggcgtatgtagacttctatgttgtggcttctatgtcgattgtgttgggtgttgatcctgttgattgtctcgttgtggatgtccccctgtcctcctagggggccttgtatttatacccataggtgtccccttatccaagtagaactagggaaaccaatatggatacaatccgagtagttcttgtcgtttccatgtagaactctagttgtctttccttatccggaactccctccatatctgaagtcggtttccgtataggacatggtatgtggtgggtcctgccgagatttaatcaactactattaggtatgtggtatccataaccatgacagtgtgattctttttttattgcataaatttgagtgccaaaatttgtgttgtgggatgaatggacagtgatatgtggatgaatccatctgtggatggatgatgatattctttttgttttgttcattcttgttcttgttgtggtgtggatggatgcggatgtgtgaggaggaactgctcggctcaatcgagccgacgcatcgagccgttttttttttattcgtcgaacctaaaaggtgtcggaccggcacctatttaattttcaaatcagtaccgtctctcttgtgccggttgagaaaactggcacctaaaagggttttctaaccggcaccaatttatgttttttaagtagtgcactcgccggcgagctagctagcctggcaagtggtgtaccagctgaagctctccggccaaagcgcaacctcgccgtaatccgaatctacagcttaattaatttgcttgtctctatgttccacattataagttattttgaatttaaataaattcatatatagattcatatatgtgtttatatattatccaaattcatatgtatgttagcgaatctagataagtactagagaaaccaaaatgtcttataacatagaaatgagagagacctatatactatctctagtttctaagctagctggccagctacctaatctcttcatatcaaaatattattttctagtatttaaaatttattataaaatatagtaaattttgtacatgcattctctttttaactaatcataacagtcctcacataattttttagttttttttgtcttttcaactaatcatattttattattttattatttctattttttaataaacgtgtctaattttaaaaggttttatattttaggatggaagctctagctgcctacgaggctacgacgactgaactgacttcatcgctggttttaaatacggccaaagttttggacatgatcaagccacggccaagctctcaccgatcaccagatcgatcgattcagttctcaccttctcagaagagagaggagctagcacgaggcctggtcgatcgaccatggctgctgctgctgctcgttggcctcgcttcttcgtgctacgacctgctgtagcgctcctgctgttgctgcttcttctgccgctgcatgctaccgctgcttcccccaccactgaaagcagcgccggcaacgacactgttgctcgacctgatccttgtgagtagtaacgatcgatataatttattttcttatacttctatatatataaaagattcgcgagtacaagatagattttcatccctcaaggaacatctacttgtttaatttcttgtatttcacctaaataattaccaaaagattgaaaataaaatgacaaggtcgatagattactccatgattaaacat

SEQ ID NO: 71597 - DNA, 822 bp, Oryza sativa
aaaaggccgagaggacaaaggccgtattgtcgaggaaaaaattgataatttaacaatttttcgttgtccaatctatatactaatataaaaaggaggagttgtcccctccaatgctacaagccaaatcatccggactaatctggaccgtccatccgcgcgcttctcttcctccaccgcacgatttcacagccgaggattccacgcgcgaagacatcgctcctcctccacccgcagccgcggagaccgcgcgcttctcttcctcgctcactcctcccagcgtcctcgcaggagcgactccccgctgccgccgcggccgtcctcctcgctcgctcctcctgctccccgctgccgccgctacgccgcgccatagccggagccgccgcggccgtcctccttcttccccaccgctgcgccccgctcttccccacctccttcttcccagatcgtgcttctcccactcggatcagccgacggagccgactttggccccttctccgccgccggaaccgacatcgacctcagcccgcggccgtccttcttcttccccaccgccgcggctgtcctcctcacgggcttctcctccgtcccgctgccggcgctacgccgcgtcctcgccggagccgccgccgtatcgttcttctcccactcggacccgtacgaatctccgtcctccaccttcgccgctcgcccctctctctctctctcttcgcccgtgactccatcccctccctagccgctgccctcgcggcctcgccatcgccaatccctccatgccttctcgggctcatggtggaggggcgggggctgccttcggtggagggg

SEQ ID NO: 71598 - DNA, 21941 bp, Oryza sativa
ttagactatcatttctccatgatccccaactttccatgaacaatgcccacatccagtgggtaatgtctgtccagcaaacctgacatgtttcccagcatcagttttcccggtgcaatgcagaagatgcattagaaggcaacataaggcggcatattgtccacatatatcaaagcaatacatttgataatgtgatgctaaggacaggaaacctgatgattgcggcttcaaaggatcaaatgaagatcctgattaaactttaggaattgcaataggcaggatactgctctattgtttagtattccataacaacggttactagatatcacacacacaatgtgaacttttggtaaatgctagaattgtaaaatattatcattatataagccttagcagcaagttgaaggtgtaatgctagaacataggaaaacgaaccaaccaaaagtgaaaaaaaaaagaattcaaggaggtaaaatacactagcattacattgctactagaagagcaaattttgtaccatgttcaggggagcttcttgaaagtacttgtatagaagaggaagactttgtttaaattggcgttcaaatgatgcaggtgcactacaagtaaatgaattaaagtcataacgaagacaattgaaaatatggggaaaatcctcataaaataaataaaaactggagttgaaatcagtaaagccccaagttacctgtatggaacaaaatagggagcagcaatgatgcacttaacttggaacaattctgcaagatgccaaccttcctgaattgtgagaaagatccaaattacgtatataaccacatataggacagactaacaggtatagtcctggagctgttctagtgccaaatatggatagtgcagagcaaggttctagaattatctccgattcttgcaacttaatggagtattatgaccatagaaggcatttaatagatacaccatagattattcctagataagactgactgactgactgagattgtactggaaatgttcgggtgcatcctcaaacaatgaaattccatattttcaacatgaattggtgtggcaggactgtattattacctccaatattttgaagaatgaattaagctacataaggactaactgaaagttgaaccaggagctccacaactcaacttatagcaagctttgttaatgggatcctcaccaacgcaaagaagttgatcacaatgaaatcaccatgagtgctcatgtcatttccaaaaacattttcgacggcagacaagcactctctcctgtgctccacttgaatggtctttttcctctgcgaaaaggagtcatgctcaacatttgattgaacagaatcacctatcaaaaatgcttacatgataaaccatatttgcaaaaagagaaatcacgaacatgaaattggacagacttcacggcacttacatgagatgctctcgagctgttcggcagcaaggacaggtgggcttgacacaggcatatatctaacattacagtctgctagatgtgtcgacaagctctgcatcaaattcactatgtgaaactgtgatcccagtaaagctaagccagctaggcaagtttatattgagttttagtttctacaagaatcaaacctgatgtgctgaatgtgtgatgaacactacaccatactgtcgttggtcctgcgcaaaagctgcagcaagtgcctaagaaaaagggaaaaaatatatccaaaattaggcgtatagactctaaatgggttcatcccgagctgtaaactgttcgctgtctgttcggtgacatccccatccgcaagaaaatcaagtgggattgcatcttgcgctcgaatccccacggacaaagagacgaaaaaaaatacgaagagagggaagagcgcgtacagctatggggaagacgtcgccgcgggtgccgaaggccatgaacacggcacgaggccgccggcctccgccgccgccgtccatcgcctcgttgagccgccgcaccgaaggtcggggtctctgcggcggcggcggcggctgtggcctgtgggcctttccaggtgaaaatatgggctctaaccactttccgtttgggcccagatactttcggcccagtacgtgcgcgtcctaataagctttcgcgtcgtctcctcgactctcgttcgagtgctcgtcacaggcggctccacttctccgctggtgcggcggcgacggcgacggcgacggtgccccgcgcgccggagaaggccccgcgccgcatctacgtccgatggcctcctaccaggtttgttccgtggcgctgtttctctgtacgcatgtttgcaatggcggcggcggcggcgggggtgtggcggtggaggttggtgttcgccacgcgtgcgcgtggtgtgttcgtggaaatgcccatgagggtgtcacgcgcctgcacggctgcacttggacattccagcggcaaatcaccatgttagtttctaggatttaactaggaaaacgataatgatgcaattagcagaactgcagaaacgcgtcgctggattgccgtacctttgtggattacgggggacctgaactttgggggcaaacaggggtggggaactggggattatattgctgtttcgcattgcatctgtatggtcaattgcacagggggttggattagttggcaattttggaaaaccataggctcaacaactcaacaggttcttatatcttctctttttgtcatgttttcaggatctggttaaacaacataggctatacaatatgaataatatcgtacagactaataaagtttatcccaggaacaagaatgccattacaccataccattttatggaatctcaatctaattaagaacgatagttaaaaacagcagcatacaagctcagataggaatcttaattgcaggttatggaaaaaaacagaataattggcttggtggaccaatattatttttttaataccaaatggaattcgttacaactctcaaagtgtattaaaagtagttgtacaaacatccaaattacagctgaaactattggtactattaggtggggaacaaaagttggagctagaatttttcatgcattcacctctatctgtttttgtttttatttcttcctcataaagaacaagattgcacgtcccattatgatcatttcaacaaaaagatttctgcaattgtcagtactatttaccatcgcagctagctccttgttctcattgtaactcaagaaatgactgtcttattgtgcccatttcggcagaaacctgtgacattcctaatcggtcttttggtgatatggacgaacacaacagacccagcttaaccattggtatgatgcaactctgcattatttcagtatgatattttcctccatttaggtcactctgcagcataatgggatccaaaatctcatctagtttgtgtggaaatgctgactccacgagttcatgaaggcttaagccatccttcaatttgtcatcacttggacgcttcccagttaatatctctaataagagcactccatagctgtaggcatcgcccttggttgagataggtccacccattccgtactctacatatgtatttaaaaacagaagtattcatttaataataaggaaaatcacttgaatatagtattggataagtaaatcaagtgggaaaaccttatataaattagaagaaaaatagatagtgaatggttcgtctcacctggtgcaatatatccgatggatcctttcaaatcagccaaactagttgaattggcgcatgctgcagttgtagtgcacatgaatcttgccaatccaaaatcactgacatatgccgtcatctgtagatctaacagcacattgcttggcttaaggtcacaatgtattagtggagatgcagactggttgtgaagataatctaaagcatatgctatatccagagctatgctaatccgatcacccaaagttaagacttgtttctgattatgatcatagactttctgatgcagccatgtttctaggcttccattaggcatatattgaaagatgattgctttgaattcttctcctttgggatccaaggttgaacataaggtgatgactttgacaagattgcgatgtcggatgtttttcaaggcttcacactctgcaataaagcttgaaggtcctccatgcctattgagattgaaaactttaatagctactagatcaacctcaagctccaaggtgcccttgtaaacatctccaaaggatcctgaaccaaccaagttttcagtagagaaccctttcgttgcttggacaatgtctttatatgaaattatcttcgtatccatgctaatgtctgtcaatattggcttttcttctcttcttttcaagcagacagtgagtaaacagatcagtgaaattacaagaacaatggcagcaattggaaccactatcattaaaataatggacttatgctttgttcttctgtctaatgcaggacaatgaggcagccctaactctggggtgttggcacataaaccgtcatttccttgaagggacaccctgctagcatttctgaaaatgccggttgatggaacaggtccatcaaaatcattaaaagatagattaagatccttcaaataattcatggatgcaaaaaaatctggaatgctccctgataagttgtttgaagagagatccaactccttgatgcttcttaaattcatgagaaaatgtggaatgcttcctacaaggagattttcttccatgtgaagggactctagaagcacacactttccgagagtggatggaatgttgctagtgaggcggttgttggaaatgctaaggctgccaagatttatgagacctccaatctccagtggtataggcccagcaaaggaattatgcgacaagtccaagctttgtgacagtgaagaaatattaaatacctcgcttggtatgcttccaccaaatgaattgtgagaaagattcaacttctctaaatgtctccattgccctaaacttgctggtatagtcccactgaagttgtttccatccaaatataactcggttagttttacaaggttgccaatggaatcaggaacatggccagagagattattttgtgcaaagcttagaaccagtaagttgcttagatttcctacggaaggagggattgtaccagtgaacaaattttgatccatatacagcacttcgaggctcctaaggtttccaatctccaagggaattgtcccagaaagtttgttttgcttgagccagagccacttgagctccgagggaagattaccaactgagcttggcaagtgtccttgcagtccattcccatccaagcagagtctttgcagctgagtgcagtttgcaagggatgagaggaagctccagtcacccgcctcaagctggttatatgcgagatcaagttgttgcaagtgtgacaaggaaccaaaggatggcagtattccagtgagcccaatatcaacaagatgaattatttctagcttagaagcattaacaagagaagctgggattggtccactcaaacgtgtttttgataggatcaatctctgaaggtttggaagcttgtagccaatatctggtggcagtcgtcctatgagtgagttgttggccaattctagatatttcagagatgatatattgaaaatagactggggtacctgacccgacaagttgttgattgagagtattagcatctcgagagttgggattctacttaggctctcagggatgcttcccacaaggttatttgctgcaagggaaacaccaacaagagaggaaaggttccctattgaggcaggtatctcactagtgaggttattctctgctagactgaggtattgaataggtgcagcaactgctgtaacaggtggtatggaaccaattaatttgttcctgtcgaggtaaatggctgtcagagaggacgtgttgaagagagctcgtggcagcgctcctgtaagtttattttgtgtcaggctaagaaattggagagatgagctattcgccaagaactcggggattccttcagagaggccatttcctcccagatcaacatacgtgagagatgagccactgcccaacaaccacggtatgttacccaccaaagtattggtggcaaggttcagaattttcagctcacgaagtgtgccaaacccactaggaatgcttccttgcagcttgttgtttgacaggtctatgagctggatatgaacgagttgggctaggcttgcagggatctcaccttggagggagttgttccacaagctcaggacttcgagacggctacaggaagataactcggctgggatgcggccatcgagcgaattgacactcaggttgaggtgtcgtagttgttccaggcggctaagctcagctggtatacgcccgtgaaagctattgttcgacagatcaagcctctcaatggagctcaagttggctatgcacggaggtataaggccatcgagctgacaggagctgaggtctagcacggtcacgcggcctggcatcgtcgtactgcaggtcacgccatgccagtggcagaagtcgagagaggtgatcctccatgactctagggctctggctggatcagagaccagagacctgaaggaaaggagagcctgccgatcaatgtcattgccgtcgccatgacctgctgatgatgacgatggccatgaacatgtcaaggcaaggaggactagaaacagtgcaggactagttgggctgatcatactactggtgtggctgcagctacttgtgcttgtgatgtaagcttcaggaagcatgcgtgcttcttttatatggctaagcaccttgctcacttgactggctggcaacttgttcagatcaacggtatcatctgctgggattcataaaccagcattgtggattggttttgaatgtttcgatcaaagttaggtacgtaccccatcttccctacaaatgttttccgaataaattacgctcttcagtctcggatggcaggctgggcacttgggcagctcaaagattagtactactcgacagaagaatggataccaatgggctatcaagacatcaaggggagtacatttgctgtgcggccgaaactgctgtttgctcaatgacgctgcttccgatcgagcggccgacgccgttgataagccgcttgtattgaccggtgtcagtaggaaggaggccagggagcatgggggagagaggaaagtttgtattcgccgcgtcccagcgccactgacatcgagacgataagaacctagggaagaaagagacagaaaatttagaggattggaagtttctctgctaccttcccggtagagaaaaaagaacaaagttaagttaacacgctatgtttactgaaggtaactgtatgtatgaaaatttagagcagttacagtcgaaattaaggcccgctaggagagctagagattatgagaagctggtgcatattataatttgtaaattctataacttcatagaaatggaccgatgctctgcctcccaatctggttgtgagggtattggggatccacatatccgtgtgatacctatagttactttgaacatggcttatatttttacatattcataataaattttgaatagatgaatggtcaaatgtttccaaagtcaaccgtgttaaatatttgtgactaaagagagtaaaaaatatatatatgtgcgctgagttaggttggaccattaccactcctatcttcaggccgtcgaacataccgcgcaattcatgtttgacaccttctttgtcttcaaataattaagagcttgtttggtttggttccaaaacttgccctagcaaaacacgggcaacttcagtagtatcttttgtgtgttttggttgaagccaatatgtgctaattaaaccaatataagctaggaacccttgtcctaccgtaattttgatagagccaaaacttacccaagctttgacactatcagtatttagtactgctatacgtacgatgcagttgtataactcatattgagtactgctatacgtacgattcagttgtacaactcatgtacaactagagatatgtaaccatatatcaatcaaaagagaacatgttcttatgcactatagtcgtttacaaccgttgatcaaattcagtagtacgtgagttgtgtcgtatgtatagctattttcatcaatatttgatagggtaacaatccaaacatgacttattaagttcataactatttatcttcaaacttgatgtcatgttttcattttcaaaataaaattcataaaaattggcatgttatgaaaatgtattggctatttggctattaataaaacttccgtttctatactgcctcaatttccaatgcgataggtcgcatcgacgatatataagtggtagtataggatttaggatgatccgcagatcattaaagaaccatgcacgtgacttgtttgggattattcgtggcgcccgccggccgacgatgtgtataccgacggctggaactcaccggacggagctgaacatctcccgtccgagtccacaggtttcaattaattgtactactttagccgtacgcccacatcgatctatgcggtacgacgctgttaactttttaatatatgtttgatcatttgtcttattaaaacgattacgtaattattatattttatcgtgatttaatttatcatcgaatgttcattaagcatgacttaaatttattttatgtttatacaaaatatttaaataaaacaaagagtaaatttcacctagggcctaatttattggccaaagtttctcaatgaacgaggtctaactctaccttttcacttaacaccaagaacgattaccttgttttacagtttggaccgggttttaatactttgtgccaggcttgagcctagtgaactcagttcagggaagaggaggtattgagggagactagtgcacagggaggaggaagatagtgccgtggaggtggagggggttcacatcctctaccttaatggcactatcattacaggcattgacgtgtggggtaataggagggtgggaccacattatagtgattgtaatggtagtgacattatattagaggatcctcacccaggtggaggcggacttgctcaactcctctgtctccaccctcgccaccggcggctcccggccgcgtctcccgagcggaacggcacagcggcggcgtgctcttctccggctccgacatggcatggcggcgcgctcttcagctccggtgtggtactggctgaatgaatcagttttgtttgtttctgaatatgtgtgcattgtgcaagtaagatggagctgtaagttttgccactaaacacgagcaaaggggttccaagttccatatgtacatgtacctgatgaggtacaacgaattatcgggacaacataacacttgtgatattttttttccagtgccttctctttagtggtacttacctacaatacacagagataataaatgctactccaacttggtgagacttttggaatcctctcccatcctgccacgagctgagaaggagcactgcatgcaccccgttgccggcaccgcggtcgagctggagaagagcatgccactgccgtgccacgccagagccgaagaagagcacgcggccgctgcgccatgcctcaccggagctagagacactattagaaaaagcattttttatgtgaggatctttttttccgcaggcagacataacccttggagccaaatgaccgcctacaaaaatataaatcaaggtgaagttcgctgtccacgcaggcggaccacttaagcggtgcctgcgaaaatctattttcacaggcgaaccttatgttgtccgcctgcaaaaatcgcacctaccaaaaaaaatcttaagtctacccttatatattctcctcccacccctccccaccactcatttcctctcaactctctctatctctctctccctcaacactcagtctcctctcatgtcctctccctcaacactgtggcggtgcggtggggacggccactgcggcggcgcggacagcggcggggcgcggcgtcgcgcgcggggcggccggcagcgtctcccctccctcccttcctcacagatctggccggaggagggagggggaggccagcgggggcggcagcgacgacaacggcgcggggcggcggcggcggcgggggttcccctcccccctccctcccagatctggccgtagaagggaggggagaggctggagggggtggcggcgacgacgacgcgcgggacggtggcagcggctcccctcccccctcccttccagatctggccggaggagggagaggggaggccggcggcggcggcgaggacatcgtggggtagcggcgatgacggcgcggggcaacggcggctcctagcgcggctcctctcccctcccatcccagatctggccagggagggcggcggcggcgaggcgcgtcccgcgatttttttttgttcgttcattgcattttcccaggcgggccattgccccgactgcgaaaatcgattgtgctgcaggcggtcctccctcccgtctggaaaaattagttttgcctgcctgcaaaaatatttttttagtagtgagaagagcacacggctgccgcgtcgtgccacgccgccgctgcatcgtgccgctccgtaggcgcgggagccaccggcggcgagggtggagaccttggcgttgagcaagtctgccaccacctccacgtctccacgacactaccttcctcctccccgtgcgctaatttctcttcctgaactgagttcactaggctcaagccaacgtggtggcacaaagtcttaaaacccggtccaaacttcaaaacaagttaattataccttacaaatttgctatcaatctgtcgacagaattttagttagatatttgtcgatttatagaccgtatgatttgcgtgaagatttgtgctaatacggtcgataaaaaacacatgcgtgtgcatagcgggggatcggttcgaggatcactggttgccctgttagccgtataccaagtagcagttaagctaaattggttgaagttatggtgttaataaactaaaatatacgttataaatgtaaatacactgtattatcgggaaggctaaatggctgtcgaatgtttttttgatagctaaatcattcatgtttcaatatatttagaactgttgtatgatacgttgtagtaaaatgtttcatgaggtgatttgattgtgtttcagcttttttaaaagattgaaatattttcaatctacttgatgaaacagcgttcgattggcttcaaaatctgtatgatgaaagcctaaaaaatcatgcgaatcctatatagactttttctcgatgtactcggatttgtttcatgtttcaatatattcagaatcgttgttttataagttgtagcaaaatatttcatggggtgatttgattgtgttttagtttttttaaaagattgaaacattttcgatctacttggtaaaacactgcatgatggaagcctaaaaatcatgcgaatcccatatagacagccccaataaactatgcaatatatctactagatatcactataaaattacagtcctatataactaaaattatatttgtaaattcagttgatatgatatgtgagtgcactgtaattttgatagaaatattacgtaagtaaatatgtatttttaattttcttttatagtttattggatataaatctaatagtaaaaaaaatctcgctgattttttttagaaatcacccaacaaatgtaccagggcaacaagagatcctcgaatccatcccccgctatgcacaagcatgtgttttttatccgccgtattagtataaatctccacgcaaatcatactgtctaaaaatcaacaaatatctaacttaaagatatgtcgctagactgatagcaaattcgaagtgaaaaggtagagttaggtttggttcagggcggaactttggtcaataaatcaggtccaaagtgaaatttcctctaaaacaaataatcaaccggttgacttcatcgttgcctttaaatatgtgggtaggttagttttggactaattaagaatcaggcaagcaagcacgtacgttcgtacgcagacaatttaaggttcaccggaagcggatttaagcaagaagtgtaaccgatcgaccggccggcggtagatcgccgtcgatcgaccatagtcggagtttctcgatcttcttcttctctgcgcgcgaggcggacaagcagcttagtttgtgcaggctgcaggcagccatggaagctgctcgtcgtgttcgctcctccgagctacgagcggccatagtcgtggcggtcctcctcctcctgctgctgctgctccagctgcatgctatttctgcctcagccgctactaacaccagttcttcaggaggatatggttctggtggtgagtatttaagcagtgtacgatatcaatatattggcattgcctttcgcccatgattaattgctctggtatgctgtactgtaggagtattatattgcacgggcgtgtatatgatatatctgctactgagtaaatcaaaggcaaattaaatatatattttgctaatatttcaaacgattttatttgtgaaaaataaagcattttaattaattgtggtatagtcggttagatgtcatgtttgtagggttcattcagaatacatgattgaaaatacgtagaaatataattgtaaaacagataattgaaaaaaaaaatgtgggatagttgattggatggagtaaaggaaaaaacataagaataaaaaaatgggtgccctgtaacaaatcatgacagtacatgctagtgacgtgaatacattaatgaaatcaaaattgtcctttgtgccttgattagttgcttgatagcctgattttgcctctcgttcccacgtgaagaaagagaaaaaagaggtcagcgtgcatggatagattttgtcctatagtatttcccttgtatcgctaatgtagcaaaattttccagagcttttcccgtgacccgattcctactatccgaatgaagctgtacagtgactcaatccataggaattagaacccttcatttttcccatgttcttactccatttcaaatgagcccttagtaacttgttcatttctcttcagaacaagacaagccaggtagacatgacgacgatctttccctatcatatactcctagctatacgcacccatattaaccctaattgtgtaacatagatttttttaaaaaattatattaatctctactattataaaaattgaagatgtttttgctaaaattttgatacgtcattcatgtttaaaccgtttttttaaattcattgatcatattttgtatggaatcggacacggacattttgttgaacggacgaggactttttgaaactgtgagacaccaataatggaaaccatgcaaggcaccggtgggaaacccaatcatactcaaactcatgcatggcctggcagccacatcagtgatcgatttagaacgagtgaagttcgtagtagtaattaaggatattaaaataaaaatcaatgtaaaactgagcacatgcatggttaactaaaatttgcaatctccatttctatctttatcttctttactattataaaaataaattgaagatattttcatcgatactacatcgtctatatttgatcagtttttaagtttattcgcttttaaaaatacacaaagagtcgtataagaaattcttttaaaaaactcatatgccaacttgagatgagagtcagagtcctaattgctttagaattcttgccacgttataagaaagtaacatgcatgatatagccattaaggattttagattaaatatgaatactatcaaaataaaaatcgcatatactttttagacaaaacaatctagcaataatacgattaaaatagccttcacccgttgcaacgcacgggcatttttctagttaagaaaaaattaaaaaaaatcctaactatcaaatatatttagctggtagtatatcctacaaatagaaatcaatctctttaatcagtgtattatacaaaggtcattaattaagatgttgagttacattcaaattctacatgaaactttagcagtatacactacgatatttttttccaaaggataaaacaaacaaaccaccatacaaacatatacatttagatattgttgcccaagtttgttacagaagctattgaagaaagcatgagtacatgctactcttccatgcatggttggaaagtaattttattattacatactgtatatgccaaatcattgatataataaacagattgaaatccgagtatcttgacagaataaacattctaaggaaaatcaaaatcccaagatacatatgccgccaaaggttattgaagtcgacgtagtctaaataaaacatgttacacgcacgaatggatgggttaattgataactaagtttgacataatgatatgcatatgacattatttggtgttcataggacctgtacttatcttactaatgctaattggtggctattattatattctataaatttcctcgcgtgaatgtcttactcctattagagagctaagaattctcatgttaattcaaaactattgaaatttgttataaaagaaaatacctgtcaagtttatataactttaatttgtacgtgtaacttgtaactttttgcaggtggtgggtgcggacatcctgttctagtgtctccgataccaagataggcacaacagcctagctagctgcacacaccggctagttcagtcagttgtaataaaaaaaacaatacctaaataagtgatggaactatgaactaccgatcgatatgaattatgtatgtgcggatgagaataaggaaaactgcataaggccggcgtgcgcatttctggatgatgtagcacccatgcatgtgtactcgatcatgcttttaggccccatttgaatcgtaggatgaaaaaacagaggaatatgaaaaacacaggattctggcaagaatacaattgtaaaacagaggattacaaaacataggaaaaacaaagaaataaccatttgattggaccacaggaaaaacgcaggaatcagatgagagagatagactcagaggaaatgttccaagaggtttagacctcttgctaactttcctccaaaatgtacataggattacccattccataggaattttaaaggattggataggattcaatcctttgtttcaaaggccctcataggatttttttttccatagaattaaaatcctctaaaattcctacattttttttctacaaatcaaaatcaaaggggcccttagttaatgaaaaatcctatggtagggagggggccttaccctcccgtctatctaaaaaataaacattgtgcatgactcgaacaacatatatgggtgtttttttgagctgaatagctgagtggatgaataaattaatgatttgagataattatttaaggatacaaatgaacgaattaactataaggttgaaaaatagatttcaaacaatgttataagaaattcagggtctgtttagataccaccccaaaactttacaccctatcacatcgaatgtttacattcatgatgtattaaatatagactaaaaaaataactaattgtacaaattgtgactactttgcaagacgaatcttttaagcccaattgctccataatttgacaatgtggtgctatagtatatatttgctaatgatggattaattaggcttaataaatctgtctcgcagtttacggacggaaattgtaattagttttttattagtgcctaaacacggggcttctaatgggcgattgggtagcgatcgatccccctccctccctccacctggtttcttttttttggcaccgtattactttcctattttagtaaatttatgcacctaaagtttatacacctcaagtttacacatctaaagtttagagaccaaaaatttatatgtcaaaagtttatatatccgattcaaatttgaatttgaattcaaatatttttcatatatagtatttctatacatctaaagtttatacacctaaagtttatagagctaaagtttataagtcaaaagtttatatacccgtttcaaatttgaatttgaattatatctgattcaaatttgagtttgaattcaaatattttctatatatagtatttctatacatctaaagtttatacacctaaagtttatagacctaaagtttataagtcaaaagtttacatacccgtttcaaatttgaatttgaattatacccgcctgaacaccctatgtgacaatctatataatacccggtgtgacatgccaaaattttacacccctgaatctaaacacaccctcagatacagaaattgtgtaataccaccatgtttggtggagcttcttgaaagtaactgtatagaagcggaatactttgtttaaatttgtgttcaagtgatactggtgcactaaaaacaaagtaaagaaaaatcgggcaataatatcctcatccccaagttattaccggtatagaacaaaatagggagcagcaagccagcaatgatgctaaatagaactgttccgtaacatgcggggagagaatccccatccgctagaaaatcgatttggattgcattttgcgctcggatcttacggacaaagagtccaaaataaaacgaagagagggtagcccgcagtccgcaccacttcgtcgggtctctggctgactgggctctctgcggcgtccgtggactgtgggccttttccattccgctttagagcccagctacttttggccgaggcccgatccagtccagcacgcgcgcctcctcgccctcgcgtttcttctcgttcgagcgctcgccacaagcggctccacttctccgctggtgcggcgacggcgacggcgacggcgacggaggcccttgcgccggagaagcccatgccgcatctacgtccgacagcctgcgaccaggtttgtttcgtgcgttgtttctctgtacgcgtgtttgcaatggcgtcggcgtcggcggtttggttgtggtgggtgttcgccacgcgtgcgcgcggtgtgttcgtggaaatgcccataagaatgccatgagcctgcacttgcacatgcaatcggaaaatcgccggtgttagtttcaacgatttagctaggagaatgattatgacgcaattagctggagcgcatcatcggattgccatacttttttgtggattatggggatctgaactttgggttttgttcatggttccatcatgcaaataggggtgtattattctactactctttgacatggcatctgtatggtcaattgcacagggggagtaggagtggattagttttcatcgaatcatccgttgatcggaaaaccttgctcagcaatgtttcttatatattttatttttttctttcgtttgggtttttagggtctggttaaacaacagatgccatacaatatgtataatatcgtttagaccaataaagtttatcatgcatacaaaattttatggaatctcaatctaattaggaatgatagttaaaaacatcagcaaacaagcttagataggaaatttaatggcaggttatggcaaaaacagaatagttggatttggacaatttaataccaaacgtaattcattacaattataaagcatatccagggctatacaactccgatcacccaaacttaagacttgtttctgattatgaccatagactttttgatgcagccatgtttctaggcgtccattaggcatatattgcaagatgattgctttgtattctaaaccttttggatccaaggtggaacataaggtgatgactttaataagattgcgatgtcggatgtttttcaaggcttcacactctgcaataaagcttgttggtcctccgtgcctattgagattgaagaccttaatagctactagatcaacctcaaactccagggtgcccttgtaaacatctccaaaggatcctgaaccaaccaagttttcagaagagaacccttttgttgctttgacaatatctttgtatgaaattatcgtcatatccatgttattgtctgtcgatatttgatttcttctcttcttttcagcggacagtgagcaaacatatcagtgaaattactacaacaattgcagcaactggaaccactatcattgaataatgaactaatactttgttcttgtgtctaaatgcaggacaatgaggaagccctaactctggggttgggccgtcccttggtagggccccaccctaacggcccaatgagagatacccaagcccgcagcagctgcagcaccgttcgctccgagagtggctgcgcgggagacggcgcgctacgagcgtgagaaaacgaagggttggtttggtttgtggtctaaataggccttaccaaattttaccaatgctaaattttggcaagttttagcatgactaattttggtaaggcaaagttgtgtttggattgaagccaaaatagcctaagttcactattgaaatggcctattttcttaggcatgccaaaatttggcttcaaaccaaatagacacactattgaaattgccaaatattgatatccctaatttaggcctaagccaaaccagcccgaagaagccgggcccactactgcccgaggttcgcacgcgggagggagtggagcgatgtggacgcaaggagaatcgagcacgtcggcccgaattcgcccggagcgcagcaattcgccatcatctttaatttaccccgatgctataatattattatgaagtattcaaattactccggatcttcactaatagttgcatataatgttataatttataatataaacatgtaagtgtaacttacgtgcccttacccttatgatatgttatttccgatggtttattcaactaatttcattttttttattttatagtgtctcggtagagtaccgatatcatttttgtttctagctctaatgtttcaattgtttccgagaaaaagatctacttgggaaacgatttttagatctggtttacaacccctttaaatgattcttagatccggcttacaacctctttactaccggttgtagcaacccagttagcaagtgaaaaacatatgtggggtgtgagaatcgaactcaagaactctcaccttagtcctcacgcgtataaccatcccacctactacacacaattgacttgaatagatatgctttccttttgaactaaccctcgagacatctttattaccggttggtaacacaaatccgaactaaagcgatctttagtctgggttggtgttaccaaccggtactaaagatgcattgttagtactggttggtaataccaactgtgactaaagatgtttatagggatttagatttttagaaccggtattaaagatactttagtaccggattttaatctaaccgagatatttttgattttgggtatcacgtcgaaagatcaattctctggtagtgaatacggtaaaagaaatatagtttcagggtatggtacgccgagaattggtggtgtacattgatgatattgttattatccctcagctcgaggaacaacatctcctgaatctgaggaaagcattcgcagtataagtttcaaatgaatcctttgaaatgcgcttttgttgtttcggctggtaactttctcgtattcccgtcagaaggggatcgagaaaattaaatataaactaatggtttgcggcatatttttatgcgggtcttagcaaaaaaaggattgagttatttcgagaaatatattaaaccaactccaatccttttaccaattaacatattagaagatttcacaaaaccattacgcttagttttcgacttttcgggatgtggagaagattggagtagagaaggcttccttctgggctttttgatttgagtgtcagggcttttcaacgactagaaagctctctatgacggcggctaagtcgaggagtaggcaggcaagagtgctttttttgggctcaacctgtataggtactgtgtaaggttagctctattgggcgccgcacttacttattgtaaagcatgcgccagaatgcccagacataaactatatatgataatatggtttttaacaaacttgtctctctttatattctaagaattgtccgtccttgtcattttacttcttacgtgggatttatagacaaaagttagcccggattactaaagagctttgttgcgggaaaaggagggatttgctgagttcaaaagcaagagtacgggagtatttttctggccattttcgtccctaaagacgcatttgcgcatggcggccgaaacagctgtgtatagtacgtactgcacacagttgctgcctccgatcgaggggccgacgacgtcgtcgtcgtcgatagctagcgcagcctgtattagccgcggccaatgggaggccggccggcgagcatgggggagagaggaaagcttgtattcaccgcgtgctcgtgctactggcatcgaggcgataagaacctatcaggaagaaagagacaaataaggaaaactacaggatcgacgtacgactgtgtcgatcgagtctcagctttgcttctctttatgtactgtatgttcttttctgcaagatcgacttggaatgaaacacctagcgtcgtaattacattacatgagtatacagtgtgccgttcgttcattggtaaaacatacagctcgattcaaaaaccagtgactaaataagaagctgcaggattcgacagtacaagctatagctagaagaagcaccaaactgtctcatttccaatgtgatagcctgcatccatggtacgtggtactccttcagttataaaatataagcatgtctaggattaaaaataacataaacaatttctgaaacattgattctgatacatagaaatacatacattttagaatctaagcagttcaaatttcaaaatttgatcactatggtaactagaaaggagattctgtctcaactttaatatttaataaataaactaggtagaaatcttatattttaaaatagagtaaccaccaaccggtcatttattttttatattaccaccactacacaaaacatcaaataggtatcggcactatatataggccttttcctatttccgcgggttgaaatcgtaaaaaaaacagcacctttaatcaattataagtaccggttctaaatcaatgagccgaccggcaatcagatgagccaaccggcaggccccaccacaacaaggcgatgaggagataaggtttgatctcgcgtctctctcgtctcgctctcttctctccgtctccctcccttctctctctctctatctatctatctatctatctatctctctcgctgctggcggctggccgatggaggcggcagcggcgaccatcccctccgccagatccggcgggaggggaagcgacagtggggtcggcggtaggcggggcggtgtcagcggtgggcgggggcagcaggctcatcgggggtaggtggcagtaggcggagggctcgccagcgggaggcggtgatctaccgcagggaggagccctcccctccgccagatctggcgggaagggtggcggcggtcggcgggctcgccgacgggagacggcgcgacgggaggtggcgcgacagctcgaagatgaccaaccatgcgacggcgatgatggtggatctaaagaggtgtgtgtcgacgtttgatgtctcgactacggtatttggacagtacgaggatcgttggtgctaggatatacgcgagactgagataaaaaagatggagacagggatttttatacaggttcgggcccctgagttgtcaggtaataaccctacatcttgttggccgaagccggtattgctcttattcaccataatcacaccagtacaatatgtgggtagcctatctaactgttgtcgacatggcggtctgaaggtctgactc

SEQ ID NO: 71599 - DNA, 549 bp, Oryza sativa
ccatccgtgttgtttgagaagcactcacctagtcgttttagaaaaagagttcaaataaacccaattgcaaaaacaacagccttcccttgaagcctgcattaaacacttatttcccctggcttgctgagtactcccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgaatggtccaagtcctggcttccgttttccttttgtaatgcagttgtgagctcgggatctgtccgcagcccaacatgactgtactcctactctataataaagagacctctgttgctgtgatattctgtctccctgtgataccagcactgtttcctgggactggtatcgattaacaggttaaattggagcgtcacgggctagtcccggtcgggactagttcggggcgtgacaaagtttgaggacctgaacggtcgatttgcgagtttagag

SEQ ID NO: 71600 - DNA, 1236 bp, Oryza sativa
attcgagctcggtacccgaattatttttcctagttattttttttaagttcgacaaaatttataaaaaaagtaacatctaaaatgtcaaattagtttcattaaatcaagggataatttcatttttgcccccattttcatctctaatattgattttgcccctactttttagggttttcgtttttgcccccacttttttgaactgaaagaggtgtttgcccctgttttggatggaggttagtgggaccgaatttttggaagaaaataaagaattttcgatttattgaattacctttttacccctgtgaaatgttaaccatacagaacagggatactactcctctcggcggcggcgatactactccagaccgcgagcacgctgtgaccgcgagaaacaagcggcgggcgccggcggcgtatgagagcgggcgtcgcccaggctccgcttctcccggcgcgtgcagaagagcggccgggtagagggtggcgcggcgtcatccaggggccctagcggcggcccagcggcgcccaaggcggcggcgagcgggcggtcgcggcgtcggccaggggccgctcctcccggcacgtcaaggagagcggtcggggagagggcgtcggccaagtggcgccctaggtggcggcggggagaggggtaggcggcgggggagggggtaggcagtgggggaggtggctgggcggtgtcgaacagcagggcctcggatgcggctggcgtcggccctgtgatgtgagctattggtgaatcacggaggaaatcttgcaaatggaggagattttcatggaagaggttaacaggtaacccctttgtgctattcttgtgactgtagtacttcatacctttgtgctaattttgtgagtgtagttgttctcagtttggtttgtacaacgaattagctagtagtaatacaattcaatgtggttgagataatttaccaatgtgccaatgtggttgagatcatccttgttctgttagtaatacaaaatgtgaatgttgtttgtgctgacttggttgagataatttaccaatgttgtttgcaatgttgaaatctctaaacctccccctcaaacaaacttatatatttggaattgtatttttgtggctattggtaacatgcaacaattagctaaatgtatatttttgttgctatgatttgtaggacaaatcacagtgagttgaaattagttgttagagatgggtcatttttcagcttgccagatgaa

SEQ ID NO: 71601 - DNA, 974 bp, Oryza sativa
ttttacatttctgctaatatatatgtatatattactcctaccacatggtatatatatggtgatatatagttttccttgttagattttgattaatatttagtgtcgatcgttttctcttaagataaatacgtacctgtacgttctttatatacgtgaggcagtgaaaatgtgcccaaaatactactagtactactactccagctacctggcaaaccaacatcagttatacatgctccacgttaatccgtacgtttttatattgtagtggagtactatatatcataatcacatctaccaatacactgtcagttgttgtttaatttgctgcatctgacagtatgttttcaatcctttgccagctagtataagcttgtgtgtgtgtgtgtgtcccctttaatttggccacttaattcggctgagtaaacaagcatatatatagagaataatcgttacttgtttcttcttctgcgtccgatcccgtggcccgtgattgcttgcaacgaccagcagtactggagggaaagtattctaattcctcgagtggatgttttctcgtttgctcaaaaaccatttaaacggttatgaaaaattttggaaaaaaattgacaacattcatacaacacatatatacaactttacagaattttaagtctaaactcaactcacacgtcgagatataaaaaagacaaattcagcatatgaatagtagcatactgtttatatctaaatttgtcttttttgtttctcgatgtgtagattgaatttgaacatgaattttggtggactagtaggtatcattatactctacattgtcaattttttcagaatttttcacaactatttacatcgaatttggaagaaaaatgtatactaggggatatccccgagagattagaatccactgctggaccacaccaaaacgagcgcaagatcgatcaagcaaaaattattggcccggcccggccacgctttgg

SEQ ID NO: 71602 - DNA, 159989 bp, Oryza sativa
ctgcagtcatcttccggcccagagtctcacaaggttcagagtcccaagtcttctcagagaactgatttcactccttagtcttacaaggttcagagtcccaagccttctcagagaaccgataccgcaccagagtctcacaaggttcagagtcccaagtcttctcagagaactgataccgcaccggatccatatgatccatatggcttacatggactactgagggtaatgaagttgaaagaggagggaccggcatctcttgctttagggattgatttgacaacactagggttggatatgaactcttcagataatctttacaagacatttggctctccttggtcaagtgagccagttaaagaagagtattcttatgaaattccggattgctactcttctatgcagcctccacccctgcaagtaaggccctcaattttcgagttaccttcttttttctttttgtgagggaatgtttaggttagcattaatcttgttgtatctgacattacgatttatcttcctctgcaggcgttgcattttctgaggtttcacctcatgacactattctacatcttctacaggtacttagttcaatcaacagtgaattcctgtgttagtaggctatgcattatttgactgtcttttgtgcagtatgccacaggatgcagctcagttatatgccgcgaatgaaatgtaagcacaaaaccacagttctatattgttttctcatttgcctgtcattttcagtaaaacgatggcctggtatgccagatagctcagattgttgcttccatttcttcagatgcaaatacgggtgggtttaccacaaagagctgcgtcagtgggttaaaagagctcctaatacgacccctctcgtcaaaactacaacttatgaacaaggactctgctatctttttgatgccaacatttgggatgcaattcctaaggtaaacgtccgaaagaaattctgacagatattttcagctttttccgatagcagaagaaaatatatctgaaagttggttgcaggacaactttattctccgttatgacgatatcgagaagatacctgcccttcctccccttcttcctgccacccaaaatcctgccacccaaaatggtagtgtaagaataaacaaggtcagatttgggagtcccaatagacgttttttttgtgcacaatgtcaaaatagtgtcataattatgattaaaaaaagtgccataattcccttttctgatgtaagtttgcatttgcagccattgcagtaggttctccgtgttgaagattagagtttcatggcttggatcaattgttggtattattaaggtacagttaactctcacaaaatgattctgcaagaacttgtttagttctatagtaagttcagattaacttacttggtggcctaaactacattaatttcctctgaacagggtatgcatgctggttctggggatcggagctcctgcgatggccggcgtttgtggtagctgcgaaataccgcggttcataattcgttggctgcaatcagttaaacccatttttaagttttgaaacaaagttgaaccccgttttaattatgtttcggtcttgtgatgactgaatgttttgaatgtttaaacctgtttttacctgtaccgtaccagatatgtcgtttaaacttatcaggcaccgacattttggatcttgaatcagctcctgtcctgtttttttttttattattactttgataatttttggtcaggtaaaattttgccatgttgtgaacttactctctccgtccaaaaaaaaactcaatctgggcatgaatctagccatttccttctacatcctttttaggttgagtttttttggacgaagaaagtatgattcaagcaacagacaactggctagtggtaacgatctgacaaggacgacacatcgccgatgccgatggtggtggtcaggtaaaagttgccgtattgggtttggctcgcgtgctagtggtatgaatcgagtgctcgcgcatggacgccttcggctgcggcgagctcgatcggccaggcgctggtggttgtggatggcctgacgctctacgcgcgccttggcgccggcgccggcgacgacctcctctccggcctcgcctttggcgcggccgacgaggctctgctgaggatcaagatgaacaccatcatgtcatgccggccgccgctggaccaaggtgatcaccttcttctgcaagctgcacgccgcggatgcctgtggcggagcgaacagtggacacacaagaggattcttctgcacggacaccatcttctcgttcgacggcaacacattctgggcggatctctcgcagggcttcatgtgctgcgacaccgccatcgtcttcaccggcgacggaggcggctcaccaccacccgtcgatctcaggtacgtcagcctccacccggacagtagcggatccaaaaaaaaaaaagcaggtggggctgaataaattagataaaatttaaacctccattttctatatatgtggagcaaatagttgtagaagagctcaggtggggctcccacattcctaacgccagtagtgagggctgagatcccttagcggggccctatgtcagatccgcgtctgccccgtagtacctacttctccacaccttcaaatccgagaagcttggatgtatggagatgcaccacacctaggcatcttggacaacttcatcaaactcgtttccgttaacaccgcccgcatcgctgttgccgctgccacaacgaaagaagaagaagacatgccatcgtcaccgtgccacgccgccaccgaagcagccaacgcgacggtggccatatggactctggacaaatcagctgatgagacttgagacacgctcgacatgaggagcttatgggcgtaggaggactacaagacgtcacggttgccccggatggtgctcacgtggcccttcgtgaggctgcgggaagatggtgttgttctctacttcttagggcctgtttactttgttgccaaaaaaaaccttacaaaattttggcaatgtcattttggcaatgccaaaattttattaactatgccaaaattttggcaggatttcttatatagttatcaaaatttggcagcaaactaaatgtagccattttttggcaactttaccgaaatttggtaaggttgaaaatggcactaaagtgaacagcctaagccgctcaggacataaaatgacccccaactatatcacgtttgcaggattgacatgcacagcaggagagttctgctgtcggggctactctctcaccgctcccatatcattcatcaatcggttgccttgcctgctaatgtcttccaacatcttaggatgatccaatgagaagccacccatgtggtttccgcggagaggtgtggctctcggtagctgtcactattcgccattgtatattgttttttataatggaagttttattatctcagtaaataatataaaattattccgagagcatctctggcgtatgcacccaaagagtgcacccagccaacaagaaagaaacaaaagataatatcatcatccaagacaaccgaaaaactttaggaactctctaaccgtagcctagaactccacccatgtgctagggtagaaaactccatggccactaactccaattattggcaagccgcagtgatggtacccaacaaattgaccttctggagaatagcccatgagtagagcctatatgtagtaaaaaaaatataacctataacagagaagatatgtttttcatttcaaaacccacatcatttttgcaaagccaaatagatcaaatagtggcagttgccccaaataagaccaaatgcctcaaattgtgtagttgtcttcttatgaaatgcccaaacatatgagttatactattaggtaaactaatattcgaagcagattggattaaagaccaaaccgcgcaagataatcaaagaataaatgattaatagtttcatctttacgacaaaaagaacaagttcctctcccattccttttaatcagattatcttttattaaaactactccctgatataagtaccataagaagatcttaatctttaatctttatggggctttaatcttccaaattctttaatttatattgggaacatcggtatgcaccaacacaagatatagagatttaaccgaaaatctgtcatcagtggttagattccatttaaactcatcttggttgtgagaaatataatattagcgatgtgtgagagaaggtgattacacgccactaacttagagccagtaaggtccctgcgctaagaaaagcttagcagactagtatggaaaatttctgaaatagttgcatgtttatgcctaacaacattataaagacatgggtattgttctattaaataggcattccctaactatttatcttctcaaaaccgtacttgagagccatctttgatgttgaaagagtcaaatatgtgaaaatcaggcttagccttcattagactagcccaaaagtgtgactctcttgttttccaatgagaaggctgtgactccaaatattttttccttagcatttattgccacacaccatctatagtgagtagcttatacaactacttactaaagagaatcttgttcttaatttcaagatcttgaattcccaacccccttgatctttacgatgatgtctcaccttgctagtcggtatttccttttgtgtccatcctcttgccaaaagaaccttgattgaaaataatcaattttattgatcactcctttatgtatttcaaaaaagaacatcatatatattgataggctgataatcactaaattgattagtgtcagtcgccctctaagtaataaaagtttgccttccaatttgccagccgtttctcaagccattcaatcacctactttcactccgagctacaaagtctcctatggtgtataggaatgcctgtatattgatcctgagctgtttgtgtttctttttgtacgatataaatgaagtaactaatgtacaaatattgcggtgtagtaactactagtaactagcaagtgtactgtagttattacaagtttaagtctacaactaatcatgagccgtggcttcttaggaattcgcaaccagaattgcaaagaatcggagtccctctcggttttaggcaaacggaagaagcgatcgatcgcctttggaaggccggatccgaattaatcccatattattcgcctttcgcttctgcttgctttccgatcgatcaccgaggcgccgatcgatgggtcgtcggcgacggcggcgcaaccgcgacgccgagttcgacatggcggagatcgaccggatggtgccggtgatgaagctggaccggacgaggcagccatggctgaccgtccccggccgctcaagctgcacctgcgactgctgcaatgtgacgacgaagaagaagccgtccaacaaggctctcatcccggcctggctattccgatccgacgacgacgacgatgatcaccacgaagaatcagcagaagaggaggaagaagataatcagctgcaaggcctgaataaacacttagctgaatatcggattggtcaatatgagattcgtaagtgcctccattgcaagcagcaccaaagtataaatttcttgttcataatatgcaagtcaaatattgggacaggattctaaaccctcgaaggatatctcctcgtgtaactttttcttttttttcaaattcaatgtgaatgtttgtattttttttaaaaaaaaaacttgacccaccaaagacaaaatagaccctgtacatcctgtgtagaataaaaccttctcacgcaggtcaagaaagcccttgaacccatgccagcccttacacaatggcattggagaacgaccaacaaccgaggcctctagctgtaaaaattgttagcaatgtacattatagtaacttttatcaccaccaaaaaaatataattcaaattcgatttacatattgagaattaaaaaaagataaatccagagcactttgatttgattcttttattcctagatgggtgatttaagttttaacttgattttatatagagtattttatatatacattattaatgttgtcgtttttttataaaaagatttaccaactatttatatgatgtttaaacaaacaagattatattccctcaaatttaaaacacttgccacatactccctccgtttccaacatataagcatttttaactttgaccattaatagtaaaataataaaaaaagatcaatcatgtaaaattgatgttactagatttattattaaacatactatcataatgtgcaactcttttaatttaaaataacttttatagatattggtagtcaaagtagcatctcggagactgtaccagagtccaaaaatacttatattttaggacaaatggagtatatgaacatttcttgtcttgcaggaggagccacgataaaacgatacccttacacagatggctacgagctcaccgagaagctgaacgccgagctgccggccggcgagcggcgctacaccccgaccttcgtcctcgagggctcctcccaccgcgacggcttcttcggcctctcgtggcactccgagtaccggatgcacgagacggcgccgacatcgctgccccgctccaggttcaccacccctcacccccgctgggactacgaagccgacaacatgctgcagctctgctcgctcagcctcgccgccggcgccggcagcggcggtgatgggcggcggctgctcgtctatgggatcgtcgccgcccgcgacgacatggaggggctgcccaactttgtgttcaaccggacacgggacaacgcccaggaagtgacactggtgagtgacaatgttaaattttgagtttgaacaggatctatcttggctgaatttgaacaaattttaggaaattcaaacacgttcgatttttttaaaaaaattgatttgtttggaataattcagagctctcctgcactggagctgtcatctccactgcgcggcatctccgcgttcgagcatgtgttgctcgagttcgacctgaagctgaagaacaccgccggcgacggcgccgacgctgacgccgacgacgtgctggtcgacgcgtgcaaagagttcgtcgacaggacgatcacctgcagcgccggcagattgctgaggtcacgcatcgagggcccaatctgctcgctggacatggactacatgttcatcaagagcggcgtcgaggccgccgtcgaggtgttcctgggcgactcctgcgcgagctgcttccagagcgtggctgccgtctaccgcgccatcgccggcgacggtgacggcggcggcgacgggattgtcatccacgaggagtccatcccgcttcctccgaagctgatgctggccgccgataccgctactgctcaggccgccgcggtggcgacggtggtcgccgtgccgtcggccggcgagctaacggtgacgctcagcttcgccacggcgaggcaccgcacccgcacgtcgcctccgctcagctatctattcgctaggtctatacccatatgagaaatgcagttgtacggggggtcgtttcatgcttaacttcatggctcggttcttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaagataattgcccaagaatatagcatttgataaatatgagtatgcatgattctagaatagcatttctaagcaattgtcataattgactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgcattgctcgtagtcctgcgggtcttgatcctcgctcggatccgcaactccctcgggtctaaaagtacgtgcgaagaattgatttgaattcaattagaattcaaatgaaatccaaataaacttaaataaaagtcgaacgcgaatcgatctttctatatcgactacaaagtttgcaaaaccacttcattccaattttaagttcattcatcctaagtctttttttttgtgatttagaagtacattcctaataattcaacataattatttagctcttaaataaatctaaatttctaccacgaattgattttgtatagagattaccaaaatattctataattatataaaattttgtgattctacaactaaaagaaacctacaactaaccccaattatttaattttccaaacctccttaatctctccctaattttctatttatttttcctttttcttcttttcaattcttttttttcttttctttctttctttctttttctctccctcccggcttctcccttcctctctctctcggctcactgcctacccggggcggcggcggcgaccgaacaaggggaggggcggcggcggcgcaaggcgggcgacgcacggcgcggcactccacgcggtgcggcggcaccgagggcggtggtgcggcggcacgaagacggcggcgcggtggagaggaaagaggggaaaatgggggaagaggaggtggggtggtgcggggtgaaatggcgaccggggaggggatttatagggcgcggggagaggtggccggccctaatggcgacgcgacggcgcggcgcgtggggcttgaggcggctacggcgacgggcgcgcggcgcggcaggcggcagcagcgacgcgacgggtgggtggcgcggcgcggggctcggcgcggcttggcacggggctcggcgcgacggcaacaggcgacgcgacggcgacaggcgacgcgacggcgacgcggcgcggcagcggcgcggggcgcgaggcggcaagcgcgtggcgcgaggcgacgggagtagagtaaatagaattttagcccaaaatatatggcatggaatttaaagaattagatatgggctaaatgaggttttggatttcgggtggagggataaagtctattctcttagcacaggagcaattgttcataataatattattctcgtgctgagaaggaaatcaagccacggaaattaaatcggcggctagatttaaagaaataatttggatcgagaattttaaaggatgggtcgacaattaattccaatgaaattggaattgcttgggtttaggttcaaaggtatagttggaggatttcttggaccatgattcataaaagtaaaaaggatttttaaactaaatttaaagaaaggaaattttggtcgaaagaaggtttaagatacaaaatcaaatcaaagagaatacctcgatttaacaagatcaatttttagaataaaaccacgaaagattttaaataccaaagagggattttatacaggttagttttaggaggtccctctaattataatttcttaggtttaggaagttattaagaacataagaatcggcatgatgcatatttagaaaatagcaaattttcagtatgttacatgacgcgacggcgcgacgggacggcgcgcggcgcggcagcggcgatggcgacggcgcgcggcggcaggcggcgatgggacagcgcgcggcgatggcgacgcgacggcgtcggcggcgcggggctcggggccggctaggctaggattacatcaagcaccttgtaggcaatgaatagggctagatccttattaaccctaatttagtctattttctatttaaatctcgccctataaattctaacttttgcacaaatcaagtttactcaatatttgtgttgctctaaccaaaagattcgccctagattaacattacacatattttatttttatataaattacttgaatttaattaaagttaattcttattccatcgcacttaaatttaattgatactaatatggtcgcgataatatttttatttattaccaacctcacttaatctttattttaaattatattttaattatttattttgccagtttaattttagggtttattcctaattaattattctttattcgcgatcaacgaactccgaaatcaaaatccaatgaaataggtgaataaaatcggcataatgcaatttgtttaaaaagtttttgaaaatccgtatttttagagttttgattttattggtcgaattttcagggtgttacaatagtacagcccactactaaggccctctttgtttaggcttaggcttattggcctagacttttaagtcagcttattggcttatatgatttataagacagtggatttaatgtcctaagtttagtggtggagtcatacatctatctcataaaagccaaaaaagcttctccaacctatcttttggcttaatagtgttagagtggcttatggcttcaaaaaagccaaataaaaaaaagctacttgtttgttttgacttagacttttcgacttataagctggcttataagcctaaataaagaggacctaactccaattcatttatagccaatctaatagccaatttatacaatagttgcttgctatactattaatatatggtcccacctgtcatacacacattgcgtcttagagttcgcgctgcagctggctacagatctgtagcccgctgctcttctctcatcttttatctcattaaaatgtttacaaccggctaataatccactattgtacctgctcttagtaggtgaatatcaggctaaccagatgtgtcagtaaacatcgaatggtttatatatatacaacagcattactgtcctacagtgccaaagatttgatctgaagggcactgctccaaaagcacctacaaattgccaacaactagccatggatatatgctttaccatgtacagtcacagcttgcgccattacacatccggggtgaagtgatccttgtggctgagaatctgtgcatcataagccgcaatggcatcaaacaccctcaaatggctgatcacctgagctccacaggcagcatactctctgccctcttccatctccttagggagatcatcaagcaatccttgggtgaaatcccttggagcgcccccgtcgtagacgaagtagcatggcttcacagcaactttctccaggttttcacgcagcaaatgcgagccgccgtttgtctccagtatctgccctccagcagctgcaatcaggctctgtatgtgttgtctgtcgtcagggtttatgtagacactgaggcaaaagttcagtcccgagaacaactttttgtgcctgaaagcatcgcattatcatcatggagattgttgcggcagaaaatttgctctaaagaatgaaatgtcgtaagttgcaacacaaagcaggtggaatatatggagttatgcactagatatatacaccttgactttgaacagcgatatgtaaaaagtatttttatgcattgttgtacccagttgtagctaggcctgtaagaaaatattactgggaaagatttgcaaatcaaattcctaagcttatacaagtgacagcctacgatagttttcactacataaaataagtctaatcttatagccagcgatgtatatgtaccccttcagaagcttgatttcttcttttcttgtttccaccaattgatgcacgtgagtcatggctaaatcttaactcaaaggaagcttctggacttggaataaactttaccaagcaatccataatccctaaaagagcaaggcgaagcacttcagcttaggaatagataatactctgcagatttatgataaaccttgaatggccttagggatacttaggtatatcaaacaatataaacgtaaaggaaagaatactcaaattggggtcctaaaagaaatagagaactgtagagaagatagctcaatactgacatccaaccgtgacaacccatttcccaaacagtagagccatcaggacctcataagatcggctccatgcactaccagcactttttccaacgataacatgggtcacattttcagtccactcgttgaccacagttgcatctgtccaagacgcaaactcttgcaaggaatcctgcttgaaaaacataaatcatgtttaccacaaaagctggaatggaagagttaacttcataaatgtagcaaatcatccactatgttgaattatccatgaagtaggattcagcattgtttgtccgtatacttgttcaccacaaaaaaagagtaatgtttgctacttctcacttatcctaccttctcggattcacttaaagctgaaccaagcaaaacccacagatccgaggggcaatctctttctgtgtaaaggtgatctgtttgcttttctttcctgtattcgtcagtggaaattccttctttgtccaagtattggctgcaatgattaaatacaacacaaatttatggaatgcaagactacaattgatcaaagaatcaggaaccttaaagacatctaacaagaaaggttaggaaagattgtgtacccctcaggaaaggaagaacatgaagtgttaagttgatctatttcccttttaggaacagcagaaattccttctttggctgaactttgtctggaacaacaaaaggcaaaagagaatgttgtaggtatttactccgtattagctaattcataaaatgattacaaagtaactcaaaaggcaggtgaataaaggtcatatacccttgagacaaagaacttgatgtgttccattgatctattataggatattcccattcgcaatcagcggaatcgctttgttcaattgacgattggctggaacacagaatcaaggagaaaaatacaaatgaaggatcaatgattaatcaaataccagagcctttgtataaccttccaagaaagcaataagattgaataacaatttcttattcatggaaaaacctctgagggaaggaagaagaattgccactctcatttcttggcgagcttatcttatcacatggtagtggcatcgttgcatgttcagggcacataacacaaccgttatcctgcaaaatgaaaattagcatctcggagcttagaacattagactattagagtggtgacgaatatcacaaacaaaaggatcgattacacaatattctcaagagcttacaacatcccagcggcaattcaaagtcatcattgcacatggaacatgatagctcctattgcactttgtataataacacccaagagctgctccaggaagcttgcatcttttgcacttcaatttcgcggcacgttttatttccaactccaagttcacaatggtatcaccttcgtaaaatacttgcggggcccttcgcaaaagaaaaaagtagggaaagacaaacaatttacccaagaaatagtcctttgagagtaactagctagtgccaactgttgcactggaagaagtaaatatagtttataatgtaaagctaaatatactaaaaataagaattgtctccaaatctagaaaattgaaaaattactacatgagatcaatcaaccatctacacatacacatgtgcaaacaaatcaactttttgcagaagaatatatcatgcaaacaacaaaattatgatgggggatggagggagggggatgtagaacgcaccatcacccctcaactacccactttaataccactccagccactggttatttttattaggtatggttagacttagcacgtctcaaacattgaataggctgtttaatggctaaaaaaaaatatcatgtgaatttactttgaaataggaatcaaaatggtaattcttgcatgccactaaaactatatatcatactgactaatatttggacataattaaacaaatggaatggttgtcttataaagcaaaccaataaggtattaaactaaaaaattatacaagggtccagatctcaacaaataaaaataaaaattgtccagcatccttgtatcttaaacctgcattggaagcgcatgatgataaatctaaattgtggtgaataagcatcaagagttgaaatatatttaggaacttaccactccaggcatttcttatgaacataaatgatatctgttgggcatggactgccattgtcactggacacaagctttcccttttgataatgcgccattggaccatgaaactgaaataggaaaagtgaggacctttagtgtcagaaatggttaagaagacctcaaaacataacctctggttaatagatcatggttcacctgaggaggtgttctaaatgaatggcagaaaacgcattcatcttcaaataagttgattggcgtttgcagtctcttcaatctagtagcacgtcccatgtcttttgacatgccatcgttgccatgttttccaggcatgttgttttctctatcagaatgttgtcgagtgttgcttagattagaaagaggcaatgaaacttcatttgcatctaccgcagctttctcatttgaaccctctgcagccaatgctgtcttattctataatagaaaaaatgtatacagtcaaactgttgagtatatgtgtagatattatagaaaaacttgatttttcttttttgcatgaaccaccacataatgtgtaggtccttgtccttgagcatgcaaatctgcaggactgagggaaagaattttacaagagatctgggaaagacaactgaagtaccctaacaagacgtgatttactcagaaagatgctttgcctagtcaactaattgctgttcatatgacttcgttgaagaatctcgagattactgctgtccctttctccaaatacgctgtcagccattgtgctcatgatctacaaggcagcatgagagtagggtgaagctgagagcagcagctggacaatattagtcccatcattatttaaatagctcccccagattaattgattaatcaaatcataagtagcatatccctaactttttcaatagtcttgtttgtaaaaacgagatcaattcaagttggaattacaaaactcgtcgcattattaaaatccaaactctagaccatttgcaaagaaaattcattggcaaacacatccctgcctttagcactttactaggaaattcaatttgcgtttatatgtccgttgttacaatgcaaccctgattcaggggcaggacaggagtaatcatgcatctcttactgacaaaaaactagtaaccatctcgcaccattcacagtggagttatattccaatgatcactgcttaaagttgtcgaagcaatcaagcgaggaggggttcctgggaggcagaagagcgccaaattttggacttcgaaagggggcaaaacgtatagcactgctaattctgttgatcattgtagcaatagtacacaaatatatatgcagctaatgaaatgaatgcagcgtgttgaatagactcaaaataatttgtgggtaaaacttttatatctgttcttagcaatgaaatgttttgctgtgttcttttgtaagagtggcagatagggagaagggttccttcgtttttcgcgcgcgcatttcccgagctgctaaacagtgcgtgtttgaaaaatatttactatagaaaagttgctttaagaaattatattaatatatttttcaaatttaaaatagttaatatctaattaatcatgtactagttcaggcgttcagcttgttttacgtactgtatattccaagtcttctcctttctcctcagggaaaaccgttggaaataaactatggtgagaaccctaaaatcaacaccaaaattaggttacaaaatttaaattcggggaagcgtaggtacccgcagcactacactaccgtcgtcgtcgccgccgaccatctgccggccggccacaccggagatggtgggtgggagggggagacacgtgcgagccggagggtcagaaatagagggggaaaaggaggggaatcaaagcgctcacctggtcggcgatggcgctctccgcccctctccctccccctcccccttcctccaccgcccggttcgcgcgcgcgatccgccgagcgaagcgggctacggcctcttcgccgccgccgccgccgcctccgcctcgggcagcgtcggcgagcgagtgagcgagtgagaggagaggaggagaggagaggaggagggcgcgagagacgaggcggtttgagaggagggagacgagacgaagcggacgttttgcgtgtgagctgagtggagtagtgcaggtgcctctcgagtgtcgacgacgacgacgagtcgactcgttttggtctctggacgtgtttagccctagcctagccgagacgatgcagttaatgcagccgaagtgcggtcacttcacagtcagttcacttcgctttgctcgctgtctctctcttctcacatccaatgagatccgaatcctgggcattattgtagaggtttattgtttacgccttccgtcccatgaaaaatgagaaaataaacgtttagctatctttaaaactggatttcgctattatgtcatcctcaaaacgtaattcgatataatactaatctcgagcgcgcgctactcgtcgcattgccattttcgccttttcatgatttccgaaatgttttttttgctgttcacgtggtgatcagacgaaaatacccctccggcttgccttttcttcatctcgcaagtgaaaggggatcgagcatttctaaaaaaaaaaaaaaaggcctcacgccctcaccgccgccggctgcttcttgcgcctccctccgttggctaggaggggccacaccgccgcactggccgaagcacgaaaggctgagggggttgtgggctcctcttagcaaccgccgtcggtgacagcggcggaagtggcttcttcttcggtggtagtgacagcaaagcaattgttgggaggaccgaagcgacgcagtggtggaagggggagttgagggcagcgctagggatacggaagtggatgcacgcggcggtgagcgcgatcttgccagagccatagtcaatgatgaggttccgtgcgatgtcgtcgctactgacaaaaacatcgcccatgacctccacctccacacgagtagagctcgagctcgagctcgctaaagggtgcgccaagctcgcagtggtcatggcgctctagctcatccccgcgcatgtatcttcagcgagctccgcgtctctgctcgaagctgcttcgtccctgcgccactccctttgtcgaaacacaccgctcgcactgccaccaccgccatgccgaaggggagagagagagtgggggaagaaaggggatggggaagaatatcaacgccgtagggtgataaggggcagttccgtcttattacccagcggaggagccaaaatctttttggaaatgaataaaatggtgaaaatggcaaagtgacaacagatgcacgcttcgtattggcattttatcgaaccgtgtttttggggtggcattctagcgaaaccgtgttttgaacgtggccaaatgttcattttctccatgaaaattatggtccaactatgaatttgaacacgtgtgtctatatttatagttaagattgattttttttaatggagggagtactccctccgtccataaaaaactaacatattggatgtgacacatcctatctacaaatctggacatccagtactaaattggttttttatgagatagaggaagtatgtgagtataacagtggatcaatgtaatgaataccgtcgatttatggtatctacaataacatgaaaattgtagcacacttttatttagtgtagtaatgatgtgtttagttcacgtcaaaattggaagtttggttgaaattggaatgatgtgatagaaaagttagaagtttatatgtgtaggaaagttttgatgtgatggaaaagttagaagtttgaagaaaaaattaaatttagagctaaactcggcctgagatatataggccttatgcccttgatcggatggctgccaactcccataatttatagtaatcatgttgatcctctgccttacaacgtctctaatgcagagtagcatggtccatcgtaatacagttagtaatatgttaagtaatacttccttcatcccaaaataaagggttttagaatggatgtgacgcatcttactactgtaaatttgaatagacatttaaattcttaagacatccagatttgtactattgtgatgtgttccatccattcaagaacctgcatattttggaatggagggagtacttcctccatctgaagtctaaaacatgcttcttccatcccataaaaaccaatttttgattgtgtatcttgacctagatacatagtcagtagttgattttatgggatgaagagagtatttactattttttaagcaagaccaaagaaaaaaaattaacttatactaagatgcatactgttaatgccctaaaattaacttatatgatgcatgctgttaatgccctgaatatgggatacccaatacttaatacatcaaatacgaaatcaagtctcatacatatagcaaaaatcctggataaagaaagagaaatatctactattataaaaattaaaacttaaagatgtttttactggtattttggtacgtcatccgtatctgagtcaggttttaagttcgttcgtttttggaaatacagatgcgtgtttgagttagattttaagattgttttccttttggaagtataataggagtcgtataagaaatctttaaaaaaactcgcatgctagcatgagatgaaatacgaacctaattgtagctcatgatttcctgaaaaaaatatccaaacgacttcccacagtgaattttatctaactaaaccgtaaacaataataaaattaaaatagcatttacccgttgcaacacatgaatattttttcaagtaaataaggaaagagaaataaataccactcggacactacaaagtctagcctgtttgaagggaacgtactttagctttcctgctacccgttcgcaaaaaatggtgaaactttaaaagtcaaattcgcttttaacgctactaacaggatttcaaaagcctatatttctgtagagaatataatacgatgggatttctagggccgtcaattcagaacgagcattcagatcatgatacatgaacaccaatgctctttaccgaacaaaacacaagaggattaaaatgccaagcagcatcaaactttgctcagaaacattaagccaagtcaaatctcgtaatagtaacacaaccaaagaaaaacatttttcccacatagcatttcaaacttcatgacattatctccagtggcgatgttaaaacattttggcagtagtgctaatttaacagaggttctacagggtagcttttgatgagatacgatttagacagccggcgagaaccaggcgaccctttcctggggatcaagaaatcttcagcgctttccaccaccaccaccaatcttcgggcccttggaacccctcggggcggcacccttcgactgcgacttctgggacttggttacctcagccttcttcgccttcttttcatccttggtcttcttgatgcgttccttgatctcactgcacaatgcataagctcagatgaatttagtcctttagcatcatcgaaatgtatatcggaggattatgcatacacaagatgcaataggggattatgcatgaatatgaacagagagttcactaggagcagacatccaataagaatgggtagcaaacatcatgttgcaatgatacagtgagctgtgcagaacaaaggcagcaaacgaaaacactgcttgagaagttaagaggcaccgcatgaggtaagggctaatgcagtgaaaatgaaggcaaaatgtaacccatatagagtggcaatgttctattccatgggtggatactttgttggaaccagtaaccagtctaaatggcaatcattcagggaaagagcataccgaagagcagcttctctagcagcatcacgaacttcaggcttttcagctctcttcttttggatgacttccaacgaagcaccaacaattgacctagagtatggcttcttggtggtgcggcgcctcttcttgacagcttcagcatggatatcctaaaaaacagaaaattgggaaagggtgtaaacagaatttatctgatcggaagcaatacatagcatgactaactgtacatatatacaaggaattgagcataagctgacaaagagaactacatggcacagacataaccaaagtacccaaacatacaatatttttatctgcacgcaaacactgcaaggcgcttatttgaagaatcaacatgatgtttgcacagtaaaaaaaaccgcaatcttgaatgtagacggtcacacttaatcatacaaacagacatttactggaatccaggtttgatagcttaagaaacaattaacttagcatttcaagcacaatacaacattacaaattttaagcattcggctcaacccaacaaatttaagaaagcaacggtcagtgaacaaaaaaaaaagggttaaaggtcatccagttagagtatgtgcatataggtgagaaaacgcccgcctaaatctagatacaataccttcttgtgctgcttcctgtacatggctgtccaggtaagctttgcaggcttcaggcggttgtggaagtagcgcttgcattttgagtttgcaaaaaggaagacctgtacaatataccaatacgtttacaacaaccttctaagcagagaaatatcctgacattaaagcaatcattcgatgaacagcctgacctgtgaatcagcacgaataaagcgaatgcccttccctggatatatcttctggccactaaaacggcaaagctctgtcctgtaggataaaaataaaagtaatagttgaaataccttccaaatatgaaatagtactcattggtaaatcattgctattaaccttttactaccattaaccaaaaaactacatagcctagagcatgcacaggataaaagggcactaaaacaatctacaatcatattgaaacaacaaaatatacacaggaacttacttcagcaccatcttctcagcttaaatcctcacagaattctgccaaatttccaacatcaaaagaaaaaggaatcaggactagaatccagaaaacaaaattgtgcagaggtaatcatggaacattaaaaacctacatcaagatatcgacaatacacagacagggtaatcatctcaaattttaactattaaaaatgtagggattctacaggcagtagaagcataatcaacttagcttagctcctgctgcaaggatactaccctggtccatcttgcacattaatcaactaggctactatgcaatcacaaaggccatagcacctgagtgcgactgtgcgacacacacaaggttcctcaaatgctcaaagcactcaagagaaccagaaacattgcagttcatacgcgcatcggattaccatccatgactaggaatccagaaacccagaaaggggtgaactgtcgggtgactactggcagaagaaacatgagacaaaccttccctgcaaagcgggttccctggttcatatagcacacacaagaataggctactacgccatcacaatagctatatcgcctcagtaccggtgctttccctcgcatctaacaaatctagaatctatcaaagaagcgcagctagtcatgataaatcagaccaaacagaataactacatactccacaaaactggaatccttcctccaaaggagtagcaaccgatgtatatacatcgcactacactacaggtaatccagaaccccagaaaggggtgaactgtcgggcgactactggcagaagaaacatgggacaaatctcccctgcaaagcgggttccctggttcatatagcacacaaaagaataggctgctacggccatcacaatggccatagcgcctcagtaccggtgctttcacacgcatctaggcaaataatccagaatctatcaaagaagcgcagctagccatggtaaatcaaatcaaacggaatcaccacggtgtcacatactcaagaaaaccggaatcctgcctccaaaggagtagcaacagatgtatatacaccgcactacaccgtgtcaagatcaactataagagagaagaagaagaaaccatccccatttacaagctcaaggatctccggcatttcttcttcttcttctcgaatctagcctaggaccgccgcaacgaccaacccgccctaattcttctagtcgctcgagggaaatgtaaagggcagcagaggcatagacgctgcaagaactatctgcggcggtggtagaggcgagacgaagagcatttcgacgcgataccttcggagcgcagccgtcggcagcggcgatgcggcggtggcggcggcggcggcggcgcgggagggagaggggggagcagcgtgtgctccgcgagggtttcttatgagacgggggagagctcacgagtgggccgggcttaagattggggaagttaggaacaggcctatatgggcccgatccatcggcatgtgggccgtcaggttgaatcctatgcgtatggtccgtgggcccgtggcccatcctaatctgctttgcttaggcttttttttttcattttcttctgcgagatgcttaaccatcttttttccccattttgtaatagctcttcgtttttattacatcatctgagagagcatcttcctactagggtctgtttatatttgagttgaagtgcgtatatttggtactaacttttttttcgtagtcaaattgttttcactttgaccaaatttattaaaaaaaagttagcaaggtcaataacgccaaattagttttattaaaactaacatttaatatatttttataatatatttattttgtgtcaaaatttttttttatatttttctataacttttctagaaacacattaacatttaatatattttgataatatatttgtttcgtgtactatattttttgagaaacacagaataaatgcatgcgctcaaaacgtgcacacacccactcctatgagcacctccagaagactggaccagcatatctctagatcgatgaagtcaccacgggcgtcaatagaagactagaccgatatattttgaggttgatgagacgaagtcactatgggtgtcgatagaagacttggtcggcatatcctgagattaacgaagtcaccacgagtgcctatctgtcgatgggtaagtcgcctatcactgaaaatataattagccgtaaatacaagtatatatgtcaattctatgatttgagctcagatgagctgtttccatcacaagtaatctagttgagctatactcatttcatttctatagattcgatcaaacttaaaattttaattaatatttaagtaggaaaaaaataaatagtagacgtgatttagtttactactccatctgtttagtctacgactttgccagcagacaagctgaggggcaaaacggccggcgagcatccacggtgctagtagtcttcaatatgaagcgtcgccgtcgacggccggccaccgccacacctgcgcactcgtcatgccgggattttcgccggtgcctatctagtaaaaaaaaatcttgcccacgtctaaaacaaattatttattgaattatttttacaaatttagttataaaactaaattaaatatttgataactaaagttaacaaaaaagctttcaatgcagtacaacacggtattttcatgaaaacatactttttttaaagactcgtgggaaagaatttagcctagatatagttgatggtcttaaattattttttttcagacaatatgatatttttgctctttgtcttaaattaacatttgagactgattctagaaatgtaatttgactaacatgaaatttaataatataatttattaatcaaaatattattacaccgtagcattagcacgggtaaattactagttctatgaagtactagaaagaacggacatagagcctgtttggggaagcttttagtagctgaagatttttctagaagcactagttatcaaatcctccctcaaacaatctagattttcattcagattctaaaaagctgtagctgtagaacctagggatggcaattttcccgttgggggcggggacccgccgggtacccacccctacggggacggggacggggcgaaatttcaacccgcggggctgcggggacggggcaccggaactatgcgggggtgggggcggggccacaggctcacccgcgggtgacccacggggccccggaatatagggatctaaaatatggcatacagcccataatcaaatttaggcccatatagcccaatatatatatatacagatcagtaaagagaagccaaccctaagacttgtttggtaacttgagggaaggggattaggagtttacacgagggaatttatgatgagattaagatgggaatttgatttttaatcccaatgtcttgtttggtagatgtgatagaaactgatagggagtttagttggagattagctcattaataaaaacggatggctgagatttgcttagacaaagtaaaggagaaattccctcccaattacctgcccctacccaggtattgaaaaggagggagtttcttcctcaattccccatcccaatcccaccaaaattcccatgtctcccaaccaaacaaaatacttaatagcctcatccctctaatcccaattcctcttaaaaactccctccaaccaaacgggccgtaaaatcaatcccgtgagtttgtcgccgccgccaccaatctctattctcgttccagtagttttgacttttgacgctatcccacaaatcacgcaacacatcacacgccgcacgccgctttggcgcttcctcacctccacaaatcacgcctcgcgagttggtcccgcaccatcaagtagcggcggtcggcgctcttccacgctgcccgtatcgttgctctcacggacgccgtctccccatcctgccatccgccgacgccccatgtcgttctcctacctctccagctgccggcgcctgtgctgttctcctccttctccgaccgttcctctccctccggctgctgcaggttccccacatcattattcccttcctccacccggctgctgcaagtttcccagaccattctttccttccttcggctgctagcagtcgccgcttgtatctgggtgcggggacccggaaatggtgcggggccccggaggggccgggggcggggattgatttcgccccgttcctcactccggggccggggccgggtgaaccctcaaggatgcggaggcggggccgttcctatccaacccgcacccgccccgtcccgccccgttgccaaccctagtagaacctataaaataaactataaactaaaagttggcttctccatattcttacccactgtttctcgtaattttaatctcctcgagacaaaggtcatagtttgaccgtcaatgttcagttcgctctcactgggacaactttcagtttttcagcgccgtattgttatactagcctagcacatgcatacaccacacattatcagcgttttttcaacaagacggcaatttaattgacaaggatacgcattgcatttgcaaacgaattgacaatgccactaactcgccgtaacgtatggccggcctccgtgagaatgaaatgcgagtgagactgatcaaatcatttcattttatcatgtaagtgcagtgtctagctaaattcacgatgagcacgcaacacttcagtagagaacaattaagaacagggtaggacgtgccatgccacacgaggagtttctatacgtacgttctctatcttaaataggaagaatatatacgcaaacatctccatgtagtgcgatttctcccactacatccactccactaattaaggtgtgatttctcccactacatccacccactaattataaggtggcatatatagccacatgttaaggttttagaattcaaatgtcgatgtttgaacaaggatgagatgcacgagacaatactgatttttacaaacacctgcgtgcatcacggaccgtttaaccgtaggcgaagatcgatttcgatcgcttgatctgtagtagtgttcattcatagagtatatttcttaaaccgaaccttagaattgatagattaattgagtcagctcagaccgatcagtgaagtgcacaactcttttaaatcacaataagaaaatcccttaaaagtaataaggtagagctatattacgtggcgaaatcaaaaacattaattaggttgagttctttagttgatcgaggttaggaactaacatctcacgcacgtaaaatgaagtaatttattaacttatcactaattaagtattagctgaacttttatgaaaaatgaattaatatattttttaaacaacttttgtatataatttttttaaatacgtattatttagcaatttaaaaaacatacgcatgaaaaacgagagaagtaagtgaaaaacgtgaacaaataaactcaaccagagtattaagaacacgctctttgctccgtggctcgctcttaaaatgggttgtcaatagacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttctagtgagccatgccacttgtcgccgtacgttcagttggtccacggccactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttccttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccacaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaattagctattaaattgactatatcagataattttgagtcagtagttagctatactattaaacttgcttttaaatgtgtttggaaccgacgccaaatcaatcacctgcgcacatatggctcatcactttttcttgcatgcatgcattaccgccagattaaactgtatattagagcaagtttaatagtattaatagtatagccgattatgggctccaaatcatatatagttaatttaatagtcaattcataccatagttatctttaagtatgtgctacataattaatgtctgatcccacctatcatacacacatgtatcttggagtccatgctgcagctggctacaaatctgtagcccgctgctcttatctcttctcttttatcttcttaaaatatgtttatagctggcttatagtctactattgtacatgctcttatagtttctctaattactccctttgttctaaaatataagatattttggtttgatgagacatatcttataaatagctctagatttgtagtactagaacgtatcctattcaattaattttttttatattttgagacgaaaggaatacctaactttacgcatgtcaaatcttgttgaatcatcacagcgatagtaaaagttctctttttctttagaggaatcttaaaagttttctagttcttacatcacttgagaacaaacaacgaaatcaaatcttgtcattatgcaaacgcttcagaatgtctaaactgctcgttgtttgcttgcttgtgccgcccaactcacactgcactagcttgcgatgacagcattggacatttgttaatttggatgatatctccattgacaaaatatctggcagtcgacgtagtcaaatttaatgcaggaatgagttgtaaattgtaatcacatggagattattgacatgactgctgttagtgcagagaacttgtgtgtgcgtgcgcgtgtggttttgacctgaactgtagtggtgactggccaaactgcactgcagcatcaatgtgctgtttagtgatcggtgtggagggtcaactgaataaatttcagactttagcagcagcagcacactgaattaatttgagaaaaaaaacaacatagtactagaaatctcatcagtagttcttctgtccatgaacagtggcagcaactatcagtcgaccactcgtgactaaccaggtcaagatcactagaccagctcgagatcatatgaagtttcaatggaatctccaacaacatacttcctttgtcctataaaaaatcaaattaagataataagagatattttctagtataatgaatttaaacaggcttttaaccagatttattgtaatagaaaacattacatctaatcctagattggtttttataggactctttcctccttcagtcccaaaataagtgcacttttacactgttcatgtccaacgtttaaccgtttatcttatttgaaatttttttatgagtattacttttattgttattagatgataaaacatgaataatactctaagcatgactatttgtttttaatttttcataattttttaaataagatagacggtcaaacgttagacacgaatacccacgactgcacttattttaacgttgtagatgacagtccgacagtgacatggttcatatgattccctcagcagactattagaagctttgattagcctttgccaatggctgctctcgcttggatttaagctcctggcactggccactatagcccactagccacatagtactatggagtatggacctgcttgaaagctgtagattccaagggcccgttcgaacgagcattttggctcagctaactggcggcacttataataaaataatctattaatgcataattaatcggttcctataaacttaaaaatagaattatttgattttagaaaagccttttgtgtagaaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaaggttgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtatttcttttcttcagattaaagtatatctgcaaattctttaagctgcattattttgacttgggagcaaccagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacatatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacagtgcgtgaataaatcctgtaccactcgagaaaaccaatcattgattgctttaagtatatccattcgtgccagcgttaattaggacaagaaataggttgtattacaggttgtcgtcatgaagctgaggcaacaaagaatgaagaaaataagactaaacgaagtaaaatcacatgtacatccaggttatactatataagctgggctgggatttggttattacagaatgtctacacttggagtaggtgatcaatgagtattttacctagaaacatatgtgacggtctagttttaaaattgatggtccttaatactttttttactttctttcttttaaactggttcatgtgtgtcttggttgtgtacatcctagttataccgagatcgagaatactccaagcacaattgtattattttgatgtaatgtgactaagatcaaagaaagcttctatttctaacaaaatgtacatcctagctgtgtgtttctttgcctgcctgcaatggtgtttgaggctaaagagctatgcatgcacatttaacgttgaaaaatactttcatagatatgactcaaaaatactttatcaatcaagctgttgctccaattagcttgcttgtagtttcatattatctctgctatgtattggcaactcctagaatttataaattgtctacgaaacatgtttttttcgctgtggcctaccctcaaaggctcatgaaaatcgacgagtttaaaaggcgggcacgctaaaagacctgcctaaaaaaattgattttcgcgggcggcacacttaagtcactcacctaaggatttctagtgtaaaaagatgaaattccaaatcctaatatcctccaattcacaaattcatgatgcaattccaccataacaaattttaaaaagatttgacaaattcacaatgcaattccaccaaggacgtcatcatcgacatcccaacgtcggagtcgtcctcttcagcgtcttcttttgggagaagccaacgcaacacaccatcattggtgttggcgagggagggcagaggccggccacgacgaggtctgcattatttttggtcacaactatataggtcatgaggtggcggtgccatataggtatttattaaaggcatagaggagaggaagaggtgactaataaatgtggataagtaataccttgatataacagttgataattttatactaacacaatcaaatggcttaggactacccattatgtgtatctggttaaatgtgaacactactaaaaagacacatgcaggttttaaaaaaacagtattacccaaccgaggaggtggaggtgggcgacaaggcgatgctgctcctcttggaggcggaggcgagcgattccccctcccccttcccctctcggtgcaagacgacatcagtggcgtcgacagcggggtagggcagtgtcagcggctgttcccgtggcagcggacggggttgataatttgaaactaacatgatcaaatgggttaggattgttaataactgtagccaattaaaggtggagagaatgggtagagattaataacgaatgcagataagtaactccttgatctaacatttgataatttcatactaacataatcaaatggcttaggattgttcatgacatggcttcgtgcatgtgcttatattcgtcacaactatataggtcatgaggaggtgttactctacaggttttattgaaggtagagaggagaggaagggacgaataaggaatgcagataagtaactccttgatcacgattgattgttttatactgacatgataaattgacttagcataatcatgatgtatatttgttaaaggtggagaatagggatagagatgactaatgagtacgggtaagtaactcattaatcaaatggttgattgtttcagactaacataatcaaatggcttaggataagagatggctagtaaatacagacatgcaactcatttatccaatggttgataatttcatactagcataatcaaattagttttgattcactcatgatgtaaatctaattaaatgtggagagaagggctagaaattactaaaaataaatgaggataagctactcctttgtccagtggttgataattttatactatcaaatgacatagtatgactcatgatgtgtatctatataaaggcatagaagaggggtagggatacctaatgaatgaggataagttactccttgatccaatggttgatgtttttgcactaagataatcaaatggctcaggttaagagacgacaaataaatgcagatactctttgatccaacagtttattttgtactaacatgatcaaatgggtaaagattactcaacctaaacataggtggagaggaggggtagagatgactaatgaatgcaaataagtaactccttaatccaacgttgatatatttgtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcagcggcctgatggatcggacgaaccctatcactgtaacatgtatgcctagctatttcttttcattctttcctcctctctttaaatattttttcttctaaattacttatccaatctacgaaccaatcacactattgtattcgttgcaattaaatatttacaacaagatatcatataattatattatgtcaaaagaaaaacatgtgtttcaaaccgttaaaactaaatgtttcatgcgtgatagtgatatgtttcaatgtgcgtcttccgtgtgtttcataaagagcaatgctacacgtactaaatttttctgactaaacttttactaacaatcatttcaaccgtttgatttaagtagatagaagttataaaaaaatctagatgcactcatagcatgacacatcagtattagtaagaatttagtaagaaaaagttagtacgtatagccttttcctttcataaattttttgaaactaactgctactactttctctccatctcatccatgcacacatgcatgtattttagcaaacttcaaaataatttttctcttaaattatttatccaatctatgatccgatcgcaccattgtattcgttttaattaaatctttacaacaagatattgcatgattatattttgttgaaagaaaaacacatgtatccgttaatacttgctgtttcatatgtgacagcgacctgtttcaacgtgcatcttcaccatgtttcataaaatatttaaatgtttcagttgctgatttttttgtttcaccatatataacttaatgtttgacttgttggccaactgcaatatttgaccatccgtttttttttcatcggacgtccgatgggtagctttctcccaacactacgagtcaactacccatcccagtgccatccatccatacatcatcgtctcctccgaccacagatcacacacacccaaaaaaaacaaatactccctctgtttcacaatggaagactttctagcattacccacattcatatagatgtgtctcgattcactaacatctatatgaatatggacaatactagaaagtcttacattgtgaaacgaagtagtagccacgagctcttttttctcgcggccattcttggctgcctcggttgctacctcctgcatgtgccgcgcaatggaaatgaggcctcgtgatctcgccgccgtcctggctatgtcctgcctattgctcctcccactactcgtctcctcggtgcccgtgtcgggtaaagcttcgtcgtcatagatctcctggaattcttgatatgtgttttgactagttgataattataatttgcgtgtcgatgcgttcttgcaggaatcgtgcacttgagcagccaacaacaacacccgtcatctcgaaacatctatgcagatgtagttaatctttctcatgtccttcaatttctgaattcccgtaagatttaaattaatttgttggcatgttactacaaaatctcgtagacagttcatagccacctttacaaaccaattctaaaatgaatatgtactttctgaaggctaaattctgaaacaattagtaatgttggtgatagtgattctgaacatggctttgtgtatgtccatgcagggatatggtggcagcggcgacggacgtggaggtgaatgactatccagcgctaagagccaatcctcgccataaccctaaacgtccactggggagagaaatgtccgtccaggacatggtggcggcaacgacgaatgcggaggtgaatgactacccgacgccaggagccaaccaccgccataaccctaaacgtccaccaagaagagaatgaaatcaatcaagctactactggaactagctagcatgtagttctgcattatttctgctagatgtcagtgactctcagaattaataaagtatataattacataagtcaagtgcactattacgaaacaagattttttttcgaggtggtcaaaacgcgatttgcacatggccacacaccctgcctatgattgaaggcttgagaagatctacagttttcgaaggcaagcatcctaagagacccacttgcaaaaatcaattttttataggtggcacacttaatttacccacatacaaaaagaatttctagtgtaaaaaatgaaaatctagattttaatatcctccaatttgaaaatcagaatgcaattccaccatcacaaatttaaaaaagaattgacatatcaaatgcaattccgccaagaacttcgtcggtggcatcccagtggcagagtcatcctttgcgcagtggcagagtcatcctttgcagtgtctttttcagggagaagccgatgcagcacaccatcactggcgttgacggtggaaggcgaatgccagccgcaatgaggtctgcattattttggtcaaaacaatatatgtcacggggaggtggaactataaaggtcatgagaagatgctactatcaaggtattattaaggaaaaagcccaaattagccccctaaactattgtggcagttgaaattaccccctcaattcaaaaactgcaccctcaactttttatatggacgaattacccctgacaaacttcggaacagttttggtcttacgtgtcgcacacgtggcagtccagtcagcataaaaaaattaaaaatatagggcccacatgtggtgactaagagaagaggcaaaattgacaagtgggctcctctatttttttattcttttatgctaactggactgccacatttgtgccacgtaggaccaaaaccactctggagtcgatcagggggtaattcgtccgatatgaaaagttgagggtgaagaatgtctggtttttgaattgagggggtaattcgtaccgccacaatagttcgtggggggctaattcggactttttcctattattaaaggtagagaggagaggaagaaacaactaagaaatacagacaagtaactccttgatctaacagatgattattttatactaacatgatcaaatgacttaggttactcatgatgtgtatatgttaaaggtagagaacagtagaagagatgactaatgagcacatataagtaactccttaatcaaatggttgactgttttatactaacatattcaaatggcttagataagagacgaccggtaaatatagatatgcaactcctctatccaacggttcataatatcatactgacataatcaaatatgtttcgatttacttgtgatgtgtatctaattgaaggtggagagaaggggtagaaattactaaaaattaatgtggataagtaactgccttatccaatgattgatgattttatactaacatgataaaatggcatagtatgattcatgatgtgtatttggataatggtgtcgaggaggggtaaggatgactaatgaatggggataagtatctccttgatccatcggttgatatatttgtattaacataatgaaatggttcggcataagaggcaacttataattacggataagtaactccttgatctaacaactagttttatgctaacatgatcaattggataaggattactcatgatgtgtagctaaatataggtggagaggaggggctaaggagatcacagatgaatgttgataagtaaatgcttcatccaacgtttgataagtaccccaaggcagcggcagcaacactgcgagtccactactcatcccagtgccatcaatccatccatcattgtctcctcctaacacagatcacactacacaaagaacaacaagtagccacgagctcttctttcttgcagccgttcttggctgcctcggttgctacccctgatgcgccgcgtaatggaaatgaggtctcgtgatctcgtcgccgtcttggctatgtccagcctactccttctcccactactcgtctcctcggtgcccatgtcgggtaagcttcgtcgtcattgatctcctggagttcttgatatgtgtttttactatatgctaattataatttgtgccttgattcattcttgcaggaagcctgcacttgagcagccaacagcaacacctgtcgtctccaaacatctctgcagatgtagttaatctttctcaagtcctccaatctctatattcccctaatatttaaatttgccggcctgttaataaaatatcatagacagttcatagctaccttcacaaaccaattctaaaatgaatatgtacgttctggaggctaaatactgaaacaaatagtaatgttgatagtgattctgaacatggctttgtgtatgtccgtgcaggacatggtggcggcgacgacgacggacgtggaggtgaatgactacccagcgccaggagccaatccccgccataaccctaaacgtccaccaggaagagaaatgtccgtccagggcatggtggcggcggcaacgaataatgtggaggtgaatgactacccggcgccgggagccaacccccgccataaccctaaaagtccaccagggagagaaatgtccgtccagggcatggtggcagcggcgacggacgtggaggtgaatgactacccagcgccaggagccaatccccgccataaccctaaacgtccaccagggagagaaatgtccgtccagggcatggtggcggcgacgaccgatgtggaggtgaatgactacctggcgccaggagccaacccccgccataaccctaaacgtccacctgggagagaatgaaatcaatcaagctgctgctggaactagctagcttgtagtttcgcattatctctgctagttgtcagcaactctcataattaataaagtatctaattacataagttgagtgcactactacaaatcaagatttttcgaggtggccaaaatgcaattttgcacattgccagacgccccgtctgcgattgaaggcttgtgaaaatcgacggttttcaaaggtgggcaccctaagagatccgcttgtgaaaattgatttttcacaggcgacatgcttaattcacccacatgcaaaaataatttctagtgtaaaaaaaaagaaaatccagatttgaatatcctctaataagaaaattcacagttcaattccaccatcacaaatttaaaaaacatttggcatgtcaaatgcaattccaaaaagggctttgtcgtcgtatcccagcgtcggagtcatcctctgcagcgtcttcttcagggagaagccgacacagcacaccatcattggcattggcgaggcagggcgaatgccacctgacggagcgtggggctcctcaccgggagaccgcgcaggtccccctttgccggttcggccgggggcgctaagtgaggttcttcgccctcgatctgaggaacgtcagcgagagaggaagtgcacaagacacgagcgacgtagacaggttcgggccgctgagaagcgtaacacccaactcctgtgttctggtggatctgtgtgtgaaggaatacaaagagccagagagcgagagagagttcaggctctagaaccccttcgctagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccggtcacacaccgcgaccggtcacggaccggataagcgtgcgctgcgccgcattaaatgcggcgtggcgcgttcgtccatcctgctataaatgcggttaggtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccctcgggcccgaccccccccccccccgacggggtcaggccacgtgggtgaccgcggctacccaagcctctagtcacgatacccccggccccatgtcaccgacagtagcccccggcgttacgccatggtgatcgcccccctcgagggaagcgctcgggcgtgacgccactccttaggcccggtgacaggtggggccggtccctacaggtgggcagaaacccagcggtcgcaaatcgcgcgcatcggcaagggaaaaccgaccgacaataatgagcggcctctttaagaccgctacattactcgagcagcgcgcgaatcggaacgagccggctcgtttcgcctggagacatgatgatggcgcttttcacggttggcgagcgtagttaatgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttccttcctctcgctactcttccccttgccttcgccacttgcgctctaactcttcgtttcctgtgccctacccttgccgcactcgctcgctctcaagctcctcctccgccggcgtcatggcacggggctccgcaccgctcgacggtagcgtgctgccgccttcccgcatcgtaagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctgcagatggcgcacctcacccccaacgcgataatgacgttggccatcttcgcgcacctgtgcgagatgtttatcggggtgcgcccatctctccgactgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggtgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtgatccaacgggtgctgaatctcagctccgtggaggcatccctcatcccccaaggggtcctccccctctgctgcgatccagagcgcgccaagatcctggccataatgcaggtggtcggggcgtcgggggagcgggccccccgaggccacgatggcgcgggcgggagccgcaggggggaacaatctaccccgggagggggtcgtgcttctgggccccttgacgggggcccggggggcagccgccctgccgacgcccgggggaagaggaagcaggagggtacccctcccccatctcctccccgagggggcggggcggtgcgtgccagcagcaggcgcccggagggtgccctgccgacgccacagcccgagggggagcgaaagaagaaacggctccgcaagatgggggggaccgagccatgccgggggaacctcatctcgcccccgaggtggtcgtttagccgacctccccgcaggttcgtccccgcacccaccgcggccgtattcattctcccatctcccaaggcgagttttcactcacccgtttctttttgtcttctggtttttcttctgcctcagcgagatcccgtcgcgccccccccccctccccccccgccattccaagtccagccggtctgaggccgaggagacggcgaccgcggaggcccggaggcgggaagctgaccagcgagaagccgcggaccgcctccgggaagccgaggaggctgcccaagaggccgtccgggttcgccaggctgaggaggccgctcgggaggaggccagactccgccgggccggggagtccgtccgggaggcagaggcggcccgcgcgcgccaggcgacctgccaagcccccgacccgactccgcccgaggcgacgacgacttccgaggctacccacgacgaggccgcgggcgcgccgctcgggcccgacccctcgggcgacgcttgggacaagccagcttcgggggacgccctcgagtccagctcgtcgatcggcgggccgagccgcgcggcacccacaccgaggcggctctcccctctgccttccgctgccccactgagcgcggagcccctcctgcaggccttggccgccgcgaacagcacggtgctggacgggttaagtgcccagatggaggccctgcaggcggagcgggcggagctcgacgcggcgtgggcgcgtgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgcttgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcactggaggagcgcgcccacgccctggacgtgaaggagagagacctggcggaccgcgaggccgccgttgccacccgggaggcaacactggcggcgcacgaggccgcctgcgccgaagaggagtccggactctgcctccgcgaggacgcgctcaccgagcgggggcaagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcaaaggagctggacgcgagagcgcacagcggcggggcggccgcgggccacggcgacctagccgcatgcctcgcagccgctgaacacaccatcgccgagctgcagggcgcgctggactcgtccgccggggaggtcgaggccctccgcatggcgagcgaggtagggcccggcatgcttcgggacgccgtctcccatctagaccgcgccgggcggcaggcggacctctgggcgggcggtacgcgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccatgggcagcgctggaagagttccctcctggaaccgaggacggcgcgcgcgcgcaggtccgggacgccgctgaccacatcgtccacagcttcgagggtacggcccctcggctcgcattcgcgctcgactccgacgaggagggcggtgacgacggtgcggacgacagcgacgacgaggccggcgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgaggatggtttgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccggttggcgattttagccggctcgggccaccgagggcagggtcgagcacgagcgtgctaattcaagccaagattcttcaaaaggaaacgatggcacaaacacagtcctcaggaaatcaaaaatgcttttattgaaatacggaagagaaaaaaggtaagtatatgcatgtggtagcccccggccaaccctgcacgcccgggggggtgcggggttggcccgagcctgagacatgacacccgacccccactaggggtagaagcgacgaaggtgctcgatgttccacgggttaggcagctctgtgccgtcgcccgtggccagccgaacggagcccggccgggggacgccgatcactcgatacggaccctcccacattggtgagagcttgctagtccagcacgcgtttggacgcggcgtaggacgaggtcgtcaacgcagagtgatcgggtccggacgtggcgctgatggtagcgccgcaggctctgctggtagcgcgcggctcggagggccgcgcgccgccttcgctcttccagatagtcgaggtcgtctcgacgaagctaatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagttcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtgttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcaacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgctgagagccgtcggccaatagaaaccctggcgaaaggccttgccaaccaaggtgcgtgaggcggagtgggctccgcactcgccttcatggacatcggcaagaagctcgacgccttgttcccgaggaatgcacttcaggaggactccgttagccgcgcgccgatagagggtcccttccaccagcacgtagcgcttggagatgcgccggacgcgttcactcctttcgcggtcctcgggtagagtctcatctgcgaggtacgcctggatctcagtgatccaagcaatcaatctaggggagctgggagcgctcccctcgggtcccgaggcttggactccgacgggccgtgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcatgtgccaaagctctatcccgtcgaaatggcgctccatacgccgtacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcacaggcgccctgaagagacagggaaccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcactaacgaagtagatgggccgctgcacctttcggcggggccgatcctcttcgccaggggccgcatctccagggcgctcttcgtctgagaggccacgcggggcgcactcggcttctgtgccgacgacctcggggtcagagggcgacaggcgcggccttcccgcagtggccctggggccatcctgggggtcgggggtgcctggcaccgtcggacaagcaggtggagggccagctccggccgtcgggggccttgggccgccgtttggctcgggggcctctcctccctgctctctcccgggtcgagccgatacagggtggggatgcgcggagtgagggttgtcctcgtcgcgctccacgaccaatgccgcgctgaccacctgcggggttgccgccaggtagagtagcaacggctcatctggcttcggggcgaccaggaccgggggagaactgatgtacgccttcaactgagtgaaggcccgctcagcctcctccgtccaggtaaacggcccggagcgtttgaggagcttaaataagggtagtgccttctctcccagcctcgatatgaaccgacttagggcggccatgcagccggtgatgcactgcacatccctaagcttgctggtggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtatcttggttgcgcgacttcacaaccaagtcatcaacataggcctcaacattgcgtcctatctggctactcaaagaaattcgagtagtacgttgaaaagtaggacctgcattctttaacccgaaaggcattgtcgtataacaataagttcctatgggggtaatgaatgcagttttttcctcatcctccctagccatgcgactctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccatcgcccagggcaacctccttgaccgggacctcgtcgcacgtgaccatccgctgccttggggcggccgggacggaggtgctgagcctctcgtcgccacccgcgggcttggacgccgcggcgaggtggtctgcgcgctgctccatacaagcaagcgcgactttgaggtcgccatggacggtgatggggccaccggggcccgacatcttcatctggagataggcgtagtggaccgccgccatgaacttcaccaacgcgggcctcccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcaaaggtgagggcaacctccgaccaccgcacccgccgtgtcgcctcatgggtaggggccgcagccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgtctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccggaggagttccaggcccaggcctcctccttgcgagccacacggtccgcgagctcaaaaagctacgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactactggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccatcgtatttttcggtgatggtgggccggaaccttgggggccaacggacgttccgaaggctcgacagccggcaccgccaaccggggacacggggggccggcccccgtgtccggaccgaagtggcgctccggacgaggaagcgccctccgttgcgtgggcggcgcgacgaacgtcgcgccggcgctcgatatcgaggcgggcatccggccccccacgcacatcttcttgggtcggaggcgttgacgagggaatggcggacgaacggcgggttacggccgccgctcgccgcgccctccgcctcgacgacatggagccggcggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcacccgcagcctggagcgcgccctggggcgtgccgccatcgccgtagacgaggcagcgacgcgccccgtctcgccgtcctcccccgtcgcccgcgggcggcgaagtcacggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgtccggccattgggctgagcgggagaagcttggcgcacacgaaagaggacgagggcttagaaagacacgcgcaccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagaaccccttcgccagagtcccaacccctctttctcttttttctctttttttcccctcctaggcctgggcctccttttgatctggtcaggggtcaccacatgggcctctagctgtctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccggtcacacaccgcgaccggtcacggaccggataagcgtgcgctgcgccgcattaaatgcggcgtggcgcgttcgtccatcctgctataaatgcggttaggtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccctcgggcccgaccccccccccccccccccccgagggggtcaggccacgtgggtgaccgcggctacccaagcctctagtcacgatacccccggccccatgtcaccgacaccacccataaagaggtctaaattattttggtcagaactatattggtcacgagaaggtggtattatataggtcatgaggaggtgttaccatatagttattattaaaggtagagaggagaggatgagatgactaagaaatacagataagtaactccttgattattttatactaacatgatcaaatgacaggttactcatgatgtgtattagttaaaggtagataagaggggtagagatgactaatgagtacgaataaataactccttaatcaaatggttgactgttttatactaccataatcgaatggcttaggataagagacgactagtaaatatgtatatgcaactcctctatccaacggttaatcaaatatgtatctaattaaaggtggagagaaggggtagaaattactaaaatgtaatgtggataagtaactcccttatccaatggttgatgattttatactagcatgatcaaatggcttagtatgattcatgatgtgtatttggataaaggcgtcaaggagggatggggatgactaatgaatggggataagtatctccttgatccaacggttgatatatttgtactaacattatcaaatggctcaagataagagatgacttataattgcggagaagtaactccttgacccaacaactaattttatactaacattatcgaaggagcgattctctggcagcggggaagtgtagacccctccccaaaaataaagatccgaccaggagctagttgcgcacgatgctccagaaaacaagtttgtggggcccgagcaccccaccaagcatatgaacacaagatatttatacaggttcaggccactcagaggtgtaatacgctactcatgttctttttgttggtatctatatctggagaaatacaaactttgcctttttcaaaccagacacaagttagcccttttttctagcatgtcccttttctattatagtacaaggaggggctcacggtgctaccattctacatcctttttgcattgtcattcaaccgtcttgtcaatgccgtttggtttccttcaaatgtccccgagaaacctacctaaaaaataagattatagtgccccaggctccaagaataagatgaagtataaaaccatttctctgcttccaaatgtgccaagcaccatataaaaatttctccacaaaatgagatgaagtatatgaagcttttgctgcttgaagcatatctcccaaattgaaattctagtgccagactataaccacctgaagccaacattctttgctgaatgcacattcaaagaagagataaaagaaagtttgtattcctgtcacatagggcacaaattaattcacttcttcctagggcacattcaaagtccctggcctatccccttccacctagggatgaaaatggagcggatagtttccgtccattccaaagaaaaatagggatggcaacggggcggggcagagccgggttgggttgtaacggccccgctcccgctccattgcgggtccacccggcctaggccctgaagtggaggatgggtcgaaattaatccccaccgccggcccccccgaggccccgccactcgaccgggggcccgctgcacctgcaggagaggattcttggaggaggcggctggtggatgcgccgtcgtgtgacaggaggaggaggcgccgccaagcggaggcggcggcagcggtggcgcggcgacgaacaatgacagcgtggcaacgagcagaggcggaggcaagaggcagcgcgacgatgagcagaggcggagtggaaacaacggcgatgagcggaggtggaggtgacgcggtgacagccagccagcggcagctgtggaggatgggtgaggggagtgggagtaggggatgggggattgggagattaggatttaccttttatatgtctcacttactaggccaactgggcttgtattgttggaatggactacattttgagacatatctcatatcccgaggccccatcaggtcacacgcaaccgcgcaggtggtttacaatccctgccccagccccggaaatttgcggggccccgtccccgctcaaccccgggtgaaaatcatccctccccccaacccaccgtggccctatagggtccctggccccaatggggaaattgccacccccagagaaaaatgaatacagataccttccggagcggatagtttggatacatatattttcttccggataagaatacggatattgttaaggttatagataaggcatatcctatgatcttgggttaagctcggcaggacctaccatataccaagggcctgtttgggggagcttaagattctgagaagcagctgctgataagctagctggtgagaatctggagaagctaggaaacccagcttctggcttctagttcattttccaaattttataactacagattttcataatctgggtaaaaactggactgtttgggggagcttctggcaactagagattctaggagaagctgcagctgctagaagctcccccaaacaggccccaagtcttatacgaaatcatgcctcgcatacggaaggtgttccagataaggaagaagaagcagggtttaatattggaaactataaggagtactcagattgtatacattcttgtttccctagttctacatggacaagggaacatttgggtataaatacaagatccctgggaggagaaagtggaggcccaatcatcaatacacgccgccagacacaaacacagagataagcctagatatacccaatctggagccgcagaggctgacaagagggatctagtgttatctctgatctcgccaagttcatgttcgaggaagaagactacctgtcatcgaccatgtgtggagatccacgccatcaagttgacgatggctagataggttagcccaaatattatacttactagaaaaaatgcatgtgtgtcccaaatattcgcatggattttttttaaagaaaatcatgagctgcaattaggagttcaactttcgtctcaagttagcatccaagtttctttataaaaagtttcttatacaatttcttttgtattttcaaaagcgaatgaacttaaaaaccgactcaaacaataataatgcactaaagtactggcaaaagcatctttgatttttataatagtagagaagagatgccacgctattgtctcccatcagtaattttcagtttttatttcttttcacgataacaggaggtgaacagatatatttgctcgttgggatctattaattatacttgactgggctgaaaaagaaacgatgcagcgatgcacaggcaggccatctccatcagtatttccttccaatctaaccaggcgcacacctctcccatcgccacggagtacaagccaagtccatctcgcttgatcgtggcaacagtaaaaccgaatcggagggggcaaatgtgctgcagacgaagcaaaagtgaaacgcatgcgagcgcaggaaaaaaaaagcaacggaagcgtttggattcatgtcggcaatctttgaatcggtgatacccgacgtatcaaagctatagaacatcttttataatactctctccattttttaatatataacgtcgttgactttttcttatatatttgaccattcgttttatttaaaaattttatgcaaatgtataaaatataaatcacacttaaaatactatgagtgataaaacaactcataacaaaataaattataattacgtaattttttaataagataaatggtcaaacatgtgagaaaaagtcaacggcgtcatctattaaaaaacggaggtagtagtagagaagagatatagatagagatagagatagagatagagaagtagaggtagagaagacatagagacaataaatataataaaaaatgaagattagaaaaccaacttaaaaactaatttaaacacggatgaaatactaaaatcccggtgaaaatatcagtagagaagagatagagatatactactatataattcacgttgcaaatctgaaaaacgaagtacgtccatggctgctggacagctcgatcgatcggcacgtaccaagaaaatgtaagactcaaactccaaactgtcgtacatatatacgtgtatgtgacctcatcggcataaacaaattcgacgtccacgacacctcaccgtattcgtatttgatacaaatagttaattaattttcagcgatataaacggaccaaatggttaagcgactaaaaactcactcaaatacggataatgaacaaaaatctcgacaaaaacatctttaaattttataatagtaaagatgtgatacagatatataagagcatcattggcttcagccaacaggagtagagctattacctatcagttaagagatccgaacttgtataaaaattcttttatccatctctttatctcaatatcgtgtatatattggtcccaacgatcatcatactatgtaaatattgtagtcacgacctattccgccgatagatatggtatcggggtttccgacagataaggatattcgatgaccagtgctattcggatatctgctgaagtcgtgagacatacaccatttctttataactctacgaccttcaatctacctttttagattttaatagtagctcatctcttaacactaatacacactattaatattatttaaacttttaaatattttttataaattatactatattttatataaaacaagctaattatatatgatgatatttgtttttattagaagttaaggtggttttcatgttccaagaaaaaaaaaatatttccgtattcgtgtccgatcatattcaatcgttatttgtattcaagataattcatatttattttcgtatccgagctattcgtattcgttttcatatctagcaaaaaaaaatgaaaacaaatatgatatgagcattatccgtctatattcgctccattttcatccctacttccaccaccgccactgcctcttctctcccagcaagtaggacaagcgttcgcaaacggacctggccatgcgaaggtcatcctcatctgaaccttcgctattccattgccatcgccgccacctccattgatctcttcaccggtgaagaagatggccatcacctcccttgtggcagtgcatctaactaacaagcaccttggcgacgcatgtggtcaacaagctcctcggcagttgcacatgtcggggttgcacagagcaaaatagggcggcaggctccctaacggcagatcggattggggtagtggagcatctagtggcatcatccgtagtaggtgggcccttcttctccctagtcattagccatcctccttgtcctctcttccctcacccccagtggttaccattgtcttctttctagcctccaccgcctcctcccagctctaaatcaaggccccacctctcgtagcttagagccatgggctcatccaacacgatcggcgagacgtagcttcaaacacatgattgccctcgtcaaacaagacacatgtgctctctgcaagtcagaagtagctctaaagggacacaacttgactcgagctaaacttgcagctccaacgtggccggttaaagccactcgccacatagacgtgttgcgaaggctctatagccccaccagagtccacgagtcatgaccacacattgcatccgtcaccaccttcttctaattaaagccattcggctaggatggagtacacctttttttttcctcctcataagtcataactagatggagtactactgatgtgaagttgaccttttaagagagagaagaagaacaaaatggaaagagccattgcctgcctagctagcatggtccaactataaaaccccaaggcggcagcagcagccagcaataaacaccatcagtacaccatccatccatccatccatcgtctcatcctaccacagatcacacacacaccaagaacacctagcggcgagctcttcgccctcgcggccgttcttggctttgtctggctcggtttgcttctgcttttgctcctgcatgcgccgcgcaatggagaggaggcctcgtgacctcgtcgccgtcctggctctgtcctgcctcctcctcctcctcccactgctcgtctcctcggtgcccatgtcgagtaagctttcgttgatgggtagctgtttcttgattcttctccctcgagttcttgatctctgtgcttaactgtttcttgattgtgatttgtgtgttgattcgttcttgcttttgcaggaagcctgcacttgagcagccagcagcagcaacacccgccgtctctgaacctctctccagatgtaattaatctttctcatcccctgcaatctctgaattttttccccctccaatttaagtttgtcgactttgttgctgcaaaatcacaaacactattcagaatacgggcagcacagtgctcaaaccagttctgaaacgaagccaaattctgaatcaaactaatagtgttagtgacagcaactctgaccatggcttgtgaccgttcttgcaggagatggcggcggcggcggcggcgagagggctcggcaggaggccggcggcgaggatggacgtggaggtgaacgactaccccgggtcaggacccaacaaccgccatgaccctcccaaaggtcctgggagagcatgaattcagtcaagctgaagctgctgctgctgctgctgctggaacagcttgtagtagtttcatatccctgctagctattagcaaattcacataattaatccagcgtctaattacataagtcgagaggctgtatgtgtgatttggggtgtaattagtagagagcagatagctagcaagttacaactgcagatcgaattgagaaaatattcagggatgaagactgtaaagcttttgctagcttgggcctcctctttgcagcagtagtatagtaagtaaactagtaaattaattaatcagtgattttgtcgacatgcatatgcacatgagcacatcacgttgggatgtcaatataatacaggattaattaatcggttaatcagatattggaagcttcttcctcctctcactgtcgagaccgtcgtgtcgaacgattcaattcaaaatcaagtgatgagtgagtgtttaaaggaaaatatataatctcgtcgcgatcccaagctgatcactgctactgcgactacggccactccaatcagttagcacactgattaacgctgcgtcgatcattggtgtactataatcattgctccctctgactaacctcacgctgcatatgcgtctgccgttttctcgaactagtaatattgttgtttaatttctggaaataacctgttgagatattcccctcggatgccacaacacaggggcatgttttaagaggtactccctcaatcccataatatgagtaactttagagggatataacatatcctaatacaacggatttggatagagagcctatccagattcataacactagaatgtgttatgtctttccaaaatcctatgtgcttccattgtttgctctacaattaagtgaaaaaaaattaatgaagcaaaaaataaaaatttataatagacgaaaaaaatgttttctagtgttttagacaccttttgaaaccgaaaaatcaatgggtaagatagatgtgataatagagatagcaacaaggaagagggaacggagttagaagaccgagggatcatattcttttactcaatctcaaagcaattctagaggttcctttcgaatgtactccctccgtctcaaacaaagtcaaaccctgggtttccgtgttcaactttgactatccgtcttatatgaaatttttttataattcgtattttcattattgttagatgataaaacatgattaatattttatgcgtgacttgtctttttatttttttcataattttttcaaataagacggatggtcaaacattggacacgggaagcagggtttgtctttttttgggacggagggagtagtaaatttacaagagtgattcagacatatttcgaattactacctccgttttttaatagatgacgccgttgactttttcttacatgtttgaccattcgtcttattcaaaaattttatgcaaatgtataagatataaatcacacttaaagtactatgagtgataaaacatctcatagcaaaataaattataattacataatttttttttgaataagacgaatggtcaaacgtgtgagaaaaagtcaacggcgtcatctattaaaaaacggagggagtacatattttgaatatgtaattcggtttagcttttcagtgacatgtaaaataaaataatccaataacatataattaatcaagtattaattgttatacggtttagaaaaaaccttttaaaaaaacacatcattttacggtttagaaaaactaacgaaaaacaagaaagttatcgtctaaagttttagttttagaagcgaacgcagctgaattcaagtaagattgctttagcatttttctattctgaaacaggtcttgccgttaagaggtggctgagatttagcatttcgttgctatatagaatccatttgctgcatttggatgaggaagaatccgcacaacatttgctagcagcgggcaattgcaggagaggctcttaccggcacgcattacgcagtttcgatggagccctttgactttgtttgtacccctatatgcgccgaggaataaatgatcgctagtacgctgacaacaacaatggctgcaacgaaagtgacgtggccagtgcttcatctgacgcgtcccggtagaagaggaagccaggaaggaacacttccggccggttgcagtctcatgcatcatctcagtatgacaccgcgggtggcaactggtgccaggcaaccatggaaaattatgtacgataaatcacttatacagtgaatacctaaaattattattagattaaaaaaataatgaacttttgagatttgttcacgttatccgaagtaataattttactcatggatgtgatgtccacatatgcagtttccgcaaccacgacggtttcatggcactctgttcctcccccaactatgccacaacagctagggcaccgaggcggctcgggagttggtgttgcctagatccggcctctcctcgaccggtactgatgaggagactgatggacatcaggaggccggcgtagtagaggacgtggtggcggtgtgcgatggagtggcacacggtagagttcagacacggaggaggcaatgagggagagccggagagggccagagccactagatctgatgcctcttgggcagttccaatgccctcccgctgtctggatctaaagcctcccgggctgttgcgaacgtggaccgacgatggagatgatgtgcattgggaccagaaacgaggcaacggggtgccgccgagcaagggtcgttgtatccgcagcaggggaagggtggatgcggtgagcaagggcctgcgacggcgtggtgacacggcatgagaggagaggggccttgcggtggctcggagacatggtggatgtgaccctgtggtggcatagcaatattaatgtaggagacagtggtgctcgttgcttcgtgtctacagaaagggtggcgtagacttttggggtgagggggccgcgggaggaggggtgctgcaaaggagccgacgaagggtcatcgatgcagtggagctccttgtccgatgagaaatagcaggtggagtagcatcggtgtggcagagaagggcatatggcagaattcggtttgtggtgcaacgtcgaggttacaacaacaatgagaggtatgttataggcgccttgatgacatttcatgttcgggctgataacggtggtgctctaggcaatgcgatccctcttgagggcgtacgttgttgtgatgcctccttctctctctggcggtatgagtccaagtttgacaagcagcgggacctccttggagacgtcatctaggagatcctgcttttcttgcctgttccatcttcgatcaattcaattttcggcgacatcttggatgttaccatcggatctattcgagagagaagcagaacttctcatctctcgtcccctccctcgacaattctttctacatggtgatggccgagagcccatatgtatcttttattgggctagcggtatccagcctcgcatagcatcgacttgattggtgtccattcctttccctgtgagagtgtataggagttgttagcacacaatggtgctttttttcccctccttgattattgcctcccgcggtggattgatactgttcgttcaacaaaaatttccaaaattcgaaaccaacgtcgattcaacaatccgtgacaatggaaactaatggctaattaagaacagttaccccactattggaacccctatcattaagtgggtacagtacaatgttttgtcacgatagttacgcacgcacagtacgcgtgtcacgggccaccgctcgccggcgcgagcgcatgcagcagcaagcgtgcgcgcgtacaaaaccgccgctgtctggcttgtcgatgggcggcgatcgatcgcccgactttgacacaaagactagattcccctgcgacttccacatcgaaacgacgaaaccacacaccgctacgcactggagaagactaatatccatgtcaatttctgcacgatttcctcgttttgctcttattaattaatcctccgatttcttcatatcatatggttccgtccatagtggtgggcagaactgtggatgtatgtaaggctatcttgttatccaattccatggatatagttagttaattaatcacacgcacgtgcggcagaagccatggacggccgtgtgtgagtacgattcgcctctacccccatgcaaattaatatggattattaccttattttattaatattatgcgtgcttagccagtaaaaaaaagtgttggatgattcgatgcctggagagcaccggattccggaggagccgtgcactccgcgagcggcggcagcagcaacgccggcgcgcgcggagcgcgagtatcatcgtggctgcttcctcccatcgctttccagctcgacgtacgtacgtacgccgcgttggcgacgtggtgtataaaaaaggcatctgctctacgttagatcggatatttgatatttggacactaattaaaagtattaaatatagactaatgataaaatacaatctataatcttagactaatttacgagacaaatctattgagcctaattaatccataattaacctatgtgatgctacagtacacatgtactaattatgaattaattaggcttagaaaatttgtcttgtgaattagcttttatttatgcaattagctttattattagtttacgtttaatacttctaattagtgtcaaacatccgatgtgatatagaataaaatttagtcccagatccgaacatcaccttagctgcggggcctcggcctcctctcgctctcgttgtgttacacatcgtttctgccgttctggctaggggtcgatggggtctccgcgcgcgacgatggtgacggcgccgacgacgagtcgacgtcgatttttctgttgcccgctgcggctgcgagtgctctgtgggcggcagcggccagcgccggggggattcagatcaggtgaagttgtatattgactgcaactttagcagtcgcgtgatccaccacgtacaaaattaatgtaacggccaaacgttaaggcaaccctgcacatcgtcatctacctcagcccaacaccaacacaccaaagccaagaggccagagcatgtcgacacgacggcgctgtgctaccggaccttgcggccggcgcgcgcctgagcatgctgctagctagccgctccttgcccggcgccttaccgccgctctcgctcctcaacatgccaaccccaagcacccgcttgcccgcttccgtcatcaactatatattcatctccccatcaagcagaccttgaacatatgctgatatgcgtgcgtgaagtagaagctcaccattccttaaaaataaaattgaagcagaacacagcctcaattaattagcagcttattaaattcgccttcatcttcgtcatgcatctccatcgatcgatcgatctccaacctcacagatgcattactatctcgattgagagcggacggatccgtagtaagaacccagtgctgcccggattaaggaacatatatattacattcctctttcatttcaccatgcacgggatcctcaagagctgggcaactcattttttagttcaccagcctttccccgaccgccgttcgctggcgcgctactgccggccagatcagcccctttgtgctcaagtggagccatgacgaacctcttttcagtgaacaccgtttgattcaatttggacgctatggatgacgcgactgccaaagttacagtcgatatagagactgcacctgatcccaatccgcggcggggttggatggggatgatgtcgcggtttggtcgctaaagattgctgtcgctgctgttcgccttgtaggcccaggcctgtaaaccagtgttcggcccagtgccagtggcacttcttcttcttgcgaatgggttgggcggccatatgccatgggccaccacacggaccagagagtggagtgccggtacaaatttggtggaataagtccactttgacttcctgataagtgacccgaatctaatccataaccctaaccctaaaaccggatatcttgacccccgaactatttaaatcggtacaatttgattcccttggtgatttttagagaggttttgctgacgtggcgctgacgtagcggtgttgaccagtctatggggttgacatggcgcttaggtggcatttgaattaaagccatatatgcgggacccgttagtcattcacacacataaaaaattgtgggtcccactgacttgtgggccccacatgtcatcctctctctttctttttcctcccctcttcctcccttctctctttctttctcactgtccccttcagccggcggcgggcataggccggagtggtggtggcgggcggcggcgggagctgacgtaggagctagctggagcggcggtccccggagtggaggagtcgacaatggcgaggcagcgctcggtgagatggggtcggcgtcgtggaggaagtcgaccgacgagggttgtctttggccaacgacggccggcgcatggggtcggcgtcgtggaggaagtcgaccgacgagggttgtctttggccaacgacggccggcgcgcgccggcggaccgcagcttcggcctccacctcagtggcggccacctcacggcgccgaggatggcagccaccggggagagatggagctcgccggcgctcctctgctaccactcaaatctgactgaggcatgtgttagattcttaggattgctatgtgagatctaggggttcaactctagcttataggaataatgggtgattgccttggagagtgaacggtagagaaagagagagagagaacccatacctttgccggtcttagagcttgacacagccatggcgatggtgcggtgatgtgagggcgtcggtgaggacgacggtgtcggtgtcagtgatggtggtggcgacacccggcggcgggcttcccctcacttcagcgcttcccagatcggagggacttctagggtttgtggggagtccgtgtgtgcggcgaccaaccttggttcgcgcgcccgccagctccctctctttatatattagcgctgcgtgagaggggcccactgccaatagatcggctggcgcccccgatcagggagcgtaggcggagtggggaatcgttttcccgattccccccaggatcgcaactaatattctcccattcgatctccgcctttcttacttctcttactcaacatttacttctcaatggattgacgcatagagtacgcttcatcatgacagtcaccattgaaccatcagacgcaacgactacaatgcacctctccatctcgaaataaacactaggccctttcttttgtaatccaaggataataggctttcctgtaaaaacccatgcctgccaagtgttctctgaacacactgggcggtaagccttttgcatgcagatctgctaacatttcctttgttcttatatgctcgagactaattgtctgatcctggattttcactttcacaacataaaacttactgtcaatgtgtttggcagcaccacttgacttattgttgtgagtacatcttgaatggcctttgaatgctgtcgaccactttcaactcgggaacaaacttctttaaccattttttgcctgccccgtggcctcataactagctacaaactcggcatacatcgtcgatgatgctacgacggtttgcttggagcttttccacgaaatagccccttttgcgagagtgaatatgtagcatgatgtgaactttttatcatctacatctcctgcaaaatctgcatctgaatacccttctatctctagggaatcagatcttctgtacgttagcatgaggccttttgtgccttgcacaagctttctttaccattcttcagtgacctaatcctgaatttcctttatatctgctaagtatcccggtaacaaatgctaagtcagggcacatacatacttgagcatactgtaagcttccgacagctgaagcatatggaaccgctttcttttgatcgaactcatactggttcctgggacattgaaatttcccaaaactatcgcccttgactatgggagcagatgtaggcttacttgcatgcatagacatgccttttgcgataatcctaaccccttttcttctatctcggtgaatctctattcctagaacaaatgagactttactaagatctttcatatcgaaattcgaggacaaaactttttcgtctccaatcaacatcactactagtgagtaggatgtcattaggacttgctgaatatacacttgctggtcaatggagggtctcgtatgacgttggggttaagttctcatacacacacgtgacttttgccaaccaaagggtttgtatgtttatttctttgttgtggatggcctaagagttaacttttgtcaagcatataagagagcttcacaagttggcaatttgatatctgacacctcaacctaagcatccaactgtgatatttataagggctaaaaacaaagaagcaagagacaaagcggtatggactatgatcaaactaaatacctgtgccactgcaaaagttcaggcaactacactggattcaggcagctgttttctctcaataggataaaatgcacagagcttattgcttatttgttaaaggggaaaagcaggataattcatatagaaataagttcttctagctcgggaaataggatatggtcatacacaattgttacctactacaaatagcagtaatttcctcgtcccttgtataaggaaaacaaattgagacgataaacgtcacaggggctacttgtgttctttgaaactcctggtgatgagactaattttagtacatagtagcatccagcagttttacagcagaaatagcaaaatgaaatataggaagttgagttataacttgagcatttctttcagctcaaactagaaaacttggcgcagctttgccgcgccctcacagtgattggcctagtgttcttgcagagtggccttaaatcaggaaattatgtgcatacacagttacatggtaatgcatttcgtttccgaaaatactccaatatctgatgttcattaaaatgtttgaaaatattaaattacacagctcacatgtgtatgatgcttccattttaaaaaaaaaaaagcttataacaaaagacaataagtataactatacaagtcatcgttgaggcacatagaagaattgcaccatatcttgtcgtaccaactttgataaaaccaataaaccatagcccaatcaacctcattctcattcatcggattcatctcagcaatcttagcgtccattttgggatcaaaataaatccattcctgatatagagtgcacatcataacggcatagcaattgtatgcattgatacggactttagtgtacatgatatgttcgtagtaacgttccctcaaaatattttcttgcagcacccctgatacagcctgccatgtagatgcataatctttatgtctcgatgctcacagtaaataaacgaactttttctagaaaacaaattgagtaaagcagttataacttgatatattgttatgttcacagacaaagcaaaatgagagaaaaataaagtaaaacggtaggacttgatataccattagtctcacaatgaaagagcaaatctatgaaaaaaaagggggggcaaaagtcagacgatgcttcttgattatgcatacctaatgtttttttagcaaatactacatcaagataattgtatcagttactcagatgatcagatcacatgatccatgttctttgctgatactagtgttttcttttataagaagttgttaaccaaatattgaaagaaatatttttttttcggttgatgtggtaacgctatctgtgaacctaaagttatatacatgcatatatatgtgtaacatggttgcagtgcagtgtaaagctaagttttcgctctttttaagactaagagaggaggaggaaaggtgacaaattgaggttatatttggtgtgtcaagataaagtatatggagcttggatcaaagcaagacgagttccaaacagagggaaataatttctcgtctttacttggtcttgtccatactatttttcctggttacaaacatgtatattatttcacttcacagtcaatgtgacctttgacttgaattagtacactttagctctagcttttatcatgtggataagaggaggacaatatcagattctttgcatttgagctaagaatctcaatgttctcactttgtgtatgtgcacagacacagtgactggctgcctgctagcccatctatgacaaatggattgaaagctgcttatcataaagctagttgatatctctaaccaaacatcgtatagctatgttcttgatatactgcaatataaataatctgaagctacacgactggcgtttgttatattaagagcaacaatgcaaagatatgtagggcaaccgatccacagtatcttcgcatcaggatacttcagcagatgagctgcctttgtcttggcaagctgctccacagttgtcaaagaaccaatatcaaaatgcaatttcaatatagcagcatcaatgaagacagtagaaaaggagagagaggaaatgatgggtgataagcttaggctgttcttcagagtgctactaacaggcagagataaagtgcagagctgtagaacatctctttccgctgaagattattaagaacatcaaagtaaaatgtgaaactggattaataaaatggatactgaattaatgtcgatagtattgagagatgatgatgctagtctggaggtttcaaaatgttacagaagattaattcaatcaaaggacacatttgaacttcagaaaagatagctgaagagaacatttgcttttcattcctcaaagatcaatttatattttgaactcatgaaacagtaaaagctgaagtactcctataacacatttaacctgtcatgaccaaagtagcaactgagaagaattcagaaatcatggtttgcaaagaaatagagcatcaattcaccaaatatactgaacatttcaacattggcacaataacaactaacttcaatgcctcaaggaatattcactgtaaaatgaagaacacttttcttctgtgaggaataaaatgaaccatatttttgtgaagctatgtttagaaaattgcatgatatattgtattgccaatattctatttcttaacctatccaactaggtcaaagctagttggataggtcaaagctaggtcaaagctataactatacaagtgaactgacaacaacaggaataatgcctgcgagtagctttaactgataggacctatactgaactaaattagtttgatgacataaacttggcaggtcaagatactctctgggctatcataggaagaaccaaagagtataatctttcttacaacaaagctatgaccattgacaaaagataggctgctctagttgcataaaaaactcaccaacaaggataatcatataatagactatttgtcatatttcagacaataatagacatatatacatgttttttccgatacttctatgatatcatttgtgtctttgtgtattcagcttattattttttgcatttacatcgttgacctggttctggttactaaataggacaaattttatgcttgtagatatatatgaaatacacctaattgaacttgatttgtgttgaaagtatagcacagctagaaggcagagccaaacagagatgtaattaacatgcctgggtccagattgaagaccctatcgaacaaatagaggaaaggacagaaaggggaaaaagtaaagtctaagcgacatatggcacgaaaaggaaatccaatttcggtaagacttgatctgaatcgtagttcagatccaagtcggttcagtgagggcaaccgcgaaagtcaccgaatgggttcggtccgtcttttcctgatctttgtttgtccccccaaaaaaaggcgtgagaggacgttgcagatgtccgggacggacacgacttcttctaacgctagaagaccacaggaagaaacccgggaccagagcatgtcgtgaaagacgcacacggggcgggcgtgcttcgttgttcaaagatgttccagatgattggtcttctgccaccctcagctgcaccacccttgtactgcatgtcaagaatggccaactcatcagatttcagaccaagacaaaacatgtgagtgtgacaattaattttgacaaccaatccattccttggagccaatcttatcaatattcagtagcatcgtgtatcacgcaaaaaccaccaagagcaaaagaaaatcctttttttcttaattatcggtggaaattaatcacatgtggcgtgaacacgtaggggaccatgtgagggaactcctacatcgcggcgtccaacggcggctgccatagcgtggtcctcggcactacgccctttgctgcacggcgaacggcctccgtctgaggcggccggcgaatcaaaaggcggctgggtagacgggcacggcgatggatgtgaattttctcctcccccatccccgcgcacagcaaccgagctcgttgccctatctggcgaggatctgcaccgccaccgctcgaggagcccctttgccatgccgccgccaagcttgaggggagaggcagcgtcctcaccggagctcgtcgctgacaccgagctcctcttcacatatagcgacgaggaggggatcagaggacagaggactgaacggcgcgccaacgcgtgggaggctcggcctcgggcgccggaggcggagcagcgggaggaagaggcggcgacgtcggcgtaggacggcgggtcgaataacaaggaggcggcggtgacgtcggcgcaggtcggaggggagagcggcgaggtggcggataagagggggtcgaaggtggaggaatagagtggtggcgaaggggagagaagggcctgactttttttttgcaaaaaaatgcacctaaaatcttctatattacaacgaggtccaccacagagatccgtcactgtacatctgcgatccgacggctataggagggggtctaactctggattcgtatgacgctacgtggagggtctatttgcatgagaatccgcgaagatttcgatattgagagatagatagctttgtaagcactaaattgatcattgtgggtaacttaagaacgggcggctcctgaatgggatctataatcaacgtgttggttcctactaaagaatcttaacgttcaaaccacataaaccacctgtgaattgcacaatggtgtatttgttgtccactcctgaagtgtcttcaaagacctgaaaatcaagtaacccaataataaaacttcaagtgttctgaataatgcaacaaccatagggttaatgcaaatcaaaatacaatcccaagaaaacaatattttcataagaatagagaagtgatgacctgcacaacagcctctttcaccatcaacttccagaatttggccacaccgagtggttccatctcccaatcggatgtttacaatttcctagtactttgcgccatgaacatagttacatgaagaaagaaatgttcagtataacttgctaggagtaccatattagtcagttgaaaatttgtaccataatactaacacatacctttactttatccaagataaacagaggtcctggcacaccagacacaatcgaacatttctattatcgagaaaaaaaaagatacatgaggtaactatctctacctttttattatctccttaaatcccttgttattctgtctctaaatccaagatgcaaacacaaatcaattagtaaaaaaaaatgcattcattgccagaatcatctttttttttaaatgaacccattcccagattcataatttcaaaagagaattttgaggccaacaagagcatgcacttactctttgaggcaagcgatacaattggcatcaatccacacggactacaattttctcttcagttgtgcctcggatggctgcagcaccagtcatcccctaaaaaaacagcaaacaaatcatggttagagaagaggatgacatgggagagatgaaaggagaatgattgaggggaggcaaggtacagtcgatagtctgagacgacgaggagaagatggaccggaccctcgttgatggatgtgccatggatttgtgtcctcctcgttgaaggctcaagaagacacggcgacgtagagcaggttcgccaacacaccacctcgtggagggatcaaggcaccgcctgagacctagtgttggatgaaaggggaaaagggtgtgcggtggggaggagggatgggtagatggcgaaggggatgccgccggatccagagggagaagtggcgccagccacggggctacaacgacaagaatggaaaggggaggagcgggtggttgacgtagactcgaaaggagaaagaggagccgtgtgcgagggaggcggagcggcaggagttggaggagacgcagggggagggcggcgttgtggagaggtgaggacgggaggaggagcaggcggccaggatgcgggagaagaaaggggaagggagcaccgacgccggctctgccgccaaggtagggggatatgaagggggaggaggcaccgggccatctgcccgtcccatgtcccactccccaccgcctgtcctactcgtcccgcccgtaacacctccttcttagccgccgtcaccaccggtgctgctccagatctgaagagggaggaaggctagcgccgggtcgaactacgcaacgagatgagtgagaataggggtgaaccggcgccgactccgacaccgccgcaggcacagacgccgccacaagggagagagtacaagggggagggggcgccgagctccgacgggcaggagggagagggaggggaggagggtcgtcgtcgacggcggcggcggtgggatggcgcacggaggcggcagggggagggcggaaggtggcggcggggggagagcggacgacggcatcgtggggaggacgaacggcggagacaggtccccgccgccggtgcggggcgcggtggggaggagatggggagacggccgggtagggtttgggccttggttaattggatccatgccactgcaaaagtgcaaatatggcatatcaaaataatgccactcttattcgtcatatcggctacgtactactgaaatctaggaaaattggaaccatgccactacatcacattttccatcaaaaatccccgttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgccatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtagtggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaagttgaaagtttaaagaaatagtttggaactaaacttggcatttgtattgtatttctattcaaaccgaggggttttccaaataaaacataacagggtgtcagtcggttcgaggatatatacgatattccgtgaaaagcgaggagtttttttttgcaaaaatactcaacataaaaaaactcaaaaaagggggaaaaacgcagcatacacactactatcatcgatattttgtttgagatgtgcaacagacaaagcccgaccgaagaaccctaacaatggcgtcgaagctcgtgacggcggtcgcccgtcaagcggcggccacatctcgcgccgcccgcttagctgcggtggcgcgccatgacgcggcggccgcatctcgctccgccggcttagctgcggcggccgcatctcgcgccgcccgcttagctgcggcggccgcatctcgcgccgcccgcttgaagcctcgtcccccactggacgacgctgcccgcctctccttccgctacagcagtgaacctccaggtaaatcataaccaatccctccctgatccctccctgtcctcatggtgcagctctccaatttagcatagtctagataggcaggcagggggattaggatttaggaggaatacatccatctctggtctgtattaaattcattcaattgttgcatgctattcgtacaattcactgttttcttgagcacttttactgatgtaatgtttgcaaaattgttgatttgtttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctccatatcctaaaagttattctgatgagaggcatgttcactgacagcttgatccatgtgtcatgtatttcagtgtttaaaaaatgcataccccaggttatgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgctattgtacctgctcttatatacttcgctttatcgaatctaactttactgaatttaactttggtgctgaaaatgaggcaataaagtaattattttattacagttggcaggaacttggaaaggcaaatcggtgtctaaacttggtcttgcgatgtttctgcttaatgcttataaattaacacattgatctatgattacgtggactgctaggtgaagccaatagttatacttgctctttacctggctataggcccctttgccacctttctcgagggttgcagggggactgcctatgaagtgtcattcttatggccgtgtttagttacatcccaaatgcccctaacttttcatcacatcacatcacatccaaaacttttctacacacgtaaacttttaacttttttttcaaacgaactagacacaccttattccgcgtgaccgttataataaaccagcatacattgagtgaggaactttgacaaaaaagaacacactgaactcccaaattttgccacggaggatctagcataacttgtcagagacgagatgtgattagcttgccgtattaagacatgcacgcaaacaattacaattacatgacagaaaattactgggtagtttattccagaaaaagcaaagaaaacaacaggaacatggtaaaaagtactcctacagaaagaatggaagaacaagtaaaagtgctgaatgaatgggttaagacaagaaaaaagaatgcatagtccagccgaaatgtcaggttggttgggcctggcagcaagcataaaaacctaacgtggtaaatgtcatgtcaggttggttgggcctgccagcaagcataaaaacctaacatggtaaaatctcatatcaggtagggttggtcctgccagccagctcaaaaacgtaacatggaggtgtatttcttatactatacaattgtatgctaatcacatctggtttattcctgatcatcgtcagtccttcaaatactcacagacgatggaacgtaaggaacaaaacatggagtacacccttcattggttaggggcccaaagttgccagtaacgaggccttcaaggtccatggcgacgacgcgctcctccaagggttcccagacaacgacctctgcggcgccttgtgagcggagcaacatagcccttttgccaaccttctccccggagaatgagccgacaactgtccagagtgcagcaaccttatcatcaaacagtcgcttgtttattttaagcacgcccaatgtgaggaaaccgtcaacatccttgaagcaggtcacagtaagatctccctccatttgcccaagctcccatacggtatcttggtttaccactcgaggggcagggatgactttaaggaggtccttccccgggtcatagcagaggatagacccaagggaagtgcgccagaaggcgcagcccagtgtaccaacaccagactccgccttcacctccacagcaggaggggcatctttagcaatagtccacctcccagtcctggaggagtatgactcagatgtccagacgctgcccttgaggtggaaggcagcgacgacatgataatgctcaacagcaccgtcgaagcaggatgtcaggggttcctcgaatgtgatgacaactgctggttctccatgatcacaactgtggcgtggtagctgaacccacttgaaggtggtcgtgttggttacatagtacaagcctgttgtctttccacagacgcagacaaggccacgcgtggatgcaaggaaagatacgggctctggtaatgcagcaaagcgtgactcagggtaaagaagcttgccgcagcgtatggtgtcaaatgcgagatacccaggctccttacataatgtgttgaaaaagaagcctgagagcggcctgcacagcggtgagagaaaaatttaaaggaagagctacaaaatgacactagatgtttaaatcatcacaaaatagtcagtaaaggatctcctatatctaaggagaattgcatcaaatgctgatgtttaaaacatcacgaaatcaaatgagatgcagtagatctaaaaataactaccttgaagcggtactttccagtggagcatcctcatcacacagtttatttatcatcaattcatttctgaggacataaatatgagcaaaagcacaattgttagtggataacacatcaacaacattgcaatctgtgaccaacgaatagtgatcatataactgcagaaaaaaatcagctaaaaagcactacaaatttgttattctgttaaatatgtatgaaacaagtttagtaaatacacttacttttcaagcaaacttctcagcacatcctgtagaggtcctcctttcgagtttggagcaatttcaatgacctttccatccctaattatgttaccaatcgcagcagcttcaattgaagctaactgatactctaaataaacaaaaaaaataatgaaatgtaaatttataattagttcagatttcatcaatataaaatgcatacctgtccaattaattctacaagataaagcagcaacttccatctcatccagaatttcatcaatataaaatgcatacctgtccaattgattctagaagctaaagcagcaacttccatctcgtctagaatatcatcccttctgttagctctactttgaattatagcacaatttctgttagctctaccttgaattatagcacaattttctggagtgttaagaccacctatataaacaaaaatatataaataagattaacaaaacatacaaaatgggactatctatcctattcataccacaaaactagttaattaagtcgtatatcattgaacattgaaattaacatttatagcgcctcaattcaatccctttatcaactaacaatgagaaattgtgtcatgcttgcatcacaaacaaggccataatgttattttaccatgtcggtcaggaggcgacggcgcgggctccgaccgttccgtcgatgcgcctgtgccggcacaccgatgagacgtcggacgccggcggtcggacctcgatctgtcggtcaggaggcgacagcgcgggctccgaccgttccgccgatgcgcctgtgccggcgatatggacgtcaggaggccggcgtcggaggcccgtcgatgcccctgcgccgacgggcggcgggagaatgcccctgcgccggcggccggcaggatcgaagcgctccggcatcgtcgggaatgagcctggcggacggtcgctggcggctggaacggtgggagagaagagtgggtttttatagctatctattagggtttcttaataagcgctaataatcagaaaaaataatttacgacgctccattatccgaagcgttaggcgctaataagtaataaccaggaaaataatttatgagccccgctaatatcgaggtttatactccgtaccaagcaaggaaatgaatttaggttctgattgattcagcttagaattattataatttggattattagaagtaagttgaaacaaacatatagcttattatgatagattaatataatatactagtaaaagtgtccgtgcgttacaacgggaagcgtacagatcaaaaaatatgcaattatttaaaatacaaattcgttgaaatttttggtatttttaagtaggtatgtgtataattaaataaatttacaagtaaagcaaatgcgagaaataaaataacatggttaaatttaattttattaaattctccatgattagtcacactctttagaattttattggaattttcataacttaattgctaattttaataatacaaacatcatttaacaaattgtttaattggaaaaagaaagaaaatcctttcttttaggtttgattcgaaataaacacattcaataactataattgtaaatgcttctaaaaaaagaagcactaaaaatgaactacttctctttttcttcggctagagggacctaaaatagacttcttccagacccttgccggtcggcccacggccttttgcgcatgcgcgggtgcacttcccctccccaggccgcaaccttggcttgggccggaaaagtggcctcgctctcgatcccatttcgggccgaaatcggcccggtcgacgctgtccgtccgatctctagggttttgatcggacggccaagcctcgagatcggggaaacaaaaccccctcagccgccgaaactgatgaggacatcaacaccatcgatacatccacgtccccccatatacagcatgatggtcctattacccacgttcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcaggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagcgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcagaaaccctagcccatttccttcccacctatctctctcttcgccgccctcccctcagcgcctctgagcggcggcggcggtggtaccccacgagcagcggcgacggcgcccctcctcccgcgagcggtggcgactgcggcggcggtggcgcctctccccccgagcccaagcggcggcggcggcgccctcccctcgagcagcggcggcggcgacggcgcctctctcaccgagcccaagcggcagcggcggtgccctccccccgccagcggcgacgacggctcccccatcaccggcggtgcggccgtgtcctccctcaccaccggcagcgcggcgacgtcctcccccaccaccggcggcggcgcccggggaggcgtcggcggctcgccagcatcccaacggcggtggcgcccctcccctctgtcggatccagcgggaggggagctgcggcggcctggcgtccctatgacaacggcggcggttcgacggcgacttccccttcgatttttttttggatatatttgtgtgtataatacttcctccgattttattttatttgtgtgattgattgaattccgattaggatttttttttgggtggtggtgatggaattccaactgggatttggggggaggcgagggggacgaaaaatcactgcacctatgaggtgacgaccggaaaaatacgaatatttatattagttatagataagccagattaatataatctggtaagccactataaatgtgtttttttagattattgggtggctaacaactaacaaacagataataatccagagaaacaaacagctagcaacttattctatgttggcttattataatccagcttatagtaatctagttctataatctagattacaataatcttaagctgaaacaaacagggccttaatcgccgggatcgccattagtaatttaatcgcctggatccctattagagcaagtttaatagtatagccaactactggctccaaatcatctatagctaagagcaggtacaatagcaggctataagctagctgtaaacatattttaagaaaataaatgaggagagagagaagcagcgggctacagatttgtagccagctgtagcacgaactgcaaagatgaagtgtgtgtatgacaggtgggaccatgtattaatagtgtagtgtgtaactattgtatgaataagctattagattggatatatatgaattggagctagtagttggctatactattaaacttgctctaaggccattcccaaccccaacccaatgattaggatggtgtccatagcattaaataaactaccacctaagatgaaagatgatgtggtaaatgaataaatgaggaaagcgaaggaaatcaggtcttgcataagacatggtttctacacaacatacaagacatcatgtgagataagtagcattaaatttaagtatggaagagtggtgtttgcattgatgaaagagtagtgtctagtactagtttcttaatgatgtggagtttatagaaactatgtctagtgtcttgggttgggactggcctaatctaatagcccattcatacaatagttaactataaaaatatactacactattaatacccggtcccatacacacgtaatgtattgaagtccgtgctacagctggctacaaatctgcagcccgcttttttctctctcttattttttcttctcgatacgtggttataggtggcttatacctgctcttaggaactaagccacgtcactgtctaatcctcaaccattcgatctgatctgagcggcgcacacgagtcagcccatgtctctttctagggttttttctccttccccatctggatcgcatcactcacagccgccgccgctggtagggtaggtagaaaaagaccgaaccgaaaaaaccgacactgagaaattcaatcattaatttggtcctatgtaatgaaagaccaaattttgttcggtcaaaattcacttagtttactcggttaatcgaatagaccaaatgaccgaattaaaaaaatgtctaaatgcaatctacaatccactaagttcaataggattaaactctaattttcacttccctacttcttctaggcatgcaacataataagagtctttacttctacgtgttcacgattttttttggtgatttttgtgttgaaaatttccattatttctttgcaaatatgaaaatgttgttgaatttcggtcaggaccgagaccgagaccgaatttgtctatcctgacatttttacattgaaattcagtctttacttttcaaacaatgaaatgaccgaagacgtggtcgcggtcgcctccccctcgccatgctgcttcccccatccctcgcgcacgattctataagaaggcaaggcaagatagcattgactgttgcatcatcgggaattgtatccttgttacttccaggtggccacacgcctcattcccagaataatatctatggtttgggtaggtagtatcatcaaatcgattaaaaatacttgatctcctaatttaatcggaacatttctacaaatagatgatactaatacagttcctccaggtgaatgtattagcatagctttatctaaattatctttaggtaaagactgatttcaactggcttttgcagataaaaaggaatgagaggcaccagaatcaaataaaacagtaactggtttagagtttatggtgaacatacccatcaatatattaggatcttgttgcgcttcttctgctttaatatgatgtacttgaccacgtccaagattaggtccactcttaataattggaggatttttctttataaaacctgtagcagatggtttctgataagaagtttggccacccatattttgacgattagggcaaagtcttgcaaaatgtccaattttcccacaaacataacatggagagtcttccatttttaatccaggtcttggtagtattggtggcatgcctggtcttgcattgggtaaagatggcttaaatagataaggcctccgaacttgtagtgaacccctagttggtgattgtcgttgtaaattcattcttctcttacgaagtccttcgaccattctacgatcattttctagcctaaccactttattgactaggctttgaaaattttcatgatcttgactaatcattggtcctcgaagttcatcacgtagtccttctataaacctttcaatcttttccttttcatcttgaatatcagaggcagcatattgagcaagttgcgtaaatttattcaaatattcttgtactgtcataaagccttgcctcaatcttcgaaattcattctttttcattctaatcacagctgtaggtataaaagcatctctaaaagctgtagtaaattccatccatgtaataatatgtgtaggatcttctatagaagcttgatatgcttcccaccactcattggctggtccttctagttgatgggttgcaaaggttaccttctcttgttcgcttgttcggaccaaggttaatttcttttcaatagcccttagccagtcttcagcatccataggttcttcagatttagaaaagactggtggtttaattctcataaattctgcatgtgcgctgtaacctttacttccttgattttgtgctatggcttgtaataattgagtttgtcttgccattacttctgccaaagtggtaggatttggtgaagggatttctcctgtttctctttcacccgtactgccattgcccatactcatctagaaaatggggtaattgatatcttctcaaaggggagtcaacatccataattaaacatagcttttatttatggacaagttgtacatgatgtatgctacaaagaaacaaaccaaagaaaaccataaccacaaagaaagaggtaatcacacatagaagttagagaggagtaggataactatctattctacacttaagacctctaactatctataacttctatttatctagccatccaccactgccttctgcgggattagtaaacaatgatgcaggtgcgaagtgtgaaaattcatgaggagatgcagaagttgatgcagtaatattgggagcagagcatgagtaagggtcttcattattttcttgatcattagtatgtatagaaagatgttcttgtgtctcaagctctcgttcttccggatcttcctcttcctctggagattcagtccagattggggcagtatttaactcattgatatgaaacacccgatttggccttagtatttctggttcttgactaggctcactgatatccatagctgaatgcatttcttctgcttcatcatcagaatgaataggatacaacggtggtggtgatggtggtaaacattgtaaaactccctcaccattatcatgaggatttggcccatctggttcaccttcacgtactggtgagatatgtccttctataccatcatcatcatcatcatcatcatcgtcatcactaccatatttgggatttgatgaagacaaaaggctgctcctgcaacacaaatattgaggatagaattttgtttttctctttcctcatataattcatgaagtatacgatatttgtgtttaagaacattttctctgcattcagcttcttcaagacgtttacgttgtacgtccatatgttccagagcttcttcatacatgtcatccgcggcttccatccagatagacatagttgcttttactggttgttcatgataatccacattctggagggtgcaatagtcttcgcccggctctcgcataggatgataagaatagctgagagtgttgcaacctgtcttggtaaatatgattgagacgtagaaaagcctccctggacacatcatatagtgcagcttgcacggtatcccgcctatgacgtgttcggaagtaatacatatcacgttcacctcgtggaggattgatctttacggtcatatcatattcccaacgttctccccgttgataagcatgtgaatagaattccggcttctcatttatcttcagtttagtcatcaaattgattagttgatcagtgcactcattatcatggatagtaattgcagtttctatgagttcttgctcatgctcttctgccattatcctgaaatacacaaatgatattataatacatgctcgtggattaaatctaccccccttaaaaggtaagcttgaaataaattcaaacttagcttagttaatagtccttaaggttcatcctatagtcaaacatatgctctgataccagtcctgtcggagcccaaaactaacaacttggatccgactgagattaatgtatcaatccctggatcagtaaaaattgatacatacaatataactggttcttcattgcatacgttaaagtcttacaatactaagggttttacaataataggtactcacctaagctaattaatatacagcggaagtttctatacattctaactagtgaggtataacctttagggattttctaaattatcagggtcttcgtagtaatagttataagggtcctcctcttgacccagatctgaaaaaggggttataagagcaaggatgagtattcacaatactcagcaaattatcatggaaatatgttatgcattgacatataatagggttctttgcaaaaagcggtattggacaatctggaaaagttatagcagaatttataaaacatataaactttagatttctaaccaaggtaccatatgagtcccggtactcaactccatgagtacggctattcgaatagtttcaaagatattctactgcagcagatgtacgctttacccgcagtccatgacttgctgataatcatcggctttagtcatggctcagtattaagtcaataacaattatggcacttattccatgaacttatatcctcatatgctctgaacgtaatgttaacagcagcaagaggagttctggcgttcccgaggtatttaaggggaactgatcgtatgacaccacatcatctcgatcagggtttagaaatataccatatagtttatacccgagtatcacaaaccatttacctgtacatggtaatggttaaagttgcccttcgcggctatagttgcctcctgcgcgaggacttaaaaataagaaccactatacagaggtgccatattgctaattaacataataactaggtctgtccccattctagaaactgcggtcgtacccattcgttcgacataagtacctggtaaaacttatatcgattgagacaatactagccacccggaaatcatccaaatcttacgtattgtcccaatctaagtatagggtattttaaccagattgtaagcaaaataagcaatactaaattatttgggtttctatgattaatttatgcatagaaaatagaatattgaatagaaggctataaataaataaataatttgtaaaatataggcttaaatgatcaacaggtatatggtaacttgccttgctcgatgtcctgagattgattgatattatctagagtgtcagaggaatcctcaagacctagggttagacatataaaattcaaattcaaaaaggagtttaaataaaatgcaaaaatagcaaaaaggggcccaatagatagaggatgattttagaagaatattggtccaagttttactgaaattggatctatattttaaaagatatgggcttctaaagtttgaaaatcgaataaaagtgaaatggtactgtgtgtgggtcccatctatcagtctctctctcttctcttcttctacctccagccgttccccatttcaagccggcggcgctagggttggcgactgcggtggcgctagagggagaaagtggttgtggccgaggaggggagggagctagggatctccggcggcggcgagcggtggcagaggagttaatttgatgcgtggacggcctagcggctagggcggcggtggcacggttaggttgtgatggtgaccggagtgatgagagttagacatggttaggggaggggttctagagcatctacggggtatctagagggatttcggcagcttgccaacctttggcaaggtgcggaacatagttgccgacgagcgcctacataggcggcggccgtgctcacgtcggcagctcagagggtgacatgatagtgcaaagggattgctcaaatggaatctaggtagtatgtaaatggttgaaatggaagaactcaccgagatcggttgaaacgacggattgcggccggaaaaacttcgcggcggcgaagaacagagcagcgcaggggcggcagtgctcggcttggtgcggcgaggtaaaactcgacgtagggctttggttagggcttagtatactagaacatggtatgatataggtgttctaagtgttatttagggcggaggatggatggagaggggtggagtcgatcacgcacaaagtgttcgaccgacgggcgagggtggttgatgagatggattggtgaagcagagcttcgggattatggggctatggttgttgatgatcgatgatggacagggaagggattggggtcctatttatagggctaggaggagcggatgagctcgggcaccgttatcgccatggatgagctcgggatttggatgaggcaaaggtggcagaggctgagagagggcgggaaagatcgatttgagtggcgggaggccacgtttgaatacttaccggcgaaggattggcttgaccgcgtgttgattcggctggcgacgtgttggcgccaatccgagcgcgacgcgcggcggcggcgagggtgaaaacggccggctcaggggtgaatggtttgaattgtgagaggggataccaccgtctatctccaatccaaccgtgcggcaagaattggcgcgattcaccccgggtagaagcgaaatcgcactcggtggcggcttggacgggtgcgcacggcgtcaagcggtgatttcgtgcggcggtcgtcgtcccggctttgtcatcgtcgagattggtgcggcggcggtgggctgagggcgtcggacgggcgacggtgcgccaaggcggtcgggcacgcgcgatcgatcccgagatcaacgcgcggcggctcagcgcgcggcaaggtcggctgccagagagcgcgcgtgaaggggaggagaaggccaactaaaccacggtttttgagtgggttgtgatcccctaggaccaaacctagactttgcacaagattgggttgaaggtgggctgctctagttgggctgggcattttgtcgagcaccttgagtgtaatgaacagtaaaaatcagaatttttgaatatttccctagaaaagatttgaattcaaactaagagtttggaaaggtttcactagggtttagagtatagtaaatctccactaatattgggataagctaaggaaataatctatggtttgaatttgagagaaattgctcaaattcactagggtttagaataaagggaataagttagagtaaattggttgggctctaatacttgaaccaattttaaataaaaaatcaaatagatttttgaaccaaacaaatttaatcaaaagccagcatgatgcagttaattttagtttaaaatttgaggatgttacatgatgcaaaaacatctctcattgtttgggatgaatctcatgttaatcataagtattgctttgaagcattagaccgcacactcaggacatgttatctgctaccagcctgcattcgacatacaaacagtttagcggttttgggtggagattttgcccaaacacttccatccaatcatccaaaatgtaacaaagaaaaaaaatgaaatcatgccttgttttaattcatattgatggagtacttcatttaaccgaaaatatgaggcgaccaacgtgaaacccaccacgcacgcggcccgcacccccatcccaaccgaccgaccgaccgaccggctcgcggtcgcaggcggccaccgcaccaccccacaccacccaccgacccatctgatcaagataccgatcgattcctccaccccaattcccaattcgataccacccgccaggccgccacgccctcccctcctcctcctcgccatggcggattgccgcagcctcatcgagttcctccgcgccttcgagcaccgccaccgccaccacgccgccgccgcctccacggactccgccgcctgcggcaccgcgcccgcccgcccccgccgcgggtcgtcgccgcggagggggaggcggaggctgttcacgtccctctgcgaccactccgcgatggcggcggtcgacgcggtggcgctgctggccgtcgtctccgcgctcgcgttcctcgtcacgccctacgtcaggatggtggcggccgaggtcgggggcctggtgtccgacctcgacgcggcgggggtggcgtcgtcgtactacgcgccgttcgccgcggcgggcgccggggcggcgatcgcggccgtggcgggtgtggtggcgtgggacgccgtggggcaccgggcgcggaggtgcgggaagccccggtgccgcgggctgcgcaaggcggtggagttcgacatccagctcgagacggaggagtgcgtccgcggccagcagcagcgcctgctcccgctccccgggggacgcgccgcgcttctcgcggccgccggggcgcgccccgtccagctcggcgacgcgcaccgcgagctcgaggcggagctcaggaagatggcgccgcccaacggccgcaccgtgctcatcttccgctcgccgtgcgggtgccccaaggggaggatggaggtctggggcgccaagaaggtgcgccggatcaagaagtaggcagccgcttactcccatggccatgaactgtttggctattgctgttactgcttcatcataagaacttgctgttacatacatagcaatactatcacagtgctctgctcttgtagctagtataattgagcataaggagagaaataaaagtggtagatacatgtcttatgaacttattatgatcggtcgccaaatcaaaagtagcctgctccttggttggcagctgttaattggattattatgcaataagtggccatttcctcttgggtatataaataagcgtggtggatagacttctatctgataactcgtatataccttgttgatgaccagacctgtcaatttatactctggctgttatttgtgctatggagtactatgtaacatggatggttttctggaggaagcaatcccattgctgttgcacttacattttgaaaaatgtttgctaacagtatttgcaatagtccaccaatatatgagttattcccttttgtccttttttcattcttttttgtttcaagcagcactaagctctaaacctgatatgttggtgctgaccactaaacctgaaatgtcagcttcatggtggcatgaataacttctacgttatgttattaaattgaggtgatggtgttatttagacggtaaggtttctggtgttttcccccccttactgcttaggttctggtgagatttgataattttccactctttagatttctgttatgatgatttgccatcttggcgcacacatcattgactcagaggaccccacatgtaattgccatggggtggcaagcttcaatctgaagagtggcacatcatcaaatctgcctcttttatgtgaatgggtatttctcagtttgttaattgtacttttctatgcttatcttgttgcatttctgttctctaatatatccgcgtgctttccgttgtattcatattgagagtgccataattaatatgctgtcttccgttagttatcctgtggtacaactcaacatttgcaatagcttgttcatacatcattgaattatttataacctatggtacaactctagatagctacaatctttcccggcctacataatgtatttacagaattaaagtagttataactttggaagaaattatttgtaagctcatttcttctccttgattgtattacatattgtcagctaatcaactccagctgaagccgttcaagtcaaaatgtctataaccttgatcgttatcatctatattgtgagtatttagatcaagattcttccctgaactttgttgatcaaaatctagtagcttgctttctctttgatagtcaactgtttgtcttttgcagcttggttcatcaagatatagcttctctacatttatttctttgcttcctgatgttgaactggttgtgctgcctccgccattcttttgaggcgtgatatactcatgtagaacctctgtatcactgtcacttccctctgatttgtgatactgtttaccgctatacagatgacccattctacgctcacttaagcttctgttaagggaatattgagattcttgatcttgggactgttttcggcaaaataatgtactatcatcatatgctttgagtaccccgtggttttgtagcctatgctccttgaatccttcagctgcagtcaaacagttattggctgaactttcaacaaactggatttgccttggctctagtctgtgtatacttgaactttctcttatttctgtaactgcgttgctgagacattcatttgaaacttgtgagaccagttctgatatttttatttttgcatcttccaggcttgcagggcccaagttctgcttcccaagggtctcttgagcttgctcaagaactgcctgcagatacttcccttgggcttctatccgcagctgtagatgccgttgtacctgataccaaattagcttcaggttagaaccattgagccaattcatattgttgatactatatgcattatattaatcttagctgttttctaaaaatagtttgctgccaaactggaggagagtatccaagttctctaatctttacataatactgtctattctattgtacaatgatttgagaatatagttagaaaatagtgttatgaaaggaatttttggggtagatctacccgatcaattacatatgtccaatcttattcataaagatactggtaccgaattctaaaggtttggctggatgtattctgaacatcgcttaacttttactagagggagaaagttatcttgggggtcattcctggtgggaatcactgttgtgaaggatacaaaaaagatgatacagcattcatagcagttttcttatgctcttagttggtatgtgggcatgctgactggatgctcgaatttttttttatcttatgtcatgtccatctactctatgggcctatcgtgggttaagatcttattatgcaaacagggtcagtacctcacctcaagttgttcatttagctgcctctgcacctcaatttgcatctgtagtgcttcaccgatttgaatagttcttgcacccaataaaagggactattacttcactattcagatggattacaattataaagtacatgggaaatttcttacttctctgcctgtggaatggcgcttgcactggccatcgctaatgcacttgttccaggaatcctatcagcaacacctgtacatccaagggctgcaaattgtcatcatccatgagttgctatgtggctattgtagtggtaacaatggaaattaaacttgtttttaccattctttgttgtcccaacattagcttgaccttggagattcttactgagcctgtatttctgaaacattcaagaaattatgaattgcactgaaattttttagtactattttaaatgggagattcctggttgtcaggtacctggagatggcttttcagatggtataaggtgagtcctggaatgcccatgagcctcatgactgtttttggagtagcttctgagtgattaaaatgaatgttagaactcagctattctagtgcattgagaagataagaatcttatacttactctctgctccacctaattgattaactgcatctacaaatcgctgatgcaactcaggtgtccatttcaacctaggtttagcgtcagttgagagaaccagcccagaatctccttgtgtatttcctccatgcagaaacagatgccgctccattggaaaggatgtcctagtagtgaagaggtcactccgaccctgatgttggtgatacatctgctgcaaaattaatacacacttttagaagaatggaaacataaagaggcaagcatttacactatcctttcttacttgtgttatccagtctgtttcttctctttgctatcacacgtcgaaactgttatgagtgcttctcttttggcagtgccaaagccagcactcttctccaagcctaggtctattgatactcttttggtcttctcaggttgataagcagtttgttgtgaggggttccttatatggggcaacatagaatctagcatcttggaaacaatgatcgaatattttttatgccaactaacataaggtgctgtccttatagttacctctgaaattaaccacccccccccccaaaacaaaaaaaaagtctttaaaaatgcactaaccttttctcttcctcttcatgctttttatgaataaaccatttttctcttcctcttcatgctttttatgaataaatcactgaaagtatgtatatactatagtgataaggactcacaattggaacaaattattgttttgaatgttgctttctggcatatcattctgctatctgatctatttggagtgtgaaagataatcactagatgaaattatttgagtactctatgatcatagctgatggattgttatttagttagtattttgaaactgttgcattttgttttgttttacctgtttaatgtttagttgtttatagctgggtggtacttggtatgtgtatattttgtttaaatgaaaaaaaggacacttaatgttatggtagtagattccttgtgggtaaggacatcctacataaacataaattctgtcaattttattctgtcctttactactttaaagcatatggaatatgaacaagcataagttccatcagcgtcctttcctaagattggtacatattcacatttcagtccagagaactgtggaccaagaggcttatgctttttatgtgagataagctccttttgaaccagatctctttgattgtaatcatcaccagtcaaagaaacagtacttaggtactatgtttctgtatatgtttcacaactatcatcatttcagtacttttgccagtagaggcagatagtttgttccatcgtgcttcttatctaagttcgacatgaaaagctagatgtgatctgtttggaaatgtatgcaggtctagcccctccctttcccccttcgtttgtttctaaaacagtagcacaatactaattatagcgcttcttgcttggctcttaaggatgcctgtactgtagatactctgatcttagttttgttgctctcctgtaaccaagtctgtcagagttctttacatgttatcattttgccttataccttatatgcaatttattaagggtgttcacctactgtacttttgcaccattgctcttttctgtgattcggttgattgaagaggtgcctcattagaagtgtgccaatggcatatgtcgacacctgggaccactagtaagagctttcacctgtcacaatttaatggtgttctttaatcaatgaaatgaactatcaggaatatatctctctttttgtttcactgtcactggtgatgttgcacttaactcccattaagagctttctgtgatggccactggtattgcttaccattacatgctactgtgctatgtttctttttccggaagtaagaacctcatgagatttagggtagatgggcgatatgagattattttatctttgttatatgatgtttatgacactcattttaccagtcataaagctgttgcatctactgctgtgttagtgctgataagtgatgggtatggagcatgatacgacaggttatatttctctttctacttaccatagtttatttttctgacgtatctacctaacagatattacatgttgttgctgtttgtagttgtactggagggtgggctgtcgtgctttcgacatataaagaagttatcaatagagaatctaaagcattatcccatgctgatcatcttttgcaaagtggcatcacttgtgggagcgcaggcagttgtaaagactgatcctggtagcagttctagaattgtaagttgcatatgacctggaactttctgatctatctttcaacctcttcaattgagttgcctctgcatctgcaagcatgccttgcctgttcaacagtaggattgcagtgagttgtttgtatgagctaacaatgcagagtcaacaccccagggtataggtgtctcttaattgttattatgatcaggtcaatagaaaaaaagggataagagtttcttgttgttcttttttttttgtttgtttatgtaagatggatgtttttttttcttctattaattttttgtggtaaataaggaaacagttttatttttagaatctttcaattgtcaataatattggacccttttaattttctgaccctttttgctgagaagagttccttttccaatcttcttgatcatcctttgtaaattggtcattggtaccatacaaagcaaagtacaaatccggttggaaccaagccatcccagttgcatgggttacttatcttgtaaatgtaggttctttgtccaggcaccatgagcttagtgaatgaagggattcttgtgctcaagcaatctcctcagcatcaattctttcttgttgtccttggcatctgtgttcatcttcaagttgccctgcagccctgcacaatacaattttctttctcatcaatgctcttagatgcgcagttctcgtcttttttctgatgcgccttgccggcatcctaatctcaatattccttgcgcagcacagaagctttcagtagctttcacagaatatatgctgcctgagcgtgcaaataaactatcgtagcgacgactatcttgcgcttagtgatagttactgttcagggatgctttcttgatcaactagtctggtctagtggttatgtgatgctcttgtagttcatgggcactgggggtttggggaagcacctgaaggattcattcctgatatggtatctaatgccaaatttgcactctatatgttttaccttgtttatgactgcgggtgtagtaatgttctctgatgccatgtggtagtagctagatttgtttgaacgtaatctaaggttatataagattacactgaggcaatgaggggggcatctttgatatttcttccttgggagtatcgttggagcatatggaatttctactcctggtcagtgcttttgggcttcctcactttttcatattccaatgatcagattagcattagtcgttgtcatgagaaatattcctcttagaatgtgagcagttgtgccacatttcgcttcctggtttatcgcaggattggaggtgcactctctccatgttaccaaccacctgctgaaaacttcgtttgtgctatttcgccacattgcaaatgtgcaaatcacttggtacgggtggcagaaatttcatcagtcaacagtcgtaattagatcgaaccttgtgtcatatgcttagtccttctgcctcatttgtttcactgtacttgtattaacagcatagcttgtggcctatggacaactttttgcagccgttttcatcaattgaactgaagaatggactcaagccatccaggattccagtcccagatgatgctggtggagcaaagtcaagaggtctcagtaaggaatgctttctttgccttcccattccatctctgatcaagtgaccatttgatatgatccactgagaaaaccaccacattcttgtaaactaaacagtatcacacttatgcaactcaaatcttcttcgcaggatgatttttttgcgctggtgaaccggttgccggagaggggcagccgaatcttttgccgccgacctgactgacggtgcaaatccccggtgcgggatacggtggaaggcgatcggccgaacccggtctgctccacggctcaattcattcattgtcaatgcgcgcatctactgaagaagctgataagctgtctggctgggctaaccgaaagtcgtgtgcaaatgcaatggcatcgtcagctcgtcgcggtcgtggatggcgagttggcgacgcgttggtgcgtggccgtgcgtctgtcttttgcttcgcacgatcatcagttttgcagttgccttcatcgtggctttatttgaccatgagctccggccatctgaatccccaggagcccattgatacgtgcacctaattaagagccacatttgcatgaagcattggagggggcaaatcctgaagctttcgtttttgcagtggtataaagcagctaagggcctgtttggtagagttccaacttctaaatttaacttcaggagttgggtctggagtagagttgtggagctgcctaaacccagctccacttctctagttcattttgtgagagagtttcatccagctccactctcattttaggtggagctgaaactgtttggctgggttctagctccaggagatgtggagctggagctgaggctctatctcttgttttttttcttcttttggaaagctaaattccctattgtaaaaatgtgagttttctaactgccaacaattatagttaactacagtaacatatttcaaaattgaatgttcttctaacatattgacgggtaagccttcttgtgaaaacatatataggccttgtttagttacaaactttttcttcaaacttctaacttttctatcacattaaaactttcctacatatataaacttccaactttttcatcacatcgttccaatttcaattaaactttcaattttggcgtgaactaaacacacccatatatgtttgagctttctgactatcggcagagcccctcagtaccgctgttacaattagttcagttttcacaacttccctattggtttttccggtgcatatctttcttcggagaaaacattccttcccaagtttcaacttctgtatgggttggttttaaatcttaccgtagattatttgaactgagatttctcgctttctactccacgtggatcaaatttcaacacaaaaactcgctcatcgtaatacatactcagtttttgtgctgaaaactgagtaactttgatccacgtggaaaactgaactcagttataactcatcgtagctttgatgtattacgatgagttataaccaaaagtataactttcagctcaaacttatttggactaaaaatgtagactaggtttctttgggccaacagtgactacgctttcaggagtggtaatcctcctgagggcactattgaggtacccctcctctctcagcaaggagttctgggtgaaaaccttgtccagtctttggatggacgacgacggcgtcattcggcgtcgcgaccttcgtgagggcgtcgttttttagagtctccgctccgtggtagtgttgttggctcggtggcgatcggtctcgcatagcgacgaccggttcggtgctcgacttccctctctgtggcgtgtgtttgggcggttggcacttggttcgggacgtgtgctctggtgcacatccttcctcgacagccagttatcgatgtaaaacttttcttgtaacattttctctttatcttaataatattggatgacctccttcggtcattccgaaaaaaaaaaagttcagttcggatcccataactttcaaccaaaagatgaatagagttctctgtacatgaaaacccgaaaactctcaatcatgatgatcaaagacttctctgtaccaaacgagcttaaagaaaggtaggagctcttgccaatcatccaagaatcaaaataatctacattatcttctctaaattaatacccataccaataccaattaatttatatcaaactatgcctgagcacctcgtacattcgtaacgaataataacaggatgaataatgcaaagccagcattgatcccagagacactaaactcggttcttttgatcacaaccacggaccattgccaagtccagagttcaattaaggattgctgcatggtaaaagttgaaccggatttagatgcgatctcctaagatgtcgtatcatttatatataaaccgcctaataaaccaggggctagatgatagattattaataaacttgcggctgttgttacaagtaagcagacaaacagaacatctcatgaagcagaaaaacaaattattccagtccacaaaggttcatctcaacatctcaggaaatttaatcactttcgaagaaaggataagtagtgttagccatggcagattatcacaatttacataatcttagcatgaagtagctccatatatagaagaaattccatcaaaacaacgttgtaaaactaccagagctgtagactttttacccacatgtttaaatttcggcaacacttcaactgcttcaaaaactcagtcttagctgcacttccctactcatgaatttttacaagaatctgtaacgccttgtttgtaataaataatgaagttgatttatggctgatggttggcaattagctaacaccatcacttcctgaatatgccaatcatgacacatgagtggtgtgccattctcagagccaagacgaaatcaatgtcccaacatgcagaaccgactttagctgcagtaagctgaagcaaagcaaatgagcacagatgatatgacaatgcctggcaagctttctatgctgtgatccatccaagggagatgataggtatggaaaacaacagttctaccaatctgggtcacttgtactatcattattcacaaatcgcaacagcagcagaaatcaactgtgccctgcatttgggttggttccagaagtgtgcggtgattgttgatccgtagaaacacctccagcattctgtgcctcacgagttgagaatagctcattcaaccaaggaacaatagcccagggtctgttactgctctcgctgacgtttccagggccatcagctctgacttcctcatggctgtcctccactctaccaatgttgctaggctcgttcaagtcttttgtctcctcagaaggcagctcaaaccggcaaaccgggcaggaactatgtaattcaagccatggcaggatacaagaagaatgaaacttatgttcacatggcatttgtttagcctgggaccccacctcaagatcatcaaggcagactgaacagctgacaacctcttcgattttcacagtgggcagcgcttcaaccgcctctttctttgcaggaggggtaccattccgacttgggtcgctctcagccaaatgttgaagcagcaggctcagacctgctccgaggacatactcctccagtaagccatcatcatttgttgaaccgccttggtcaccttggccctcatcaggatcaagcactgagccttgcagagcgagggcttggttgaaggcgttgatcagaatggaactgtccctttcttggtcatctgcaaggtcatcatggatgctgtcaagcacgcgtcgtagagttgatgcccgtcgatgcctcctgataaaaccctcaaactcacgacctaaatcattatcttcatcgtcgctgtccatcgtttctcctggatgctcaatagggttccattgcgagaaacccggctctggctgcctgttggtcagtctctcaatctcctcatcggtcatctcttcaacgaacccgccaccacaggatgggcacttgatctcatccaccatggcctcctcaatggcctgctcgcattcatggcaccagtaccttgtgattgcagcttctgccatcttgcaaatccttcggttgacggcaccacgatcaaaacgcaaatctgtgaaccgggcaccataataagttaataatccgtaagattcccaagcaaacaaccacgacatacacattttttatcatctacacgagagagtccagcatcttgccagaagtttaatcaagaagaactgaaacaagatgaacactacggcatccatccgtgactggatttcacaaagacaattgctggcatacagatctcacaacagatcagcatcaagaacaaagaacaagggttagctttgcatccaacacacgaaataaattagccttttttgggttcttcatcaacaggggcagcaagctgtcccagagaaaagacccacttgggggggatgaggcacagcactgacagatagatctttgcgaaggggaaggcagagatcaagagccaagattccctctccaagaatcaggtgctcgattccaattctttcagagaacacgatgctatcccccccgaaagaggaataaaaacgcagcagaagtctttggtttgggggttagaagaacaagaaaccggattccggcactgctcaagattcacgccattgcaccccgtataatttcgtcgcaggactcatcttcccccaccaaaatttcctctttttttaaagagaaaaatctctagattaacatacaagcgatcaaagggggaaagatagaaatcgtctccatgatttcgaacactggaacgaaaataaaaagaatccccttttgtatcaaactaagcagaaggaaaattcaaatcaagaagtgactaacctttcgattggactgggatattggattggatagaggcggtcgtcttgttctcgtttgcttcgggcgaagtgtgagacgaagaacaagaagttcagagggcaggtggctgcaaagctggatactttactccatccctagaggttatcgtactactaccaattttttttctctcgttcttgaataagataaagttttttttatatgatcctagcgcaaatctccaaccaataaagttttgttatgactaagcatacaaatcacgcaaatccgctgatcatcttgggagattttttaatatctgtaaattggagtttggctgataagaactcgttttcatccaaaagcaaaactacctaccagactagtatgctgttggcttctcccttgtattattggcgtgttaatttctataaaccattttcaatttattagaaaaatcttgttataatcttttttttacgaaataataagatatgaaatgtcaaagatataaatgattttgtcaaaatattttgtttctgatacttttcagcgaaactgtcgacgatggtatttgtgatacttttcagctaggcagcgagggccttatcttttcgcttatacttatatttatcagccaaagattaaaattttaacattaaatttgaagccaattttaaggtttttttatcgaagtttatttttcagctttgctcttagatcgctaagaacacatataaagttttattcacaaattactttcgtttgcaaatatgttattttgcttattcctgcaggttaacagcactgttcaggccttgctaaatgatcctgtctaaaaaaatcgtttctttaaaaggagatttgtaatttggccaaacatgagtagatgttgtttacttcttctttttttcatatatgccatgtgtatgacatgtggctttggtgatgatttcccaggtgtagcaaatgaacactaatcactcaattatggggcaaaagagcacaattttcttcttttaaaccacttagtgtttcaaatacaagaaccgttaggatttcttttttaaaaaatattttaaccttttaaattttttaaaaataaaccatcccaaacttattactaaatctaaaccttgacagcagtgccatgtccaatgtttatcacatgttttgttacgccaaatggagtgccatttttaaaatgttcaaataatttttagatagtttctttttgaaaaacaaaaaattaaaaggttaaaaaaatattgaaatgccaagaggggcaaaggcaaccatatggtttacttggtcaacctaaatctgcttccaaaaggttaattaacctctaccgtaattgggtaacttaatcacgacgtactccacctgcctgtcaatgtcatactttacacctgattagtactcctacttactatacttattttggaactggacctatctaatttctcctagtcagaaccaaattttctcctcagaaagatcccatttttttctcatagaatattcacaagctggtacttctagaagataaagaaatgttaaatccggaccgacgatctggtggtctactcgccgatgtcaacgtgccacctgcactttttgggcctaaaatgggccatacatgggccggaacccggcccatacaggtccgtgtgaaccaggccggatactgcggcccacactacacggcctggcccatgaatgatcggagatgagagcaagggtgacgtcagccatggcggagaagccaatccacctcctccctcccctccacctcgccgccgccgccgccgccgcatctgccgaaggcgggagccgtgaggggaaggacctgtggcacgaggtggtggcggcatggagttcctgcaggggcagagcacggagaccgccgtggccgtggcggtggccgtcgtcgccgtggccgccggcgccgccttcctcctcctcctcctccgcagcagcaagaagcccaagggtatgcacccgcgagatctctcttcactcgacgacgctgcagcttccactgccactgaccactgtgatacaccgacactgatttagtggtcatttacctagcgatgtcttcggccttagccatcggttgcttgcatctgttctgcagcatttagagaatggttttgtgattgttaatgtcttcttgaagtaagctagtatcatctttggttcatagctcatcctgaatggttgtgctgtgatttgttccattaggctgcttggaccctgagaacttcaaggagtttaagcttgtggagaagaggcagatcagtcataatgtggccaagttcagatttgctctaccaacccctgcttctgtgctggggcttccaattggccaacatatcagttgcaggttgggggttatatcatatgtcttcttgcttctctcatatcttttgtttctcttttacaaagaattgtgttaaatgttatctcctgttcttgcagagggcaggatgctactggcgaggaagtaatcaagccttatactccaactacgctggattctgatcttggacggtttgagcttgttattaaggtaaaatttcacaaatatgttccattttgaatttgttagtcttgtctcgctagctttgtgcgtaatgtaaagctatagtccgtcagaaatgcaattatgtcaattcatccccctttcctggtttcccccctaatttttccttctcattttgaagatgtatccccaaggaagaatgtctcatcattttcatgagatgaaagttggtgactatttatctgtgagaggacctaaggtatggctttatttctgttgtaagtaatacagaaattttccatgctgtatttggccattcttgtgatgtataattttttctctgacttggttataaatctttgtgcctgtataaatttgtctgtgacttagggtcgcttcaaataccaacctgggcaagtaagagcatttggaatgttagctggaggatcaggcattaccccaatgttccaagtaagaccctttccaacaccaattttttttatggcatttaatatgtgagacacctgtgttcttcaattcattgtcctcccttactgtaggtcacaagagcaattcttgaaaacccaagtgacaatacgaaagtgcacttaatctatgccaatgtcacatatgatgacattcttctaaaggtatgatcttgttgaaagaattgctgtagttctccaccagtgattaaccttactggtgtttgttatatttaaagtcgcttcaattcatgggtgcctattagacttggatactatatgctctatccgttcagcttatgatattaagaataagaatctggtatgtctggtttttgaataaagggtagtttgtctagttgtagtgcaaagttagcaggttataccacagaaaccttgaaaatatcatacaggacatgtactttgttaccagataaccagaattccatatatgtcgtctcgataatcttcttccttaataatctggtaacagcccactttttaattgaaagtcaaagatgatatgcaaactatctctcagtggcctaaccatgaacacaatcaaccttgtattgtagcttgttttgctatgtagagtcctttctctttagatctgttggagaaaagtaaggttccattgttgaagtaatgcttcatatgtgcttttcgataactgaatgagactactgcatagtttctgtaagatgaacgtggttcaatatgtagtacgatgttgtgcttgaaagctgatgtttgctaattgctgctgctcatttacttgtcgctttgatttatgcaggaagaattggatagtatggttgaaacctatcccgatcgcttcaagatatactatgtattaaatcaggtttgttttctgttctgaggtctagtactttgtactgtggtgtgcaataatttcatgcctgaactgtctactttggtagtcccatcttctactacttactgctaatactactatattatggcttgcattaaattcctaccatgcaccttacaccatcagctttgttttcatgagcagcctccagaaatctggaatggtggtgttgggtttgtgtcaatggaaatgatccaaacccattgcccggcacctgctgctgacattcaggtaggtgtcacattgtgatgtcttctgtggtagcgtgccttctggaacttggaaccgacaattgctaagagaatagttgaagtgtattccatctaccaagcaggacatctgtgtgacaatgtatggttgctcctttcagatattgagatgcggacctcctcccatgaacaaagccatggctgaacacctggagaatcttggctacacgaaggaaatgcagttccaattctaagcctccacagtggaacaataccgaaataacagcgatggacaacattttcgttcaccttcagtagaaattgtctgaccctagtgccatttaatcaagatataggcgaactttaaacccgataaaagtagaatgtcaggtcagcatattttgagtgaaagcaaaaaacaacacctacttgagttggggtcagaagttcctgtagcccatcatttttgtgccaatgctgttcaattccagacagacagaatgaaactaattatttttttttcaatcagaattttggacacaaggttggaacgttcattgctccagctaactcgttgctcaggtgattaaagaatgaccaacttgtaccatttgattatgagaagaaaaacaactactgtacgtgccatttatgtctgtccatagatgcaaaaacctgtgacagcgaagctgttgtctgttcttttccagctcctgtcctgtacagccaaaacagtgcatcaattcatccgcttgtttatgcacaagattgcaaatctttgacagcaaagcaatcgccttttcttttcagcagctccaattgatttggtattacatacatacaaaaatgcattgtgtcttgtacgttactgtacgtatgtgctggcttcctaggagacatcagcgaggagattacgtccgcctgctgggcacacaagcattcggttccattttttaaagtaaatttcgggacattaaaactattttatcaaaactatcatgttgctgcaactttagttagtcatttaggcttcacctctcgtgcatgcaaaacagagcgacgtattttcttaattttaatatatttatatgatttttttaaaagtagcttttgtatagaaaacttttgtaaaaaacacaccgtttatcaatttaaaaagcgtacgtatggaacacgagagaggcgagttggaaaatgtgggaaagaacacagccttagagaactgtgtagaactatgttttatagaaaactatagttttatttgtctgataagtttagagcccttattacacacatggaatattgaagctattgtaatttaggcccacatgtcgtatgtagtgtacaaagttgtagttttctgataaaattgtttactattgttgtaattttgtgaattatcaattccataatttgcttgttagcttatcaaccacaatcaaaatttgaattttaaaacgcaattttagagtggttttgagttttttttatcgtagtgtatttgtccagtattgccttttaatatgttaaggtcatacatataaaggttttacccataaattatttttattgcttcatttatttatttttcacggctcatcagttgtacattaagggtctgttcggttcagctgggctgtggcgctgcagctcccctagcataatcttgcttgctgagtcctgtagctgcagtgctgctgctgccacagccagctcttccgaattcactctaagcaatgagagacctggttgaagttgtaacaaggtgatagttatcaccaaatagttgtagttttgtgaaatctactttttttaaaaaaaaaactacaaacacacattatattatatatatatatatatgccaaaataaattctacagatgtactactacttttgtcaaaacattttgttaactcagaacaaatgatggcagtgatcaacacagagctgtaatttggggagaagcactgagctggtgctataattagaatcttcgaggttaagttatctcaagctaaatgtggctaaagtagaagggacattgttttcagataagaccaagctttgatgtgtaccttaaaggttattatgtagtaggcctccccctacttctacttatttctttgggttgcacatatatgactttcttctcttgattgcccctccctctctagatctctcatggagggcgaaaatcgctgtcatgatcagttttaaatgcccatcatggcaccccactaattctcttgaggggtctagttttaatgatggagatgatgatcccacatcatccctcccacgagctcgtggcctcatgaccaaatcatatcttcttttttatggaccacgtcatttcttactcggatttatttgtcaaactataaatgaattaattattgttcgtctatttttttcattggttaaaacaactggatttggaatgaatttaaatgcaaacatatatgattatatttaaacttgtctaaagtttgtctagtaaaaatttcactagtactatctatgtttttaagtaattgttagtggcgattattattgctttattttgaccgcaaaataccattaaatggttaggctaggatgtgcggaagcgttatgattatgtttaggatgcaatacatccgtaagtaattgtttctctaatgaaaatgagttgtcgaggtttaaagatgaaaaagtggatttccccgtgcaaagctacataaaaagtacaattggattggatttcatatacgattatgttttttatataaaactggtaatagaattaatattcacatataggagtatctccctacgtacggttgtaatttgtatacagtaaatttaaaaaagtagaattacatctgatataccggtcttacgctcttagattttacatttttatgtgtttcatatcaaccatatcgaccaatctacactggtatagtttgaaaccatgttaaatttagtaagaactttaccaaaatcagttcaatcaacaaaaacagttaagtaaatttcacagaactacggatattccgactaatctatcgcaaaactaaaatatcgtatcacaaaactataaatttagcggtaaatttactataaaactacatattatatattgaagttatcacaaaactacataattaatattgaagttatcacaaaaccgcaaattctagagtctaaatccctagtactaacgttatattagagctatataaatgttgtagttctatgataaattagcactgtagttttgtgatatatttgctacttaaccttttttttttttgacactccattcaacatgtagttttgtgatataagattttaaatttgtagttttatgaaatttacttaaaaagatgttcccatatttatcattgcattattctgtctggctgtctgccatcaagcaaaatagtcttgactcttgagaaggatgttgccttgagaaagatggtgcttcaagccttcgactcatcatggattagttgagttgaccaccaccaccaccaccacaccacgacagacgggccaatccacccaaccgtctccacttccctccccaccgcgccaaattcccaccccctcctccgccgccgccgccgccgcacgtgcgcctccacctcctctccattgccgccgccgcggcacggtcaaccacccccacccttcggcggagtcgcggaggaatgcggggggggcaatagaaaattcgctcgctagcagttggcatggcggattagtttaatcttgaagtccttggtggtggtggtgaggaggagggggaggaggaggggattgggctggctaatggccgggtcctcctcctcgtttggctcgcagagcagaccgcgacccgggtttgaggggggagcagctccgcgccgcgctcgcggttgctggctgaggccgccgccgccttctcgggttgggggagtggttggggagccgttgggttcttcgctgctggggttttagggatcctaggctggcttgcttgcttgctcttggaggaggaggaagatcgtgggggtggagggtttcttgcgggggttggccggattttgattcgtcgcccgagcgggtgggttcctgtttcatcctgctgctggaaatctgtagaattgaatttttgttttctgattccatatgctcgatttctctttgttcctgttcgcaacttgtagaaattatggtggaagaattctttggtttgagaaggataatgagttgtgagaaaggagatttttggcatgaaaactactttttcttttggtatttgttggcgttgtggcgcgggaaatgtttgatttattacttggaatctcttacagtatttacaggcatgtaattcatgagagaccgcattgataatatttcatgagacttactaggtagtggatttttgtacgtcaactgttgctcgaaatggcactgtcataattttagtataattatgatgaatagttgacgatacttaattctgttaaatttttgttcaggcttgatactggaaaaaggagaagcttccatttttttttctctgacttgaaaggggatggccttcccagatgatgatgaaaagatgaaggtttgtgcttttcgctttacatcattcatataacattacaatacactcacaaaaataaaacatagcagcataattctattctcagatccactgtgctctatttgcatgttttggccctaatattttttttttcatactgaacttaaatcaaagtatttactttgtaattggttgtatactatagggttgccggccaaaactttttggaacaaaagataagaaagttgtgaagagggcagattaccaaagctgttctgcaggttagtttttctttctttttgaattgtgcatctagactgaattggtgtcttgtaggatagtgataaattgaaacgaagatgagcataatttatcaaatttcagctcatctagttgaatcaggggaattgctcaagtcagttgggcaatcagccaactacattcataaggtcaactgaacctcgtttcattgtgtataatgagaaatatatgaggagacagccagttcaaatatgtttaagaagatgctaggattcatttattctctagtttcatacttgataacttcgtgtcagaaatttcacattttgcccgaattgcttcaatacaattacgttgatttggcctaatgacaataatatagcgtaatagcaactaaatgtttccatgttttcctgtcaaatgcagttaagtccgggccaagttcctcaaagtcacaatcttcttcccccttcagaacacttacaggtggccttctgtttagcatttttgccacattgcctcactctattcatgtgctgatttgttttgattggattattttttggttctttggactgaaaggaagtttttgcagaagttaggagcatacgcctcagccatttacttggtcactcttcaagtactactaaaactgaacctttcaggtcaaacagctaaacttgcatgttgagtcatactttatgccgtcggtttgtcatactttacattcttagatcggactaggtcgtctttaattttttaattcattatataggatatttgtatctacatggaatgtcggaggaaacacgcctactgctgaattaaacctggatgacttccttcctgctgatgacaattcagatatttatgttttagggtaagttatttcaccaatttttcaccatcttacatatttttcatatttcagttagtgagtgatatgaaaaataaaaatagctccttttaatttgtttcctagtgatttcaggatgttactaacttgcttgctttgccacgatgagctaattttccttagtgttcatttgtttcattcagtgaaccgaagacgctgtttccatctgtctcttttctaatttttttttgacacattctcttatgatattatgcagttttcaggaaattgtccctctcaatgctggtaatgtgcttgtcgtagaagacaatgaaccagctgcaaggtggcttgctcttataaaccgaacgctaaacaaaccagttgacagtaatgctgatatcttccagcacaagccatcttcttcccttgattcaacctcgtctctgtcttcatcaaaccttgatgcctcattctccagccgcacaagaacagctagtggtagttctgcaatcttccagaagtcctccttgaagtctatcaggaagccttacatgccaacccagagaaaactgctcaaactctgcaattgctcagttgagatgactaggaagtcctacaaagatgcttgctttggatgtccacaagcatatgctaatgagacggactcttcagaagatgatacagatgatagatcgaatgatccttgtggttatatagttgatggaatgaattctgctgcctctgcctccagggatcagctaaaatacaacctcgtatcgtgcaaacgaatggttgggatttttatcacggtgtgggcaaagaaagaacttgtgcatcatataggccatgtgagaacgtcttgtataggtcgtggaataatgggctatctgggaaacaaggtaagaattaaatcaaagttcagaagtattatcttcataaccttgtaatgggatgtcattgttaattaaagcattacaatggtcacaattatattaataagtacagatttagcctgacatgttttttgataatgtttaatagccggaagtcatccttctgttctttctttttttttttttggagaaagagagggggacctctcccatttcattaatgaaatgatagtagttctacaagcattccaggttccaacttacacacaaagtctcagactactcctgaccttcagaattacaccagacagactaacagagcaacacagatgctaaagcaaacatttcagctccttccattctttttagtgtgacatagtaatgagggttcttcacaattctcatgtgtagattacatatttatgccacacttgcttttggcttcagggatgtatatcagtgagcatgacggtgcaccagacaagtttctgcttcatctgtagccatttggcttcaggtgagaaagagggtgatgagctgaggcggaatttagatgttttagagatactgagactcacgcaatttcaaaggatttgtagagctgggcgaagaattcctgagaaaattcttgaccacgagtaagtcatgcactcatgctacacatgctgcgaaggatttgttcattgtcaatcatcatttactaattattgtgatttctcttattttgttagtcgagtgatatggctgggagatctaaactaccgtatttccttgagctatgaagataccaagaaacttcttactgaaaataactgggatgccctttttgaaaaggaccaggtaaacttctcaaaagatgcactgttttttgaaacttcctctcagaaggaaaggactaaagtaataaacgataaaaccaaactttcaagaacttctactgtgtatgtgtgctctatgttctaattatatctagccaggctataatctacttatatcttgtgaaattttggttaacatgcatggttgccttctctttttcagcttaacatcgagcgcaagtctggaagggtgttcaagggttggagtgaggagaagatatattttgctcccacatacaagtattctagtaactcagattcttatgctggagagactgcaacatcaaagaaaaagaggagaacccccgcctggtatgtaccgtgttcatattagttagttttactataaaaatgtattcccactgtgtcaggttacaactttattggtaagttagtaccatttaattatcattataatttgtccacatgcttgtgtgcaacttcagtaatccaacattatcatcttatattaccatagaagaggaacatcttttgggtttcttgacgtgaaacagtgcgcatttggacaaatgttggttgaagtcgtagaaatagaaaacgatgaaatcattcacatgaacaaatattgcatcatactaacaaatatatatcagacaaatggcttggtgtactggctgtgtgcattgcactactgctgcacattttgcatttcaaatgttaatagtttcaacttgttcaggtgtgacagaatactatggcatggagatggcattgtgcagttgtcctacttccgtggggagtccaaattttcggatcaccgtcctgtctgtggaacatttattgttgatgttgaaatacaagagagcagatcaaagaggcgatcatctaataccaacatcagaataggtgctgaagaactcttaccaactagtaagagtaaggctaataaaaataagggcaataaaggtatgcagcttcttgactcttgatttaaatttaccataaaaacaacataatttccagtatatgcatggacaaaactaatttgtatgggcattgcacaggttctgggacctaaaccctattggaaattaaattggtagcaacagcaacttgtactaagatactgaagaatatttccatcggcacctgtaggtatttattccaaagcagattatttttttgtgacaggggaaaggtgattaccaagtcgtacagaaaatgtagtgcatatatactttccaaagggaaaggtgattatattatactcgaacaattttccacattctttttgttcttttgggtagaacaagtgtgcctatgcatagctatccagaatccattgacccccttgtattattgtgtctgtctgatcagtttgaacttttctgtaacaaaattgtactgagaacgaggcattattccaaaatgtacattatgttatctatctatctatctatctatctcataattgtctttgatttgccgattattatgtgactatctcatggataaacacaaattaagtatgattacaatgtacagtggatgtttcacctgagctacgtctgtaaattttcctttttgttcagtataattttggtcacctggccaagtgcaccatggtcttcttgtctggcttcgatcgacttctttctcacgaatgagtacaaacttttgtgattttcagctgaatttcattccttcaatcacattaagaacatttatgcaaacctattttatatctgaattctgctcaccttgaagttcaacggtagagccttagagggttctgcaactggaagccagaaatgcaaacttaacaagaaaggtcagcatttctggtttccctgacaaatgagtgcagttgttagtgcacgaagcttattctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgattaaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctgactttggggctaattcatccaaaggttagtttcaagcagtatgtcattgaaaaccacgctcaataattgttttttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatccaattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatccagcaagttttacatcaaaaggaattttatagttacttaatacgtctttaaataaaaaggaatttgattatgatcagcaaggaccatacaaacaaacagccacatcacccccagaaaatgatagctagttgagcggatcaatcaaacgattctaaacatcccggcgacgacgacggcggcggcggcaatggcgacgccgacggcgacgaggtggtcgccggagcggccggcggcggcggcgttggtggacggcgtcgccgtcgacggcggcgaggcgaacggtgaggtccctgcagatgaagttattaaggtcacatgaactcgaatttagcggccgtataaatacgtgacaggcacatgaacctaacggtacggcacgtcagtgtttactgtcgagcaattaattgccatcataaactgtatatgatgcttttgtacatgtagccgattaaatgtttattcctctatgatagcatcatcacaaattgtatgaacaacaaccataacgattccctcttcttttttcttttcttttttttgcgtgtataaggcaaagcatattagacaatgtgagttaggagacgtatttactggtgtagtatgcattagtagtgatgtgttcatcagcatcttttttatacagcgtgaaaaaagattatttgaaaaaaaaaatccggctggaaacacaaatctctggttaaaattagatgcttccctaaatctttgctggtatgtgacgtgtgtattactcagcttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaggtggagacgggaggggtggagacgcggcagatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggccccgctggccccggcgccgccgccggcgccgactgcgcctccgccgtcgtcgccgccgacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtttagttgaggaaataaaaatttttgggtgccatattggacgtttgaccggatgtcggaaggggttttcagacacgaataaaaaaactaatttcataactcgtctagaaaccgcgagacgaatattttgagcctaattaacccgtcattagcacatgtgagttactgtagcacttatagttaatcatgaactaattagacttaaaagattcgtctcgcgatttcctccctaactgtgtaattagtttttcatttatctacatctaatgcttcatgcatgtgtctaaagattcaatgtgatgtttttcggaaaaatatttggggaactaaacgggctttaatacacgctcaacgaacgtacaagtagtacgtcataaataaaatctatatatcttgcgaaattcatattcgaacaccatggtggtgtttgaaattcatatatagataaggatgaagattaagattaaggttgtgtatagattccaactttttttcatcgaacttctaattttttcgtcacatcaaatatttagacacatgtatggagcatcaaatgtggacaaaaacaaaaactaattgcacagtccggctgtaaatcacgagatgaatcttttgagcctaattacgtcatgattagcacataggctaaaaagattcgtctcacagtttatagtcggaacctataatttgttttgttattagtttacattattaatacttcaaatgtatatccgtatacgtcaaaaaaaattggccaattttttacagcatctaaacacggcctaagtgttttacgcaaaacgatatggtatcaacgtatgattaattttttaattgacttttagttatttattttgtaaaatatccaaactttagagcaacttttatataggaagttttcgcacgaaacatatcgtttagtaatttttaaaaagcatgtcacgcatatccaaactttggtccagtttttgttgaagaaataaataaatctatacatcttgcgaaattcatatttgagcactatatgtatcccgagtcatgacgtttggtgcaagagcattttatccatgtctatctacaacaacaataatatatatggagtataagttttcaagaaaacagcaataatatatcgaacgcaattcaaggatgatggcatatgcatgcatgccgcatgaaggatatgagttgtggctatctagctagctagctcacattaatgcaccttgttgtaggagtaggatgcgtagttcttaaaaaaaataaaaaaagaaagaaaaatgtgtaggatgtgtacaccctccgtccgtccgataaaaaacgaatttagaatcggatgtgacatattctagtacgataaatctgaatatatatatgtctaaattcgtagtaataaaatgtggcacatataatactagattggttttttttaatagaacggagtacatgtgaaacaagaaactgcccgtgattaaatcctgtatctatacagtcgacacgcatgcattgcggctccggttctcgcggcagggattaaatcctgccgtccatcttcagctcgattcatcactgtccatcaggtcaaatttgcgcagttcacacacgccggccgcccgggccgaccctcgcgttgcatgatcgaataatatgattacggcgagctgttctgttcttcggttcatatgcatgatccgatgatcgatcgatcatgaggtgccagtcttttgcattgattggatcaaacataattctccctctgtctcaaaaataaataaacacatgtgatatgtaacatattttaatactacaaatctacttataaaatagaacttatattaaagagacaatccattatatgccactgagtttgtcacatctttacgatttgccactgactttaccacgttttataatataccatcgatttttacttaacttttatgatttaccatcgccgtccagttagtctccgttagtactgtacaattttgttcaaatgaccaaaatacccctgtgataaaacttccaaaatgtggacaaaaattccgaaataccatattataaacataagatagtaaacattcaaaatttgtccaaaaacttaaagtctgatatttcagaatttttatccaaaatttgaaagtttttgtctcaggggtattttggtcatttggacgaaagtgtacagcaccaacggagactaactggacggcgatggtaaatcgtagaagttaagcaaaaatcgatggtatattatagaacgtgacaaagtcagtggcaaattatagacccatgacaaactcagtggcatacaatggattatctctatattaaatttgtttattttggaatcgaagaaaatacgaataaccaagcaaagcttgtcaagtgccttcctcacatatatggttgtgtttagttcacgccaaaattggaagtttggttgaaattggaacgatgtgacggaaaagttgaaagtttatgtgtgtaggaaagttttaatgtgacgaaaaaattagaagtttgaagaaatattttgaagagtaaagtgcaccagcggtcctcaaacttgtaagggtgtgtcatctaggtccccaaactctcaaatcgtatttacaggtccctaaacttgcttagccgtacattgcctgtccaaaccccatttgactcggtctgctcgctgacgtggcttgccaacgtggaggggaggagacagccggggtggtgcattatgcattaagccccttattttttcgccagccctcagacgataaatcccccactcttttttttcctcggcgcgggaaggacgaaatccccgactcctcgttatcctcggtgtgggaagggcgaagtgggtgacgcaagcgagaggaggtggtgatcgccggtgatcgccgacaaccaacgccaatcgatcataggattggtagagagggtgggggagcgattctgtctgcacccatcgacggacgcgacggcagagaatggtggcaagattgcgtcgactaggtggagacgcgcctgtgtacggtgagtaaaatcaagccctaatccttgtatgctagcaggtttagatcgataataggcagtaatgtaccttgctgttggtagaaaatttggaatttgctggctcggttcgatgcatgttttgccgtacggcaaagctagggttttttgtttgcacaagtttacatgctgtatcgtggattgaaggatttgtttcttccttactaggtgatgggtcagatgagttcacagtgaaggttcaccatgggggttttttcgttgggcatggtaatctccgttcttatttgaatggaaaagtgagttggtttgataatgtcgagatagacacttggtctccactatggctggaccagttcgttgaggatcttggataccttaggactcccaccttgaagatttattggctgttacctggtaaggacatttcagatgggttaagagtggtggttagtgatacttatacaaatgtgatggcatcaatggttgaaaagttcaggaccttagttgtatatattgaccatgatgacaaagttgcagggattgactgggatgatatcatagacaatccaggtacacctttaccaaaggtaatcagccccaataaggtgaattgtgtagagaagataataggtgagagcagcaaacagcaagagggtaatcttaaggagcagagtagcaggcaacaacaaggaagcaggcagcaacagagcaatctaaaagagcataacaacagggagcaacaagaagatgattgtgatgaagaagacagtgggacaaagagtgatgacagtgatgaggaattctatgatagtgactatgaattagatgatggtgatgatgacttgtttgttgattatgttgatgaaaatgtgatagatgagggggtggccaaaggaaagaaaatattgaagggaaagaaagccagaggaagcaggttgaagggaaatcttgcaattgtgcctagaggagatgaaagtgaagatactgatgaggaagagcttaatgcagcagattctgatgatgagggtgtcaggctcaagttcaagtcatttgcagaagaggacttgaacaatcctaatttcaaggttggtcttgttttcccatctgttaagaagttgagacaagcaattactgagtacagtgtaaggaatagggttgagatcaagatgcctagaaatgataggaggaggataagagctcattgtgaagaaggttgcccatggaatctttatacttcagaagacagtagagctaaagcttttgtggtgaagacttatgatgagagacatacctgtcaaaaagagtggattctcaaaaggtgcacatccaaatggttggctggaaagtatatagaagcatttagggctgatgagaaaatgagcctaactagttttgcaaagacagtgcaactgcagtggaacttgacaccatctaggagcaaattagctagagctagaaggattgcaatgaagaccatacatggagatgaggttgagcagtacaagcttttgtgggattatggcaaaaaattgaggagaagcaatcctgggacttctttcttcctaagcttgatggtagccttttcagccaatgtacatgtcaatggatgcttgcaagagagggtttctgaatggttgcagaccattgatttgtttggatggttgccacattaagacaaagtatggtggacaattgctaactgcagttggtatggatccaaatgactgtatatatccaattgcctttgctgtagtggaggttgaatctctggctacatggaaatggttcttggagacactgaaaaatgatctaggcatcgaaaacacatatccttggactataatgactgataagcagaaggggttaataccagctgtccaacaggtcttcccagagtctgaacataggttctgtgttaggcatctgtactcaaactttcagcttcagtttaagggagaagtaccgaagaatcaattgtgggcatgtgctaggtcatcttctgtccaagaatggaacaaaaatatggatgtgatgagaaatttgaacaagagtgcttatgaatggcttgaaaagttgcctccaaacacatgggtcagagctttcttctcagaattccctaagtgtgatatattactaaataataattgcgaggtttttaacaaatacattctagaagctagagaattacctattttgactatgctagagaagataaaaggacaactcatgactaggcatttcaataaacaaaaagagttggctgatcagttccaaggcttaatctgccccaaaattaggaagaaggtgctgaaaaatgcagatgcagctaatacatgttatgcattaccagctgggcagggaatatttcaagtgcatgaaagggaatatcagtacatagtggatatcaatgctatgcattgtgattgcaggaggtgggacttgacagggattccatgtaatcatgccatatcctgtcttaggcatgagaggataaatgctgaaagtattctccctaattgctacactacagatgcattcagtaaagcctatggtttcaacatttggccctgcaatgacaagagcaaatgggaaaatatcaatggtcctgagattaagccacctgtgtatgagaagaaggctggcaggcccaaaaagtctaggagaaaggcaccatatgaagtaattggcaaaaatggtccaaagctgacaaaacatggagtgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatacttaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggatgccccgcatccgagcttgaagaagagggcgacgaactgaagatggaggcgacgaatcgagcctccctagggtttcacggcttagctcgatggggaaaaaaaagcgaaacagtgggggatttatcgtctgagggctggcgaaaaaataaggggcttaatgcataatgcaccaccctggctgtctcctcccctccacgttggcaagccatgtcagcgagcagaccgagtcaaatgggtttggacaggcaatgtacggctaagcaagtttagggacctgtaaatgcgatttgagagtttggggatctagatgacacacccttataagtttgaggaccgctggttcactttactctattttgaaactaaacacggcgattgaatcggagtaaaaagtaggaccgtcacgtcacgtcggatgttagcgcacggacggttggggaagtgatgtactgtaggagtatctagctagctggcattcattcttgcattcatggtacaggcatgatcaccgtcccctttctctctgtgctactgttactgtggctctgctgcgtgcagctgtcacggtttcatttttcgggtgtctctgggttggttaacccaatacacaaggcaacgaacatgtttaccggcttggtttcatgtgggaaaagaaagcaacggaattgtagccatctcagctcagctctcaggtgtacaatggccactcgaccgcttgcttgcctgccggtctctttcgtttgctccgttgaacatgacgggtacaaaaactttgggatgccaccaaaatattcgttcgtccaggactccacataggcacatcgtagccgcctggatatattgctccgaccgacactagagatggtaatgggactccgatttccctgggtgtgaatatatgttgcattgcttatataatttgacacgtatatattattttaaatagggacaaagaccccataggaatttattccccgtgcggactgggatgggagcaaaatttccccttcgtatttcacgaggacgggaacggaaaagttttgttttgcggggatgggggtgggggtgggggtggggaattcaccatccgacacaaacttagattctgtttaagagtagagaaaagaaaacgtttgaaaagataggtaaacgagataagttattagtgtataattaatatttaattaattattaattaattattttaaatttaaaaatgaattaatattgtattttgaaacagtttttatatactacctccatcccatattacttgtcggtttgagttgttgtttgtactccctccgtttcaaaatataagcatttttagctatgaatctagacaactgtgtatccagattcatagctaaaagtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaactatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagcccgcagcccgcagatctgcgagcaagggcacgcagaaagcgcggcatcggatcggattcgcggccaaccgaagcgattccccgcgcccacccagattcctcccaacaccaagcgtgggaacgaagctagatcgagcggagccggtcaaaccgggtcaaacttccccccgaatcaattcaaatccccccccccccccaaacctatcgaatctagcgagaaaacctaaccaatcaaatctccttcagatcaccccaacccatacaaacccacccccaaaaatcgcacaaaacaagcacacacacacacacacccaaatctaccgatcaaatcaaaatcaaaccaaaccagctgctgccgaaccgatcggatcggaagcagacgcagaattccactcaaaaccagcgagatcgaacacgaccagcgggggaatttcgcgggggcggtggttaccgagatcggcgacggcgacggcgacggcgacggcgatctcctcctctccttctctcccctgctctccccgcggcggcgtccggctccctcctcctcgcgggcgcggatggatcgcaggtggagaggagaaatgggcggagagggagaggagatagatggggagagagaggtcgttgaaatcgcgcaagggaggaggttatataggagggggagggggaggggctgggtcaccggcaggtggggcccacgtgggtttgtggtgagggcgtggaggggcaggttggagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgttctagatttctgtgatgcgtctggtactgatggatgttagtttttgcagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtactgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttgctcattgttcctgtaatttggcttccgtgtagatcctgccattttttccatcttgccacttgtttccatctagatccagtaactttgtaacattgtctgaataacaaatcatgagtgcaatatatggggttggaggaaatatttcaaggtcctctgcactcaacaactgcctgtgttccttgagcacagggttcttgaaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttgaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaagaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgtttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattgaagaggaatgtttttttttccttcaaaacaggcactttcccctttgttttgcaggaataattaaacatgaatgcatggcaagctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtgggcggagggaggagaggaggacgtcctggagggcgctgtccttgttcatggcggccttgaactcgtcgaaggtgaccttgccgtcgctgtcggcgtccatctggtcgaacacctcgtccagcttccccggctccgttatgtcgcctggcaggcactcctccggcaacgccttgtgaggatcaccaaagttcagatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttgttatgaattttaattgaatttgaagttatgtatgatatgatatcatgcaatgtttctgatattcctgtacataaattggaagggctgccacttcagtttgagtcgagtgcatttggaaatttttacctggaagcacaagcgaagagcatcatcgcctcgtgagttcctgaggctggagaacccacacaggatctctctcatgtcgacggttccatcacggttgttgtcgaacagatcgaatacgcggggagctaggggaatcagtgagtccattttcattgctctcagcacctgctcaaactctgacagagtggcgttttctccatctgcacatctgcataaagagcacttgcttagtgttatacttttcgattggaacatcatatgtgtcatgtttaaatcctaaaactatgaaggttttacgagaaatctgaacttctgaagcttctctggcaaaggaaaaaaaggctaccgctttctgcttataaatcttttcggtgttaatttcacagttcatcatagcacatatcttctactcctaaaatcctaataaaatgggctgcacatgatatatgatatgtgcaaatatactcctgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaagaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggccaactgctattgatttgacatctcagggcaactttttctactagaactggacaaaatataggacaatgcaggtataaactgaagtgctaacaactaccaaaagacgacatttcagcaatgattggcaggcagatctccaaactatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaataggtatcgtcaaatgcgaaccagaatattccaaaccattttgaacaccattgaagcaacaatttgaccagagttagctcaggaaacttacttgcaggatcctttgctgcttttctcgattggttgcagcatgaaatggtgggcatctgaaatacacaaactaccaggcttaaaactacgaaaataatcctaatcaagggaactataacaagaaaatggccaacatacccagataaaagaatgtacagaattaccccaacagaccacatatcactagcagctgaaacctcctgcctggatagagcctccggtgaaacataatctattgacccaaacagcgcgacgattgggtcactgaaatcttcgacagaactcaaaccaaaatccatgatcttcagtgtggacttctcatctttgtcagagaacagacaattctccggcttcaggtccctgtgtacaatgcttgccttatgaagagcctccagcccgctagcaatctgacgaatgacgcaggccgcatcgaactccgagtaccggtcacgccccacaatccgatcaaaaagctcaccacccgagcacagctcaaggacgaggtgcacaccatgcacatcttcatacacatcatgcaggttgatgacattaggatgtggcgcaacgctctccactatcctcctcatgacgagtatctcgttcgtcagcagcgcgtcggagatcgatacctgtttccacatcggcaggccggagccgggcacgggctttgtcccctgcttcatacccgccatcgccgggccgagcctcctcagagtcttgatggcaacctgggtcttctcttcagacttgctcactcccctccttactattgagaacccgccccggccaagaacatccacaacttcatagtcatcggacaactttctgctctcagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtcaaacggctggagaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaaaacaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaacaaaaaaataataattttctagatgaactatgccgaatctccaaagctcaatggctcttgtgacgcttagggtttatctttccataggctgcttgcctttcggtggtcatcttcaactccctcctcctacgcttccttcgttcacttctggttgattttgccttgccatctgcatccccctgttcattcggcagctccttctctggttctgatgaagcagggccttcctcagacttagacttcttctttttgaccttcttgccttctttatcctgtcctccaaggatcgaatccttgatcagtttcttatgatgcgtcaccttccattctgcctccctgtaaggagctatcttcttcatggatacatactggttcaaatccttgtcatctgatgccaatatctcataggtgctcaggccgaaactgttcggcttaacttgcttatacttgaacctagtcttcagatctccaatagtgtcctcatagtctaacttgtagtactcttccatctccttctcaagctccaccttgtccttcaaagaaatttttcctttcattttctgatttgtcccctcaccatttgcaatatcttttccacctttctttttctgagaagccccctcagctgctgcagacgatccatcttgcccatcaagagcccagtccttgggtagcccaagcagttcatcttctttgtcaaagtctggtttttccaaatcaatttcctcaccactcccaaattcaggatcaacatcatctgcttcatagtaattgtcattgaatgtctccttcattttcctgtcatactcctcaggatcaaaatcctcctccaagtcatcggctccgagcttgcaagctgcatcgctatcaattccggcaatcatccggatcctctcaagcttctcggcgatctctttcttcttcaagttcttcaaatgcttcaactcctctgcctgctcctgcttggcccgtgctatccgctcctccttgttcttgcgctgctgcttcctgctgctctccttcttcctcacagacccctcgacaaaccgcgaatgccccatcaccctgtccattacatccgcaccagtcgcggctgcttcctcatgccggaagttatacctggtctcataatcctcctgctctatgagatgctcctcttcgtccgatacctcctggatatcatccggagagtatttcttctcgctgcccgtctcgagatacggcctctcgagaagaatttcttcaggaacttgctgttctcgtccagctcctcgtctttgccgaaaatatcaatcagtatctgctcagtctccttcttctcctcgtcatcatcctccttgttaccaccatctccacccttcggcttcacttggaacaaatcgtcatcatcctcgccgccatcgccatcgccattgcctaatgccgccttctccgccgcaaggaaagcctccagccccttcctctgctgctcgtcgtaggcgatcttgtcgtacttgctgctgctgtggccgccatggctagcctgcgccgcgaactcggggccctcctcgagcaggtggcgagcgttcacgtccttgaggtacaggggccgctccttcttcgtcttcttgggcttctccccctcctcgtcgccgggttcactctccgacgaggaggaatacatcttggccttcgcgtcgaggatggcggcgtcgccgcgccggatgcggcggatgacctcgaacatctggcggtcgacgcggcgggacgcgatggcggcgtcatcgtcgtccgacaaggactcgtcgtcgtcgtcgtcctcctcctcctcctcctccggcgggacgaggcccttcttcttgcgctcctccaggcgctgcagcgcctcccgccgcttgttgtgctcgaagcggcgggcgtactcctcgttgatctggatcttggagagatcctcctcgccgccgcctccatcggactcattgtcggagcccgcgaggatgtccttcttcttcttctcctcctccctcctctgcttcatggctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggtgggttgtggcgatgatgcagaagaagagcacggacaacatcaacaacaagctgcagctggtgatgaagagcggcaagtacacgctcggctacaagaccgtcctcaagacgctgcgcaactccaagggtatcgatcccgaccgattttttgttgttttgttcgatctggtagtgttagtggatgttgattgattagtttgctcgcttaatccgaattgtagggtaggtgggagtgttatgattgattgatgcgttgctagctaatcatagtctgcctatagatctgcgtgttagttcgtgcgataattttcgggtagattggactgtcttatgtttatttatgggtggaattgttgtaaatcctttggaagttgatcggctgtaaatttaagtttagatggattgtggttgcaattatttgggatgcgttgtgaattgagttgcattgcggttgtcttgaatgaatgggactgaagtttacctctttggcttgcttttgcggtgtcttagagatgaatacagtaccctataacaataccaacctcttagttaatagttctccatgatctccattagtctggggacaactggaggttgaaacatttgttgtttatggagcatagatcatgttatatagtgtgatgtctgaaatggttttatcgattttatatgttctcagttacctgcttacacatgacatattctttttttctgttgtacatatgtgcaaaatacggtgcatttaactcaggctgtatttgtattttgatgtgtggtccttgttattgtgtttgttgcttgttgatattagttaagaaagttaaatgcaaacttcccttgaacttaaatttctcgagttgaatgaatttgcagttataacatgtaggaaatttcagataggttgtgttgtggtttctgattgtgacatcaatcacatcttttttatgtttagggaagctgattatccttgcaaacaactgccctccactcaggaagtctgagattgagtattacgccatgttgggaaaagttagcgttcaccatttccatggaagtaagtttgtttcatccttccgaaccatttatgttttgtgtgatagcatctgtattcatctacatgtcacggtttttccgtgatatagtttggtactgtatgtcttactgtgccttcgctttcagacaatgttgatcttggaactgcctgcggcaagtactaccgggtgtgctgcctcagcatcatcgaccctggttcgtcgctaccgacatcacttacatatattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattttagcaaggttgccaaaattttggcaaggttgtcaaattttgacaagattttatatgtgcttagtaaaatttaggaacaaactaaatgtagcaactttttttttaactttgccaaaacttgataagattgaaaatggtagcaaactgaacaagccataatcgtggaccaaagaaaggaaacaaatgttgaccatcacg

SEQ ID NO: 71603 - DNA, 34425 bp, Oryza sativa
gtcagtgagtgttttgctaaaaataaaaaaaattatagttcctcctctttctcgctttcctcctcatcgtagatgtcatcggcggcggcggcggttgcagggccggcgaggcagaggtgtgcccaaaagatgaccctgaaatcaaatctcccggagtttttgaccgagtcgttccaccggagcaagccgctcttgacagacctcatggagctgggcgtgcttgccgtgccattctcgacggacgggaacacgccggacctgcggttcgacgagaccgatgacgatgacgccgacgacgcggcagctttcttcttcgtataatcaatcaaaaattcaaacgttaattcattattcatgtatctgcctttcaaatcgattgctgcttcttgcagattgctagatggccagaagaagcaagctaatgtgtcacctgattcccctgtgtgagttggacttttctgaacttatttgaagatatagctgaagtttttgcgtatgcagcgcggaactgaactgctcttgcaggtatctctcgctccggccggacagtcgcgtccgtggcagcgacgtcgggtacccaccgtggcaagctttcgtggcgcagctgccaccggtaaaggggatgtggtctgaccttcttaacgggatggatgggagggtatccccgtgggcgagcaataggccatggcgcgcgggctcctagcgcgcctcctcccgttgcactccagagctttgatttcatggtcatctccgggtgcaccttcgcctcgctggccctgccacaacggccaccgccgctgacaccgacgacgacgacgacgaaagggagagagaggaagagagaagaggtaaaagagatgaggcggtgacgtaggtccctctgcattttttttatttttaactaaacacttactgatatgtaggtctcatgttttttttttctgttttacgtgtcacgccaatgccatatcagccgaaaacgtcgtccaaaccgttttgggaccttatttatattagttttgagagttgtgagacgcgtcgtattattactattcagggagacttagcgataaattaagggacctgaagtgaacttaatgcacagccaacaggtcgtaccgtaccctcaatcctattctagcccaactaagcggcccacacttaagccattatattgtaccagcccaactagaatgatccgcatgtaaaccataataatgttttggcccaaccagccgtgatccgcgccacaaaaaacgaacccttccggcacatactgccattatacataggttaatgctcaattatatatagctccagtttaaattgtgtaaaaactaacatggaaactccatcagctattgaaatcggttgttttgcctcctcttgagtggttggttttatcctacatgcactactggagaaaagggtcttcactcacggttcgtaaccccctgttgtcccagttgtgcaaccgggaccccgaatcaggtactaaagatgggcatatagtcccggttgaaataatcgagactaaagatgaatcttcgtaatacgaaccaacactaaagatcagagtgccacgtggctgacgctctcatctttagtatttttttttgttttatttttaattattttttttgctacttatattaatttcaaaccaaactcaacgacaaaatcatccccattcacaaaacatcacaaaatcatcgacaaattcatagatcgaatgaacatactcaaattgacataacaaattcattagacccacggtatgaacaaattcacataaaaaaacaaatacacattaatcaagtcattgtcgcgccggccgccgcccggtgctgctcctcgtccggcgtcgtgttagccgccgccgccgcccgacgcgcgcaggccgcccttgcccggtgctgcgctggccgccgccaccgcccaacgctgctcctctctgttgcgaaaaaaaatggagagatgagatatagagaggagcctaaggataagatcgatagaggataagatagagatgagagagagagagagaggaggaggaaagggagttacagatgaggaggagtttgtgaggatgaggtgaggataagtgcgagggattatatataatgcatcgatctttagttccggttggtaacaccaaccgggaataaagatagtgggacgcctgacatattttgaaccgagactaaaaatggtcttttaacttacattgcgattttaaatcgggactaatatggattttgcatgacccaacaaagatcagttgccagtagtgatggtagctacatggtatgtttccggtattcatcatatatgactcttacatggaattataatcagtaaagaaatgtaaaaatatattgaggccgacgaggatggacgctgtagcagccataataatgggccacaacacattagcaataagaagagtaccatttacatggcaataacgtgtcatatcttcacgtatgacatgtatttttcccgaccagaatactcataggcataaagctataacaacagcaaatagttcagaataaataaataataaataaaaatctaggggaaggaggacgggatactttagtgaccactttcctttccttcgtttggctgaactcccacgcacaagctaagcagtagcgtccctcgtctccttgcccccatcgaccacaacaacaaacagggaaggaggagcacgtaagaaaaagaaagtagaagaggagaggaggagccgttgattgtgacttgctgggcaaccaacactactacagaaatgaatatttaggtcagcattatatatgtcggaaatggtataaacgttagctgtagtgccttgatacttggtacttacgtataacggtatttggtagttggtttggtacctcacaagtcacaacagggaagatgggagttcattgaggagagaaagggagtagaatagtgatgaggacatcaacaattcaacaccatcaatacatccatgtctccacaagtacaagtacaactatcggtgagttcattctttacttcatgtttatcttagttataccacagagatgcgcgcactcttgttttactcaggaacaatagagaggatccaaaaggagaggattcacgcgggctggattcggactgcaggacagagccaacttcattctgacgaccgctacgacttcatgcgaactccgatttaggcgtgcaactacttcatgaaaatcttatcaagtctactttcaaatggatctagcctcgtgtccatatctatgttggagcggccgcaatcatcattttactaccaagttcttatttgggtctaatgggccatgtatcgagtttggtccattagggacgtgtactagggttagaacatgactccaacacccctgtggtcgttctctcatcttcttatacctttagccgccacaaagaacaattgggttttgtttacatcaaagtttagctttgctactttgccgtgtaatcccgtgattggttagatcgccggtttgttcgctgcggaagctcacctgtgatacttttgttgattcaatcctacatctttaattcgcaaattgagttgcttgttcatcttattcttgctagttatcgattgcttgcaagaataaataccctcgtggttgggctgaccatgcatccgtcgagattcataaccgcctctaagattggtgtacgattgctaaagcgcaaatagttttactcagattactaacgacgtgcacatcaaatggaggagcaagcaatttgatctgctgggaatagatcgatggaaaaaaattgtttgctcgttatgttatcccattgccaaaacggaatctcttgccgtggttcatttgataattttataagtaaattacagctttcatccattttataagtaaattacagctttaatcctttgtatatgcatgcaactacatgtgtggttgaccgtgtgcattccccttataatgcagacaccgggcgctgcccattacaaatcattgataaacatgtgtggttgactggtaggtccaaacatatcaacaaaacaattttgcaattcattgataaaatcatttattgctagttttctgaaacaactagctaaagttgccgtaaatcaatagttttgataaaacagttatagctttctgaaatttactcatacgaagttacaaatagactatacggtttactgttttatttatttattttatcatgaggaaacgtataatgcttttattgtacccttctgctgtacatctttcgcagtttcgctggccagtccaactcgaggcacaaataacattctattaaaaaaaatcctttgcatgataaattttgacacgtatattatattagctcccagggtttgaccaatttggccgagttacctcgagcaagccttgtaaaaatggcaaatgtcttttccaaaacctatacagtcaatccctaatcatcaccatccgtccagctgaagtttagcctgtctagttgtatattctcaagaaccatcatctcaaaaggaaataaaaaaggtccaaattaagtagcttgttctgtggtctggtcagtttgttatattcgctgctgtatcattttcactacagaagaactcttcagccttgtccaagaaagaagctgggatttttctatgcaacatgaagttagatgaagtttctccagctctttgcttcagaggtccatcatcaccaattcttgctcctcggccgtctctttggcccttatttctgctcaatctgatgacccctgaaactccttttcctaaaactggccgtgcacttttgcggttcgaccttattgagatatcaccttgcgggtttcttgtatccaataagatctgtgtattatcactggaactgttggttccccaaccatccaaaagaatggaatctgaagcagccagtcctggtgttttgcatgatttgatcaaagaacgaagcatctctgtgcttatttcttgctgaactacacttctattctggtcacaaccataacagaccgcgataagagcagtagccaagataggcatcaactccgggtcactgaagaaaacgaaaggcaagtcgcacacctgtttttcatcttaatcagttttgcccataggtctctgaagttaggagagaaacatggttatataaaactttgtttaccttgtgaagtatggtgggactctttccccaccgaagaactgcttggttcccagcatggaacaaagagaagtaaccaagaagtagcagagattctagaagcagtaaaccaacctgaaaaaagaagcacaaactcttatggtaaatagaattatccacaactatccctgcatgttttgcacattgaacgtgatagctgatcattcaaccacatactaaagcattgctttgagcatcagtgtgcaagttgtcaatagaccacattataagaatcacatatataatggaaagtgtttgtccaataagaacgtgcaaatgctgaatacacattaagattcttgttcaaggacaggagcccatgcatttattcttgacaatctacacatcaactagattctaaggtacccactctattagtctaatgtcacggataacaaagaaattgtaaccaagtccatccaagtaatagcaaactgtttgagatgcatcttgctattgctatagtattgctatagtgatagaagaattgatttacattaaaatctgaaacttgaaattaaagtactatgatacttaaggcaacaatgtacctcgacaaaaaaaaaagatatttaaaagtatcacatatatcatgtcaagaatgtatgaaccattttttctgtaaggaacagtctgcactttacctgatcatttggcactctccatttattcatgcaatggctaagaaggaaactgatcaaatggaagaactccatctttagatccgatctagcctgaaattatgagaagagtgaaaacttatataggtgaaagaacagaaagaaactatcttcagaattcctatactggaaaaccatcaatttgcctgacagctatgcatgaaacctttatggaagactgattgtgtccattgataacatggagacatttgttgctatgctaaattcatctaacaacatcaagttatacatgaagaacagacaagcagacagcaacaacaataccaagccttcgatagttggatgccaccacttaccagcatgcattgaagaagggtgatatccaaacatgccatgttgttcagaactttcaaaacgccagtggctacctcttcaaaattcgatggaagaattgctgaagcctgaaaaatgaagtgccatttgcttcaaagagaagatccatgaaacaagtatatatatatttggtctgtgaaaagaattccagttttatccttatgtgattcttaaagtctgaaagtcaccaagtaacagatttatgtgcataatgtcatctgccatgcttgtttataaatgcatgtgagcatgtcattttgaaactgagaaccttatgcatatccaaatgcatgtgtggcttctatataattcacttgcaatatggtaaaatggtgtttcataatgtctatgaagtattggaggcaacataagcagcttttttcttaaataaaaacaacattttttccacacaaagcattggatgtaaatagagaagaaagacaaacctgttctgatgatgatctgttgttggcctggagcaacacagctgtcaaaagagaaggcagactaacaaggcctgtctctgccatagcagaaagtacaagcactacaggttgatttaggtttatttcattgtcttttccaggactatcatgcaaacatgtagtactccccttttttctttcaagggtgccatctgcagcatctccctggcagggaattacagagtgtacctctagtgtatcagatgactgcatttctggcatggaccctgagtctttgctagcttcataaactgacatgttgtcccctggaatgttgaatttatgatgatccaaggacttattttctttgatcaattcgctaggatcgcattcatcacatttcaatagatcagacttggtagatggcaatttgacatctccagattgatcagatatcatcaactggttgcccatacctatgtcttgtgaacaaagatattcatattcttgaactagattacccgctagagttctgcatttgcaggactcccaatcaatggtagagaaatttccaggtttagatgttaagacggccagaaggttgagaccaaatagtatggatgatggtaatggggatccttccacctggggcctgtcataaagggcaaaaagatctcgcaggcgatgaattatttgataagccacaatcagttctatcaaccccccttgcatttgaagctgttggtcattgagatatacgtggccaacaattacggtcactgtccaaaaaaatccatctaacacttcacctactgactccatgtattcagttgatgttttgcttgactgaatgttcgaacttccagagtttgatgctgcaacctttatgtaattctctagagataccgataacatgggaataatcggaggtaaaagattttgtacaagaaaataagttcgattggctggaagcgagagcaacactctcaacagtcgtagtaggtagacagtgacttgacaagctccaggccttgaagtgtgagaggcaggtaaagcagatgcaataaaatcaagcaagccaacttgtctagatgcatgtaattcaagatcctttccttctaaatactgtgccaaaataaaaagaaagtggtattagtaaacatctttattacaacacaatatggaacaaacaagaagtacctttgtcatgtcactaacaatcaaaccaatactcgcagcaccctcttttctagcttgacgaagtctttgcaagtcctgaagccatctacttaacttagcttttgcagtacctagagcagacctgtgcacaattcctgtattttcgcctatgagtggttcaacaaaatcatgcttaagagccattaacctctggcgtatctttttaatccttcgtttcatttgcgtggaattgaatgatttaacaccagactcagcagcgttggcactgcttattatttgtgaatcttctccactattagctgagctagaacgattttggttatctttacttggaaagcggcgctgaaaaggtgaaggctgatccctgaaatccattgaagctctctcacgtatctgctcaaggtaatacttacggcgctgctcactttcacgaagcttctctgctaatttttgggctaacagttcagcctcttcttgttgagcttttgctcttatctcttttctacgttgctgctctgcagccctcgcttctcgtgcagcactagatgctttgcgctcctcttctcttctaataatagcttcttctttcttacgctgtatttcagcaagacgttgcatcttctcagcttcaagaatttttctccgttccaatacagcttcttcccttgcaatgtcctccttttgctttgttttgatcaccagtagcttttcagctctccgcatttcagaaccatgaagtttctgcctcagtaagaatttcttgttttcttcatttagtgatgtaataaaacggacctcattgaccttagtactctcatcaccagctctttttgcaacctgggcaaggtatgcctcatgacgagattcactacgttggtggcgtgcattcattacttctcgcagttttgagctgcgcacagcctgccattcattgacacgatttaacttttcagaggtacgttgcagcctctgaactctctcactttctagttgactccggattcgtaaagctcgtgcatgtttttcttctgcttcctttttcatgtccaaagcacttcttttcttcttttcaggagacattaacttgtcatgtagaacacgagcacgctctggtacttttctgccaacaccaggggaatgggagacacgagaactccgaacaggagatttcagtatatcttcccagtttcttttctctttccaggcatccaatgacttccgtggtgctgcattttgtttctccttctcagtatgaactgtagtcctttttgccgtatctgttgacctgagcttgtcaaatttgttttctggcaattccttatccttcctaaaattatgcttctctacctcagagataggttccagtgatccttttcgactctttgcagaagatgaaggcatattttgtggaggtgatctacctgacttgattgtatccttgctttgcctctctccagcaatttttttctcagtgtcagaaagtttcacctgactctccactttcaaacttatacttccaacagtcgctgatgctgtggttagctttgatgagctaccagaaacttctccagaagagctggatgcaaagctctctgttgttataccagcttgtttgcgagccagttccaattgaattctctgaaatgcctctagagatgaagacaatatctcttgcctgtgtggtgaacttgtcatccttctgacctgcatatatgatttaatcaaaaagggttttgttaactcttttagcactgtgagatactccccaagttgatttctagcattcaaaatttgtctaaaaaagggttgatttctaaccatccttggtccagaaatcgagaagtattaatgagtcttatctcttcaataccccttactacattcctattaatgaggggcacgtctttttccctactaatctgtcttggaattgctagtagaaatcaactcttttggagacgtagtagatttgcattccatgaaaagtgttttgtggcaattaaccaggttattttaacaactattaattcaataaagggtccaagtccagaaactcgtcatgatatatgtaatcgttcaattcttgataagtacataggcttgtggacagagaataatatgtgcacactatgagttgttcaatgatcataaaactacgctaaaacttggagcaattgaaatgaaattctgcatacaagtcatgtaagaaaatatttcataattttgcgtattatgagaatacggacctcccaagacaaggcatgtggtcttcgatggtcagctttcacagccattggcatcccctcctttggtagagcagtagattttttggtgttatcaaaatgctccgccctggatttcagttcttgaaaatcagatatagcttcttcaagaacaaggatggattcattaatttgctccatgtcacattctaactcacagaggaggtaaagttcatccacagccctattcagattctcaaaaagaaaacaccagagtctctgcctgaacctttctttgcttccagcagtttcacctccaaaatctgctgaagttggtgcatgaagaactgtctggctttctgttgaagcaacagaagacgacttaactggaacttcaagatcattgtttgcacaggacaaggagactgtgtcgtccaaggaaggtgaaccactaacatccaaacgattatctgttatttcacatatatccaataccttgctctcatcttcagtgggcgtttctgccccttgaataataacaggagatgtctcaacaattgttttacaagaattcggctcagttttaagttcactttcatctttacattcatttatgaattctgtagcatcgccaatgtgtatgtgtttttgagatgaactattatttctacatgcatctgcaggtaatgctagacctggcacttcatcaaaatcaccaaacctgacagaagtgttcgataaaacacctatactatctgtcattggagggcctttaacatgatcataaaaacctgaagattttgcaagaccacttgaacagttggaggattgatgtggagttggagaatcagcacagtcaatcttaccaacgttgggaggttcacttatttcttcagtcactagcagttttttaggtttttctattgcatgatccgaggctgaaacacttaattcactcttcagattgctagcatctgcatgagcacattcttcaccatgaacaaccattgtgactacgctacccggttcattaacgcaaacattaacctttgtgatctgaggtgagcattgtaacctgtcacaccactttgcactatcactgccaaagttggtctgagattgtgaggacgagtttgaaattttattatcattggaacctcctgaagacctctgcaatgtgaattttgagctggatcggtgtttctgttgaatagatttgtaataagttaggaacagaagcactaagagttcttctggcataatagagcatcaaatgagagcatgatccaagtctctgagcaaaatgcaaacaaaaaatataaaatgtttgatgaaatatggtattaacttgatgatccagaaaaaatgcttctgaaagagccaataatcttcaagcaacttagagctgtttacagggtataccttcgctatgtaagtctatgtgtgtgcaagatagtactggttaatagctatcatcctggacagaatggaatatggccaaaatatatcactgaatacatgcccttttgctatgcataaataacacagaaactcctaccacaacatctgtttggttcaatctaggtattcttctaacatttgatttataaacaggtgttaaattgattattatcactctcggccaagctattgcatctgtttatctagaaatgactgtcttgttgcatggatcaaactcacaccccttaaggccttaaccttgcatttaacaataaggcgattgtgggaacatattgttagagtttgtgtcgaatatatgtacaaagtcagttccagtttaggacttggaattgtaataggtgttaggactagagtaagagtcagactctatcctaggctctctcataaatagaggggcgtgcctattgtaaccgcatgacgacttagcatagcgagagggagcggctgccggcagcgaccagtcgtgagtcgttgtaactctgatacgctgtaatatgctggattggggaggagcgtccgtaatcagtgctccggagatgtaggctacggctgaactccgttatcaaatatcgtgtctcggtgtcatcatcatatttggatctcctatggtgttttcttccgcggtttggtttccgatgtgatttcggggccggttttataacacatataatggggaaaacaccacaatcattcgatgcattataattgaacagagagaactccttacttttttcacttcaagccaccctgatcccacatcatctagatctccatgatcattctccattaccaccaataaatcttcagtggttcctcatgcattcctgctttttcatacagatacggcagttaattataccaggaaatgtaccagctaaaatatttttttaagtgtacagtgtgctgagggattaaaaaaatcacagatttttcaagaaaacaactataatctataggtactgaaatcctcactaaaaccctgacacttaactgcaacataaaacatagcaaaatagtgcagaagattttgccaacgatgcatatccagacaaaataaataaataaatccaaaaccatcaaaggaattggacgaaatgtagacaaactaaaacgtggggctacttaagttccggatcccttcgcagctggtctccgaatttccaatctaaaattccaaaatgactcctgccactcaccgtcactggcattcactacaatcaaccaaggatcgaacaactaaaaaaagcaagaacattccattcctctcgtgctaacatgtcaacaacaaggttgttggttggaccaatttccggcgcaaatttgtacgatttgggggtaagaagagaggccccgctccctcccttctccctgcccatccatcccaattcccaatctacaccgcgcccgcctgcctcgcgcaaagtgggcggaggaggacgaataccttcaatccgatccgaaccgagacggaaggatgtcgtcggcggcgtcgcccctccagacctgcctgctcccccgacgcgcgcgcgaggaggccacgccgctcatgaggggaggatggccttccccgccgccgccgccgcccttctcgccgccggccgcgcgcgcgaggagtcggggagccacgtctccggctcgccgcagtttttttttttctttttttttcctttttttttcgttttagggaggctagtggagactgcgggttgggagagagtgagagaggcgtggggaagtcagggtgaggggcatttcggtcattttaggctgagggtgactggcttccaggtggcggatgacgaagacgaggcggtccagcgcggcgacggtgctccggcgaccggcggcggtgacgtgagggcggtagggaatccagaacctccgtagtaatgcaaaggtgcactcttcatgtggggagcacaataaatcaatgcgtgtgaacagtgtcaattcagtgtagcaaccgtaacgaaaacgttgtagaacactacagagtactgtagcatagttaccgtagtgcacgatttgatcttgatcggacggtctccattgctcctaatgctgagtatacctattcgggcagtgggagcgctcgatgatgttaggtcaagtgctactcgtgtcggcgaggattaggagcagtgtcacttcctcaaagttgatttgggttgggatttgattacgagctaaccggttccagctcacttacggtttgttagagcttagctccaacttcatctctcctaaagttagagcccatttatttcagctccaccataaaagaaaaaaatgaaacggttaagtgttctcacaaaatgaactggagaaatggagctggatttaggctgctccacaactccactttaaactgaactcttggtgttaaatctcgaaattgaagtactctcaaacatgctctcaatccaatcggatacactcccttggcatcaaaatacatgatttttaaaataaagaataaatattataaaaaacccctatgtctcaaggcgttcctatcacaaaactacatgttaagtacttcctctatttcaggttataaaactttctaacactgcccatattcatatagatattaatgaatctatgtgtcatctatatgaatatgggcaatgctaacaagtcttataacctgaaacagaggtagtaaattttatcatacgcacttccttgccccttccgcaaggacgaagtattgacaccgatatagcccatcccctccacttctctgtcatagccaaccgtgtaatacataacttcaatatctaagtattaaccagaactaaaatatgcaggataaaccttaaccaataggtttatctaggttttctaaaatatgactattttttactataaacttagataatatttttagttacaaatctagtagtaatagaaaggagtatataaatttttttacgggaggatggtataaccttcagcgaacaacacaaagaaggttagttagaggcaggactaaagttgcaatcatgttccttccgtgttttcatactcaaagtctcaaacccagcagttagcaacttccatttctaaacaatgcgctggtcagcaagaaaaaaaattacagatatccattgataaagaacacaggagcatcaaaaccaacaccgcttgatggcatggcatgtctgattgtctgtggccatttgcgaccagttgtacccaaccaacagccgctccaaagaatcaacagacgttggtcactgctcatccagagacaaacccctgttagtaatataaaaattgtttctttttctttttcttttttactccccaatcccccttcttcctccttgatccctttcttctccccatccctctttgccatggtttccgcatcttgagctgagcagagcacagcttgtacctgcagccagccatggtgaccaccaatttcgtgcagaaccaccaccttcagaacagccagttcttcctgctccccaagaggcagcttgtgacctacgccctctacgctctcatccctctcgccctcctccattaccttctcttcaaccctgtggccactgccaagaagccggtggtggtggtggttcaggcgacagacgatgcttcggtcatcgcctcgtctcatcacgagcatgtcaaggtgaatgccaagcagctgcctgtgcccccttctgaccaaggagatgaagggttcaagaagaatgcgataggtgagatattgggatctcttgtcgatttcgagtacctaggatttttttttccatgatgagatttgtctgccccgattggttttctccatttcttgatgtttttggattatcggattctgggcattagatttgtgatgtttcttgtgcagattttagcatgtatgaacagatttgagttcttggggatttaattgggggagggaagggcatccttttgggctaatctttgcatcttgtgttggatccgagcagccggagaagtggcggcggcggcggcgtgcgactactccgacggcgagtgggtgccggacgcgcggccgcctctctacaacgggacgagctgcgccacgatcaaggatgggcagaactgcatggcgcacggccggccggacaccggctacctccactggcggtggcggccgcggcggtgcgacctcccggcgttctcgccggaggcgttcctcggctggctccgcggcaagcacctcgcgttcgtcggcgactcgctggcgcgcaaccaggcggagtcgctggtgtgcctcctggcgtcccgctccacgccggagctcgtgcaccgcgacggcgaggagaacaggttccggcggtgggcgttccgggagcacgacgccaccgtgtccatcttctggtcgccgttcctcgtcaaggccgcggagaaggcggagcgcgccggcgtgcggcacaacaacgtgttcctggacgcgttcgacgagcggtggatgtccgggctggggggcctcgacgccgtcgtgctctccatcgggcactggttcctgatcccgggcatctaccacgacgccggcgaggtcgtcggctgccacgactgcgccgagttcaaccacaccgagacccccttcttcgccgtgttcaggcaggcggtccaccggacgctcgccgagatcacccggcgccacgtcctcgccgccggcgcgggcacgagcaagagcaagagcaaggtggtggcgttcacgacgttctcgccggcgcacttcgagggggagtgggacaaggccggcgcgtgcaacaagacgcggccgtacaagaacggcgagaaggaggccgggtacacggaggcggagatgcgcaagaccgtcgtggaagaggtcgccgccgccgacgccgccgcggccggcggcggcggcgcgggcctgcggttcgcggcgctggacgtgacgacgctggccaacctgcggcccgacgggcacccgggcccgtacatgcgcggcgacccgttcgccggcggcggcggcggcgcgcgggtgcagaacgactgcgtgcactggtgcctccccggcgccatcgacacgttcaacgagattctgctccagaccatcaccagatgacgacgttgataagatgaatcgtttcgtctcgtttacgagatcatacgagtagatagtgcgaattccgcggtaaaaatggtttggtttagatctcagtgatttttgggtgtcgcctttgatgtagctgtaattgttagagcatatacaatagcaggctataagtccgttataaacataagtccgttataaacatattttaaagagatatatgaaaagataggagagcagcgggctacagatctgtagccagctgcagcatgggaattggctattacattggttatagatgatttggagttagtagtgtgctatactattaaacttgctctaaactgctccattttaaatctgaactactcccactgaactgaactgtactactgtcatcaatacaacgggattacgggatcgtcggtggcgtttgatcttacgatcacgtgtgaacaaatcgtgcatttgatttttcgtggacactgctactcgatcacttgcttgatttgaaaataaatgcagacgttcatgagccgtgtacatcgtctatcattttaaaaaataaataattagtcctaaatatgagcatcaggattaagtacaggactttgcgttcacatgttgatcctgatctggtgtgcaagtagcagtcaggcaagtagcagtcaggtttcccaaaccgccgggtctggggttaccgcgccccgacggtaagcgtggtaaccgtaaaaaaccgtacaaaatcgtgtaaaatttatcaaaaattcaaattattttttaaatttatttaaatttaagaagattaccgcggtatttatattaccatacctccgcggtaagaccggtaaccgcacggtaacgtcaaccctggtagcagtcaatctaccatacaatctggttggtgtgtcgcaagtgggctgtcggctccgtggatctgtctgtgcttagcctccggcggaagttgtgccttgattgtctctgcttcttagacaagagtggtggccactttgacctttgagtgtgttgtttgctgtccctttgatacccactcgatagcagcagcaggccagcagccagcagcatatctgcatatggcgtcgagaacaattggctcgtcttccggcgagggagtaccatgcaggccggccggagcggtgaaccgggaaatttccggcctccgacactagggcggcggtgaggccagccatgccgtctcgcctcgcctcgccgcgtcatggtcacggcacgaacgatggcgtcggctgccgtacgtgtgccacgacgtgctgggctgctggcatggtatggtaagggtctctttaaatcatttaaatcatatgaatgaaataaaaaacatgattatagaaatgcaaatgtaaaacagagaattacaaaacacaagaaaaacatacgaataattgtttgattgggtcgcaggaaacacgcagtgagagatagactcaaaggatttttctaagaggttggacctcttactaaattttctccaaaatctacgtgcaatgagctattccataggatttgtataggatttggaaaactccaaccctttgaatcaaatagccaaatagaaaaatttcttataggatttcaatcctatgaaggttaattcaggacgtcttgtttcatggttgttttggaccaccgaaaacaacatggttttcagagacaaaatggtttactctccactgatcctgcctttccaaatcattttctttttgttgcagtgaaaagcctatgtcgttctgaggagacttttgctgatggagacgatgactgagaagttaaaagtgacaacaagtgctcttggtgctcagagaaccggtgttggatgatgatatgccttgttttagcttgtcatagtatcttttgtcggtgacttttttctgctcatggccttttgtgtgttggctgttagtctcactgtaatagatgtgtgtttgagcctttgatatgtaaaatgggtatccccgtaaggccataaacttgtttcgacattttgctttcaatataagcagggctgtgaggccttttctttaaaaaaaaatttcaggatgtcccacttgttttacttcttttcatcaaaatggcacaattatattaggtttattcagcagatgctgacaaattgggccaccatttgagtaggaacttaaaagtcttatacgatgatcaaacaatccaaatgacccaaaattatacggttggaccttaagtgggaccctgagttgggcaaatcaagttattgagattcgaatttgctacatactaacagtcatgtgactgtttttctttttccaagacctgtggaaaacaatcctttcggcatcaaacactccaaagaaaccactcaagtcgttggtgatattctagttgcctgggagatttggaaaaaaaaaaactcgcgcctgtttagaagcctagcaaacacccctgagaccatcgtttacgcatcgtatgggttggttttgttataaaaaatatatcaaatgaatataattataatgtgattacactataattacaatattattatattataaccatacttagtgtgatttttactcgagtgatatagttagtccaattgagacttgatgtgccactattagatttgtgcagccagacacgattatggtaggaaagaaggtgttacaaataaagttgcttaaaaattttggctaaagaacaagaaatacacatgaaatccattaaagttgtgcctttgagagagtgcacgaccacttaagatcttgccaatgcgctcagagtaaagaatatcacacctcataagcattttaaggaagataaatttcgtcattgcattgacttttataaagtttgcattgactaatgagaactagaaggctccatgttgagtacggaagaagctcctctaacatgctgatcagtcacttaaaattagagaacatcaagtccgaggatttgtttccgttgagtactgcttgtccatgttcataccgaattcgctacttacaatttacaaattagtgtacaacgttgtgtgcccgtgtcactaacgccagccccaccggccagctccagcgttgtgcctctccgctccatcattggagtatatgcaaacgacaaacgttcttaggttgtgctcgaaggtagaggttgagaactccacctcatcacatgtaaaaggagtgatttgttagtacataattaattaattattaactaaaataagtttgaaaaatggattaatacatttttcttaaaagtaattttcctagatatagaactcttgcaaaagacacactgtttaacagtgtgtgaaaaataagagagtagaagttggaaaaaggagtggccaaacacaaccttagacattaatatggggacgaccgacattaaagttattaggtgatgataaaataaggatggaagaagtatcatgatctttaaagattggtactttataaaaaagtgacattgcacattataccaccaaaataagtctaatacataattaatataataaaaaagtcatctccacttcaaactgccgcaatagtttttcttgttttaaacagtcaactaccgtagaaatgatgggtagtaaaaggacccagaggagaggccgatggatcaaatttgaggattattagccctaacatttatgagtctactaatttaagagaaatttgagaataaaatgtttacttttctcatagagtttctatgtattttagttgattagaggtgacacatggtgatttaaaagctggtgatttaaaagcgttccacaagatgttcaatgggctttctttttttatgttacgtttgtatcttatgtagttcatctatctctaagagttttagctaggtacgtaaagagagattagccagatgttaaaatattatcatgccctccattaatatggagagaaaatatcgaggagaagaagcgagtactgctcgtttaatttgatgattaagaataaatgataaagtagtattaaaggggtctagtggattcctctaaaattcatgtttagtaaattaattattagcctacaactaacggtgggaatatgttttttcctacttagtttttttttcttttgtgaatagtacgtacgtacgtgtttttctgttgtacgtccacgtactggaaaggagggattatcttttataatagatttataatttaatggtttaaaaaaaggttcaccgatttaagtgtatataaaggctaagatgttctgatttaaaaaaaaagaatttctaagctttttcataatttattaggatgacgtagtgactcaagggcatttcagaggatatttgatagacattttatcataccgtatatatgtatatatatttatagactatatattagcttacatgtgtatatatattcatatgtgctccctccaatttaaaatataagcatttctactatttttttaaaaaatatttatacgtattttttaaggcttctctctcttttttttcctctcgcgaatagtacatatacgcactgcacttttctccagtaagtcacgtacatgagatatctcgtaagtacacatacatgagatcaggagactttttaaaatgatataatggtccaaaataatggtttcactgattttaggtgaaaacctagagctaaaaattttacatctaatagaattttaatcttttattttaattcatttaatgtgacacgtggcgacttaaaatgcttcagagaatgtttaatgaaccattttcaaccgttcatatgtaatctctcttttataagattatcatttctgcatgtttttttgaatgcatatggacatccctccgtcaacatatattttaagaaacaagagaaaatgattatattttagaatgaaagtggcttttcttttgcatttctttctctctttttcaggcaaacagtacgcgtgtatttttcttttgtaatcatacgtactgaagataagggagagattatttttaaaataaaatctgatagtctaaaataacgtatcatcaatttaagtgaaaaatcatgagctatatattttgtttttttctcatttaatttctaatcttttttctaatctattagaggtgacacactgtgagttaagagtgttccgtttagtggaattttagtatacaaccgaaaaaaatagaaagatggatgatagataatgatatgattattgcttcacacaaaccagtggattagatttgacacaaatattagggatactttggccactcgaaatcgttactgtacttcaatcagccagtttaatcacttcctctctacttcagatgttaatcccctttatgttcgattaagcaataatgctgtgctttccaggttacactccatccatctcctctctacatgtagtacaaactatctgaagtcaccactcccacctgttcgacgccgtacgacgtcgtcgtcctcgtcgtacgcgctagctatggccgcgcgcgagccaccgcgtcaaggccatggcgccacccggctgtcgtgcccaactccggcgaccaccaccaccaccaccaccagcaacctttgcagcttcctcaacagagccatctccgcttggctcgtctgcgccgtgctcagcttgtttctcttcaacctcctctggttttaccctgtcgacgcgccgtggaacgtcgtcatttccggcgaaggtaagcgtccatccatggcgatggcaggaggaggaggggaggaggctaggtgcgactactcggaagggcggtgggtgccggcgccggggcgcgcgcggcggtacaacggcacggcgtgcaacgtgaaggagagcgagcggtgcgtcgggaacgggcggccggacacgggctacctggactggcggtggcagccggcgtcgtgcgagctcccggcgttcgacgtggcggcgttcgtgggcgcggcgcgcgggaagcacgtcgcgttcgtcggcgactcgatggcgcgcaaccaggcggagtcgctcgtctgcctcctcgccacggcgttcccgtacaccctcgtgtaccgcgacccgcacccgcgggagcgcaagttctggcgctgggcgttcccggcgcacaacgtgacggtgtccgtctactgggcgccgttcctcgccaggtccaccggcaagacggacgactaccggaagccgcgcaacgacgtctacctcggcgcgctcgccgagcggtggtcggccgacgccgacacgatggacgtggtggtgatcagccaggggcactggttctggatcccgaccgtctaccacgacgccgccacgggcgaggtggttggcatgcacaacgtcaccgggctcaagaacaccggcgacatcggcctcttcgcgccgtacaggaggactctgcggatggcgctggagcggctcgtcagctccggcgccggcaaccgcacccgcgcccgcaccgtggtggtggccacgttctcgccgtcgcacttcgagaaggcgtgggacgaccccacgacgtgcgcgaggacgcggccgtacgacgacggggagaaggaggtggacgccgacgagagggagctccggagcatcgccatggaggaggtggccgccgccgccgctcgccgtggcgccgccgctggcggcggcgagagcagggtggaggtgctcgacgtgacgaagctggcgacgatgcggccggacgggcacccgggggtgtacatgcaccgcgacccgttcgcgcgcggcgtgccgaagcggctgcaggtggactgcctccacttctgcctgcctgggccggtggacacgttcaacgagatcttgctgcagctactgatcagcaagaggcggtgacgataaaccggagtactagcgtgtgcgtgcatgcaaggcaaatatgaacaactaacttgagatttgagatacaagtctgatgatattaagttccatttgtattacaaagttatgtacatgtaaactatgtttcaaacttatgccacggcaatcaaaaccgatctcaatattatattaggagttgagaatacatttgtactggttttaaaagatgagggttacgttgtatccgttgttttacggttgagcaacatgattgcaaactcaaccattatgttattaggaatgtaaagtggactttttcccttaaacttaaggtatattctctgccagaaatacactttttcggcccaaaagtagggtgtcaatccgtaccaaaatgcggtcgtgaaatgcgcgtgagttgagcccacaggccacagatggtcgtgaatttggtccaaagcttagcctgaattcagccctacgttcttctaaattcagcccaaaagtgtgagcgatctcagctctcaactgtgcacgcgaatgcggcccaaagatccgcgtaaattaagcccaaacgttcggcgggttggaccatatttgaggccgagaaatgtgcgaaaattcggcttttaagtatggaaattccggcccagtgggcgttaattcagcctatatctttaaggaaatttagcccacgtgaaaagaacgaagtatgtgcgccagtccgccagatatcatcatcgcaagtgggccgacatgtcattgggctgaggcctttatttctgcccattgagcgtggaacatgtcccagctaaaattcttcactacttcaaacgtacactaggtgaaaccccacgtgttgctgtgagagttttgtatagtattaataaaaataacatgcaacatagatacattatgtacacttttcatctttgatcaactattgagaaaaaaactataaacaattaagataatatggattatgaaaattaaaatcatatgtggattgatcattcaaaaacaaaagtaaggtaacgtggcttcatgagagaggaaaaaaagaacgtaatatagatcaattatttaaagagaaaactaaggcgatatgattttataagagaaaaaaggaggaggataatttagaccataaatcaatcatgtaaggaaggaataattgagatgatgtgacttaatgatagaagagaaaaaataacattaactatatatagtggtgataaactatatagatattcgctcagtttcatattataagttgtttgatttttttcttagtcaaaatatctttatgtttgaccaagtttatagaaaaataatagcaattgctacaataccaaattactttcattaaatttaactttgaatatattttgataatgtatttgttttatattaaaaatattagtagagtttttttataaactttgtcaaattcaaataagtttgattaagaaaaaagtcaaatggcttacaatataaacgaatggagtatataggatacgcggcttaagattctaagaatctagttgatagccagtttctgagaatctgaagtgaggtttattttttagattttataactaagtttaaaatttggatgataatctggattgcttgagggagctgaagtttatgcgagaaacttcggctgctaaaagctctttcaaacaggtcttgttgcaggaatcttgcggcgtggtggtagtaacagcgagtcagaagtcagaacttcttcgcaggacacagatttaacactgcatcaccattggtgctcgctaacatggagatctgcaaacccgttagtttttgcgcagcacaatcgatgcagcccccatttgcgaggcaagttcgatggaaatgccgttgaaaatggaacagatatgcccacttgcagatatagaacagtattgtcctccaaatctcgagaccgtaattcagattcagttaatgacgcgattgacggcatggcctcgatctacagcaaaactcttcttcctctctctcactctctgttgcggtcttttcttttgtgtgtgtaactgagttctatcacttttgaaacgatttaacacttctgcgatatggtttagtattatagttaaaatctcgattgcatgattttacatttctaacttgtaactaaggtacccaactctacgattccatacggtaaaaatgagtaaattgtatcaccagtacacaaacttgtcaggtgggtgtaatctagtgcacgaatttgtaaaatgctcattttagtgtatgaacttgtctggtgcgtgcggaggaatgtgaaaaggttactacatggctagtcttattgatttaggggctaattaggatactatgtaaatagagtaaattgtattggtggtacacaaacttattagctaggtgcaatttagtatataaacttgtaaaatactcgtttcggtacacaaacttgtctagtttgtgcggacgagaaccaaaataacttggcaatgttaattttacgaagctgatgttaggatgtgacgtgcatacatgtagtgagtatgcataagaaatgcaatatttataaatttaatctctagtttatccttcatcatggaaatgatgaatttcatatatttctaacacttatattgctcagtttttttctttatctttatctttttctactatcactatattctattaattttttattgaataggtgtatgcctgatagcaaccttctcatatatatatttacatagtatcctaattagcccctaaatcaataagactagccatgtagtatccttttcacattcctccgcacgcaccagataagttcgtgcactaaaatgagcattttacaagttcgtgcactagattgcacccacctgacaagttcgtgtaccggtgatgcaatttacttcggtaaaaaactataattttataaatttcactagaaaaaaatatcagtgctttgtaaagggtgaagctattttaatattattattgttatacagtttagctaaggtaaaattcattgtgggaattcgtttcaattttctttttataaaatcattagctgcaattagaagttcaatcatctcaagttatcatgcgagtttttttaaaaagagatttcttatatgacttcttctatattttcgaaagcgaacgaatttaaaaacagctcaaacatgaataggtatttccaaaagcgaatgaacttaaaaccgactctaacttgaattacgtaccaaagtaccggcaaaacatcttcaatttttataatattagatagtagagatagatatagagataaagatagaaatatagatagagacagagatgtataggattctatagttgcgattctacttagaatttccaattctaatttagcatcgtgatttcgaattctagttcaggattgtgattttaataatcttggtttaatattttttaaatcacactttagtcattttgagtcattttgaaactttctactacgcccgtcccaataaaaatcaatgaccgaatgagacgattattatattttggaatggagggaatatcatttttacatctttttttcctgtgtggcctgtcaaataaatgggaaagtaatttcatcccttgaggggatatcccctcgttttgtgcatgccacctaaatagtcgtaaaaaaatatgaaaaaaaatgacaacatagattaatatgaaatgtatcacttcacaaacatgcaagtttaaattcaacttatacaagttgtaacaaaaataacaaatatagttgtggatgcgcgataactattttcagtttaatttttatttttgttgcaacttgtagaagttgaatttggtcttgcatgtttgtggagtgatatattttggattaatatagtcaattttttaaattttttgataactatttagatgacatgtaaacaacgagaggaaaatccacatcccaaataaataaatactacaactatattactcctctcacaaagtgtaatttgggttgttttctcaaatcctatgcacaaatcccaaacaacagaatatatttgagttgttttcacgtcacgctccgttgacattttttgggtttgagctcttcttcttcgacaatcatttcatttctacatagacctatcagaactcataacacagaacccccctggtaacatcgtcatccactcatcctcaccgattccgacgtacggatcgccgccgccgtcgtagctgcaccggcggcaaatgggagcgtacgacgagccgccactgcgtcaccaccacggcggcgtgcaacccatcagagacatcttcacgtcgctcatctacgtcgcgctctgcttggccctcctctacctcctctgcctcacccctcgcggctcgccggagaacgccgtctcggctctgctccggcacgtcaccattgcttcttccggcgaaggtcgtggtaagctaagcgcccatccatggatgcgcgtgatcgcgtcgtttcagtgtaatcttgagttgatctcgtgtgtttgtgttgttgcaggaggaggaggcggcggcggcgggtgcgactactcggaggggcggtgggtggcggcggcggggcacgcgcggcggtacaacggcacggcgtgcgacgtcaagggcagcgaggactgcgcgcgcaacgggcggccggacacggggtacctggactggcggtggcggccggcgtcgtgcgagctcccggcgttcgacgcggcggcgttcctcgccgcggcgcgcggcaggcacgtcgcgttcgtcggcgactcgatggcgcgcaaccaggcggagtccctcgtctgcctcctcgccgcggcggcgttcccgtaccgcctcgtgtaccgcgaccgggagcccgggacgcgcaagttctggaggtgggcgttcccgacgcacggcgtcacggtgtccgtctactgggcgccgttcctcgccatggccgccgggaggccggagaactttagcgtgcagcacaacctcgtctacctcgacacgctcgccgagcggtggtccgccgacgccgacacgatggacgtggcggtgatcagcacggggcactggttctggaacccgaccgtctactaccaccacaacggcggcgaggtgctcggcgtgcacaacctcccggagctcaaccacaccgagatcggattcttctcgccgtaccgcgaggccatccggatgtcgctcgagcgcctcctcggcttagccgccgccggccgccgcggccgcaccgtggtggtgaccacgttctcgccggcgcacttcgagaaggagtgggacgaccccgcgacgtgcgcgaggacgcggccgtacgaggacggggagaaggaggtgggaggcatcgagggggagctccggagcatcgccatcgaggaggcggcgggggcggcggcggcggcggcggcggcggcgaggagcagggtggaggtgctcgacgtgacgaggctggcgacgatgcggccggacgggcacccgggggtgtacatgcaccgcgacccgttcgcgcgcggcgtgccggagcggctgcagagcgactgcctccacttctgcttgcccgggccggtggacacgttcaatgagatcttgctgcagctactgatcaagaagaagcagcagtgaacaacaccggtatcgtacaagtacaagtgacatatgcgttgcgtacttgcgtgcatgcatgcacgcacgcacgacaatataacaacttgacgaatttcctagacattttttatactcttaagggatacaagttggaagctgcatgcgttggtagatactaagagcttctccaatagactatttaaatcagactctccaaacacatatataaccaactttctaattgatttagcaagccaaatttgttgcttacttcaacaaactctgatccatctacgtaccctctttattttgagtctatgacattgagaccccaaatgttagcctctactatactcttcctcatcctctttctccccctcttcctcactacaccacaacaccaaataggaggcacttgatatatcgggataaacaacttttagtagcaagcagtctgtcgggaaagacttttgccaacactttgtctgttaggtgagtccgagtcccccttcctcctcatggtgtcttgctccatttaccctgatgagacttcggtgagttggagccccatatctcccccgtgagttgacaacgtccctttcatcctcgccgacatgccttgcatctcgttccaagcaacgacgaaaagccaacacaccttcctcctcagatccggactacattaggagataatgggacttcttttttggggggagctaatgcaatttagttgacatttgaggagttggtactaaagtttttcaaattttagttgaaagttttatgattttgagttgaaagtttcaaattttgaatcaaaagtttgtgatttcaagttgtaagtttaagatttcgaatcaattgtttttgtgattttgagttaaaaagttgtttgtggttttgagttgaaagttttaagattttggaccataagtttatgattctaatttgaaagttttagactttgaatcttgcgtttttgtgatctgagttgaaagtttaaagtcacaagtggaaggttttggaaattggaagtaaaagttttggtaagattatctttaggaatatagagctaggggtatgcgtcgacacttcaaatgctcttggcatgcacacgctctattcatggaaagggcagcgaaattggtctgacttccctaacgcatgcctgacctatcctgctggtgcataccccctccgtcctaaaaataatacaatcctagctacaaaacatatgcatgtccagatttgtaactagggtttatcattttttggaacggagtagtatgtgcgatctaggcgcctccgaaattgggtaacctgtttttaattgctagtttatttttttagtaaattacagcgatggtatataaacttttgaggtgggtatagtttggtataaaaacatgtaaaacacttgtttcggtggatgcattttgtctggtgcgtgtgaaccttaggccaaatgagcatgccatgccatggttaatcctacttagtttgaatgtttattaagatgtcgtgtaggcatacatattagcatgctgtcatctagacgtgcatatgttcaatcaaatgtataataagaggcactgataattgatgttttaaataagaacatatttttagagaaataactttaaccactatgttctgttacatataatagaattatcaacaaatatataatttttgtttacacccaaatttagtacctttgcacgaaatagggaaaaattgctaaagtttggaaagcaccggattttcttcacatggccagtcagaccgcaggtgtgttgtcggtctgactagctagtaggaccggtttgaccgcaggcatgtggctggtcagtccgtcagagttcgagcccgaagcgaatttcgtcaggtctcgggtttccttactcgggaaggtatgttttgggttttcattggtttctaccctgagttgaacatggaggagcacctgtaaaaggcaagaccaacccttatataagggacaaggccggttcaattgaatcacacaatctactttcaaccaattagccaattgaattgctttttcaatattgcatctacttttcgcttagttctagcctagtttcgtccatctttgttggtttgcaccgtgaaccgttcgccgtcactgcgagagtgcaataccgctttgtaggtttgtcccgtaaaccttctgttcgcccacgagacgggtggttatcctttgttccacctagattagatccgctagccggtctagtttgcaaaacacatcttgatttcgaaaggctaatgggcgatcgattgcccctagcgatcacccccctcctccacgtggtttctttttttggcaccgcattactttcctattttagtaaatttatgcatctatagtttgtacacctcaaatttacacatctaaattttatacacctaaagtttagagacccaaagtttataagtcaaaagtttatatgtctgattcaaatttgaatctgaattcaaatattttatatatatagtatttctatacatctaaagtttatacacctaaagtttggagacccaaagtttataagtcaaaagtttatatacccgattcaaatttgaatttgaattcaaatattttttatatatagtatttctatacatctaaaaattatacacctaaaatttatagacccaaaatttataagtcaaaagtttacatacccgattcaaatttgaatttgaattcaaatattagtttatagacccaaagtttataagtcaaaagtttacatactcgtttcaaatttaaatttgaattcaaatattttttatatatagtatttccatacataattttttctaactttgttttctttttttaaaatttatggtgtaaaagtaggaagagaagaagggggggaggaagccaggaagggggagaggagcgtataggggggatggcgggtgatcgctgtgggagatcacccgcccattagccacgccatcttgatttagccttttggctagatcggagtggttggcgactccatatcaccgtaagacgtttaggtatcccgatcatggttgtcttcttgccaaaaaaaagttgtcaacaattttgttgaagtactttttgagattaatctataaatatggagaccatgattataagtcaaatactacccccttttcaactgtaaatctttttgacttgttttttcaagtaaaactttttttagatttaactaagtttataaaaaaatatagtaatattttcaacacaaaacaaacaaaaaatattaaaatatgttcaacgttagatgaaataaaataaaattggtgctataagtgttactttctccgtttcatattataagtcattttgatttttttagtcaaatttctttacatttgattaagtttatagaataatataataacacttctaacataaaataaaatagattatcaaaatatatattcaatactagatttaatgaaactaatttggtgtttaaaatattactaattttttctataaacttagtcaaacttaacaaaatttgattaggaacagagtcaaaacgacttataatatgaaacagagggagtactatattttctataaattttgttaaactttcgagaaatttgatgggaaactattctaatccctcgaggggatgttccctcgtttgctcaaaaaccatctaaatggttatgaaaaattctggaaaaatttgacaacattcatacaacacatatatacaactccacaaaatcttaagtccaaactcaactcacacgtcgagatataaaaaagacaaattcagcgtatgaatagtagcgtactgtttatatctaaatttgtcttttttatttctcaatgtgtagatcgaatttgaacatgaattttggtggactagtaggtatcattatactgtacattgtcaattttttttcagaatttttcacaactatttgtatcgaatttagaagaaaaaggtatacgaggggatatcccctcgagggattagaatccactcccaaatttgactttaagaacggaagaagtattttagaagttatttataatattttttgaaaaaaaaataacatcagtttattaaaaacaataattattttaaccggaggctataagtactttgaccaagttggcaagttgaattcgtaccgcttgtggatggtcatgccctctgccatttgctgcatcgatccgcaccttcctcaattagatgccctgaggtgtagtacgagaaatagcaaagaaaatgacctcgaggtcaacccatctccattgtcgacgcacccatgcacattttcccctatcagtgtcagaatccctctatatagtaccagtactcgatactctactcactcactaaccaaaaccctcactgctcgatccccaagctcgagatgggagcttaccagccgctgcagcatcaccatggcggcgccgccgccggctacttcctgccaagaaccgccgtgacatggctcgccgccgcctgcctctcccttgccctcctccacctcctctgctgctcccctcccggcggccaccaagccgtcttctcccctctgctccagtatttcaatggcaatggcacttactcctccaacatctcgtcttctgggtatgtacaagctaagcttggatggatgagcgagcgatcgggcgagctagctagctcatcaatggcggtgttcgttgtcgttattgttgttgcagggtggaggagaggtcgtcggcggcggcgtcgtgcgactactcggtggggaggtgggtgcgggcgccggggcacgcgcggcggtacaacggcacggcgtgcaacgtcaagccggagcaggactgcgtcggcaacgggcgccccgagacggggtacctggactggcggtggcagccggcgtcgtgcgagctcccggcgttcgacgcggcggcgttcctcgccgcggcgcgcgggaggcacgtcgcgttcgtgggcgactcgatggcgcgcaaccaggcggaatccctccactgcctcctcgccgccgcgttcccgcacgagctcgtggcccaggacgccgagcgctacaagcggcagttcacgcggtggtcgttcccgtcgcacggcgtgacgctgtccacctactgggcgccgttcctcgtcaggtccggcggcaagccgttcaactacaccatgccctacaacctcgtctacctcgacgagctcggcaaccggtgggacgccgacgccgggacgatggacgtggtggtcctcaccgccggccactggttctggaaccc

SEQ ID NO: 71604 - DNA, 656 bp, Oryza sativa
tcctgcacccctttgagagtttgcgctccgcccgcataaaactaaaccccgataagtgtgtgttcggtgtacctgcgggcaagcttctcgggttcttggtctctgcccgaggcattgaggccaaccccgagaagatacgggctatagagcggatgcgccccccacaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcatgtctaagctctccccagttctggtcgccccggagccagacgagcccttgttactctacttagcggcgaccccgcaagtagttagtgcggcattggttgtggagcgcgatgaggacaattctcatttcacgcctccccaccctgtgccgacttggcccgggagagagcagggaggagaggctcccgagccgaacggtggtccaaaaggggggggggcccccccccccccgtaacccggaaacccccccgggggggcaagtggccctctgccgcttgtcagacggtgctaggagcccccgacccccaggaaggcccctgagggccactgt

SEQ ID NO: 71605 - DNA, 37527 bp, Oryza sativa
ccgcacacgaaaataggtgcccaccatttaatccggccgcgcgcccattcctccctctcccatctcctccctcctcccatctccatctccctctccccctcctcccaagctgcccggatctggcgggcgggagcagcgggctcggcgaccgagagcggcgtgcgcacggcggcgagctcggcggcggcaggcgacgacgatggcagtggcggcaccggtctcccagcgtctggatccgtcgccggcgatcgcggggcgatggctggattatggttagggttttggttttttctctttttttgattttttattttaccgtgcggcgtgcgagcacggaaaaatcatgattttcgtagacgttgggttccagacgagcgaaactactgcacgtgaaaatgagtttgcaacacacggaaagatcgttgttgtagtagtggcagccatgcatcgatcactgctataaaatcgatttttgtatgtcctagctaggtttttctttgcacatacagccgaaatgtgtttagctaaatagttagcctcgccttaggtttgtagatcatatgtacttcctccgtttcataatgtaagttattgtagcattttccacattcatattgatgttaatgaatctagacagattcattaacatcaatatgaatgtggaaaatgatagaatgatttatagtatgaaacggaggaagtaaaatatatttctgttaacggtctctaaaggaaccacttgtaagaataaattagtgcagacagtttgttagtaaatccgtgtgtcaaaacctttgtttctttattctttaacaaaaatacctaaacaatatcatagaaaattttcgactgagatgaaccaaggcgttcatctaaaatccttataatacctcctttaatatgaccaggtcaataattcctcagaatattttctttaacatgacataaatgaacgatcgtgacagtggcgtatttgtatatatgtatatgggtatggcacacatgtgtgtatacatgtaatcacatgattgcgaaagaacatgcagtctagtatttgtaatgaactaagcagcacttcaagagtgctgagtttaaatctttataagagcgaattttagattagattatttgaggggctaagttttctatttaaatcagtggcggatcttctcttgtggcaagggatggcaccggccatacctatgccatgcccaaaatagatagggtatttaagcatatggccatctcagccttgattacatatgctaattatgtgattagttagctgtattttaattggtacaagcttattcgtctaattaactggaggtaaagacctatagtgggactgccttgtgtctgcacaaatgaatgaatagtctagctaacaatcggtaaaaatcaaatgctaaataatagtgaatgtctacttgttatgaataaacacacctaaaaaacaggggaacactcgtggaaatgtagtttagtcgtaaaagttatacggcgaatttaagggcatcagttgtaaaaactgcataacaaatttaagattataatcattgtttgttattcgacgaatttaaagtgtcagttgtaaaaattgcatcacaaatttaggattataatcatcgttaatagcatatattctaataaatgcgaacatatattatagtttgtgtataataaaatgctacttcatttttaaaatattcgttctggtgtgatgatccgccatagctaaatttttatgctgtgtccgccactgatttaaatggctgcataatctagttggatataaaggccgggtaaaaatacatttttaaaaaaattaatcacatgattaagcgtactaccggtggctcctccggtgatttttcacggttgcacatgcttgcagatccactgacacgccgcacataatgcaacgaccagctagctatagccggcgtcatgctactatacaagcattaatatgttatagtacaaatactgtacatatatgtagcggaccagaagaataatggtcctatatatcctgtaccatacgacgactttcagctaagatcgatatctctacgacattatatttaccaacttggttaagaaaaaatcacttttaatcatcgatcactatacctagctagactagcttgtccgaggtgagcatgaattgagacgagagctagcctagaccgtagtctaatggtctaattaagacgctagacttgtccgtctagacagttaaagacgatcctaaactgtcaatatcacacatttaaataacaataagatgagcctaaaccataaaattatcgtttaaactatgatccaagcaacactaatgtattttttgtgagagaggagctaaaacttcgtgtcccacccaaggtccatattgcttaaggttttgacaccattacaaacccctctgctctgcacgaaaccttgcgttgccatgaagttgcaatgggaagagagaaggaagaaaatggagaaggaaggaaatgaatgaaaaacatgaccctagcatggttccaaatttgtaaaatccagtgacacaattataaatagacaaattataatgatatttatctaaatagacatatttacaatggcacgaatccaatttacactaaaatttagtagtggtttctattattttggatctcctgaagaccaaactaaaatgaccaaaaccgatgggttttcattatcatgcaatgcattttgaactttattatatttctagcgaaccgaaatatattgttttggtttgaccgaacgcccacccaaaatcgtgccttcatgactgaaatcaaaacttttaagtaaaataagagcgaaggcaatatatttttgtattgacatatacaggcatgaagccgttgcagtatttgactggaggggtcaaacctgcatatatatgggcccggatgggcagccactcgaccagccagtacagtagtactaccgcacctactcataaaagaccaaaacatgtaggagtaaaaagctggatccctggcctatccgctcatgccgtgcagcaggcagtgctgtatatgcaatcaggccaggacatggcccatcatatctcctacgaatgtgacttatatgtgcgtgatatatatgcaccagatctatgatccatctggctagccaaacatgcatggcccatatctgcatcttgcctttaatagttcagtataatactaccttcatcctagaatagatattttgggtgtgattagttcacgccaaaattaaaagtttggttgaaattagaacgatgtgatgaaaaagttagaagtttatgtgtgtaggaaagttttgatgtgatggaaaagttggaagtttgaagaaaaggtttggaactaaacaaggcctttgaaggaatgagacatatactagtactacaaatttaaacataaagattgtctagattcatactactagaatgtgtactatccatttaaatctcttatattctaggataaagggattagtcgctaaaagtaaaataatattatatagatacccactttgtttcatgacattatattgttttactttgactactcctgtttcatgaatatttttttaaaagaaacatggcacaaacgtaaacgcttacagcaaacacacactcacccttaaaaacacactcacacataccatacctctataagcacctcctaaaaactaggctggcatatcttaaattgagtaagccatcacgaggcaactcacccctaagaacttacacacgcacaccctatcctataagcacattcaaaaaattgtttcagcatatcttaaaattgatgaactcaccacggatggcacgctgtcgaatgatacattacctactattgaaagaacaattagtcatacacccgtgtcatttctaggatttaaacccaggtgaataggattctagctaaatacactcacttcactttcatgaataaatttgtaagagtgtccaacatactatattattaataaagtatattatacaataagtatataaaaaatcccgttcatcatgattaaacgatttacttcctctatcttaaaatatagctatttctagcacaatatcttgtcccagaatgaagctatttctctaactacctcctcctctcaaccaatcacaaccattcttcttcacctatctcctcttttcaaccaatcacacacctcctccaatcattcccacctacttttttaatactcgtgccaaccttaaaagcaagtttaatagtacagctaactactagctcgaattcatctatagccaatctaatagctcattcatacaatagttacatactacactattaatatatggtcccacctgtcacacatacactgcgtcttggagtccgtgctacagctggctacaaatctgtagcccgctgctcttctctctcctcatttatcttcttaaaatatgtttacagctggtttatagcctgctattgtacctgctctaaaaatacctatattttgaaacggagtaagtagaagatatcagtgatcaaattaaagcatgcactgctactctaaattatagaatattatgaaacggagggagcacattcttttgtatgcgtatggacggatgcagccttttacatgcacctatgtacagtctgctcattgaattatggagttgctagaaatatggcgccatatgctacaatcgattttttttcagtcacttacatatgtaattagtatgtaattttagtacttacatatgtaattttaagacttacattataaatacactaaaattacatatgtaatttagggatttacaatgtaaatacatgccgactatttttttataaaaaatatggcgccataaatatagctacacccttgaattaaccaataaactttgcatctcgtacgcagaagttgatggaatttggattttggatgtttgatacggccgtcacactaatgtcattgggcagtacgtactgactagccggtaattacatgcttgtacgtctggccaattgcccaaacctggtgtttaccgaaatgattgtactgttgtgaaaggctgaaatggccttaagtgcgagtgtacaactttacctgctagggataaccctgatgttcatgtttatgtacatgtaggtgcatgctctttaacagaaagttttgtaagttgtacgttcggatttattgttttgattaatttgtttattatgggccctgcattgcagtgatataaatcttagcttctattttcataaaaacaattgtacctacatggctacatctattaatccgagcaatctatgccattataatttggtaccacaatgattgatcaatggtcagcgtgaattttttttctccatgaattaagttttgtttggcacaactttagatcagaattttttagagccaatacacttcagaaatatatggatctaaatttgttattaataacatttggataaacacttttctatatattttatatgaaatatatataaaattttaaaccactttattttaacttacaaagtctaaatctagtagttatatatgtggagtagtaggaccatttcctgcttcagctctagaaaaaaaagtggtttagattttactactactcccaaaaaaagctatgtggagtagtaggaccattatctaaaatctattactactccacgatccactttattttctgcttcagcttcagctctagctccatttcttagagctgaagtccaaccaaaaaaagagtgaaattctgtttagaaagctctagaatgtgaagactccttgtataatctttactccttaaattaaatttaggataatctttaaaccctcgaatgtgaaggctccttttataggctttgataacttgtgtttagccttgagtttattgtcctttttaaggaggattgaggcaagaggcagcactcagccaacgtacagtgccgttctgccgggacagacaaataaaaccaagcatcctgcaggtttcatttccagttctcatatccagcgaattctcagctttgctatcgcccacagtgatccgctgctccaccgctacgacgcacgccatcacacgcgcgcgcgcgccgtcgcatcgcagcctgcaccttgtggcggccgtagctcgctctcgctctcgctctcgcggccggtgaaatggcggcgcacgacgcaatcatgtcttcttgctagctagctagctaagttcgtcggcgcgatgatgtacaagcatgtcggagacgacgcacgcgggtcctccgcgggcgtagtgtgctgcgtggatgtcgtcgacgacgacgtcgacgcgctgctgtgcggcgaggacgccggcgagctggagcgcgagggcgagccggcgcaggggtcgtcgccgtcgtcgtcattgtcgtgcgccgccgcggccgccgcagccgctgacgacgacgacgaagacgaagacgaacacggcgtccatggcgaggtggtgcaggtgactccaggcggggaggagcactgctacgactacgactacgacgtcgacgtgcccgtcggtgccgagctcgtcatgcctgcttgctcgccgccgaggacagccgtccaccggcccggctggtcggagtccgtctcctggatcctcaaggtgaagctatagctagcaccgccgcaatctagctagctcgatccatggcaatctaattaacttgcacatcttaatttcactcgcctttcttctccaggtccggtcagtccacggcttccagccggcgacggcgtacctcgccgtgagctacatggataggttcatgtcgtctcgcagcttgccggtaaatcaatggccgcccacacttttgtctctagctgtgtctagttactggattaagcgcagtgcactgcagagagccagagattaggccttaaaaaaagaattagctgcagattacgaatcaattgatcagactatgctgctgtagcatacatacttagtacagagttggcagaatttgcagtaaaaaaaaagcacacttgcactatagttatgtgccgatgatatgtgggttagaatggtactgaatttctaagtaacttgtgtgtccgtcccaaaatatatatacttttttgagtttttcaaagtaactaaggagatatataaaattaaattggaaaataattgtgattagtttaatgagctgaggaagcatgtgtatgaattaaatatataaaggatgattgtgattgtttaggacgagagaataataattttattgtggattgtagggaataagtacctagctagctagcacacaaggctaacgaatgtttttggcagatgcaactagtagcagcaaattaattgaggtcattagggatggaattctgaatctatgttaggtggctagtagggcattattctctgtcagaggatgtgtctattcaacagggaattttaactttcccattagtagacaaaaaacatgcatgtgaccggtgatgccattttctgcccaggtgtgccaccacaccaagattgagaattatgattggcaggggcactattttgatttggatttggtctcaatccccgatctacatggtcactaccctgattaagaggtaggacaaggcactttttcatggatcgacgttctacatatttttgcatatgattatcatgatccctctgctacagaaagccacagccattccttttcttaaacggctccaatttataatcgtctatagaaaaggttggggccgttgtaaggtcataggctgcctgtgaaaatatgtcaccatcgattacttaagaaaaccgcctacactaatgaattcattattatttgcaaattcctagagaatccaagtcagtcgtaagttcataacagttaatatcaatctgaaaatgactctgtacaccacacttgcaattgctacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaaataattctcagtgcaattcatggtaatgctaacgttttctttttgagggaacagaaaacaaaattttactctaggatgcatataggttgatcatttattcgcatgccatataatatactagatgaataatcaaaattgttttcgttagagtctagttaaaatatctaaaataagcaaaatgttgattatattttaattttattaccatactatcactagtagtaaaaggtggcataacataagtaaactaaatgccaatgtcaagaggtgcaaaatagtacaatgaaatataatttgttgttttcattgcctgaataatattatcattgcatctttgactctctattgaagtacttttttgttcccctctctttgatgaaaagatgaatcactggagttatggtgtgagtagtgagtactcaatgtcatggtcccgaaaactgttggttttaccggtcaataaccggatggcaaccagttccccgggtagttaccggtcggaaggatgcgaatataaataaaataacatattgtaaaacttgaatatagaactattctgttcgggaacatgtaaaattctaaatttagatttgaattcaaaattagcatttaaatttcaccaggcctgttcctgccaaaccggtattctgaaccttgctaggtagcactatttgcgtcaggattaagagggtgtttggatggtgaccacactttaccacaactttaccaaaatctgttgtagtacataggaaggagattattggatttccatttcaatcaaccagttagctggctaaatgatcatccactacctgggccaatccaaacacatttgtaacatcctggattcctggtgacagttcaatgtgacaagagatcagatgctttcttaaccctgctaaaataatagtacttgcaccattttctgtgaaaaactacatgagtctcatcatcattaattacatattgaaattaagtgctagtaattatccttaaacatcccaactaatgctaaacttgtccttgaatctcgctgcatccaatgctcgctaattgatccaagaatcttcttgttgccatccgtggaacagagctcgagttcctgaaccactgcgcctcatcaatggcggcagcggcggtgctattcgcagtaaatgagtcgcctgcagccatgtcgcacaggagcagcgtcagctctgaatcagctgcctcgtggtgcattggcctgactgaggtaagtaacctgatctctgacgtcctgaccaacccaacccacgacatgatcaattgaaagatcttgtagtttgcaaaactttgtcagttcgtcagtaactttgaaatgatcctttttttaaaaaaaatgtttttatatttgttattacaggagaggatcagcagttgctatcagctgctgcagcgagctctgaatgctactgcgaggaagaggaagcgacatccgatgatacttgcagcttgttcatcagtaacaagttcatcttcccggagcaaaaggcgcaaacttgatggccattttggagaagattgaatctttcttttcttttcttttcttttcttttatttgagtctgaattatattacattcctcggcgatttctgttcctggatgagctatttatttgtttatttttgcatccttgtggttgttgaagctttgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattctttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccgttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctctaacgtctaagtgcacatttcggaccacttcccacagtgcggctagctgttcgacaaggtcgattgtgatagatgattgtgaatcaagcttcaaatcttgcacccaggtgtcctcctcctttccttgccgaaggggttttcctctgttttttgagatcgcatagacaagcggcatgaggtctttgggtcttcgcccaccaatccacgtggactcccaaaatcgcaccgtgtttccgtcccctattgttatgtttgttgaggcggcgaagaggttcctatctatttcatcacatggcgtctccagccccacccaaggtttggtctggtccttccattcatgccacaaccatctcaacctcaaggccctcgtgaatttgtccagatttaggacccccaatcctccttggctggtcggcatgcacgtctttgtccaattgaccttgcatttccctccggtaataacacctgtgcctgcccagaggaagcggcgccgctgcttgtctagctgcttgagggattcctttgtgattttcagagcggtcagaaggtagattggttgcgccgttagcacatatttgacgagcgtagttcttccagccgctgccatattttttcctctccagcttgctacccttccggaaattttgtcaaagataggttgcaagtccaccttccacagtcttcccagagctagggggaggcccaagtacttgatggggaaacttgccctcaccacagggatgccctcaagaacctcattcaactcgatgccgccgcatctgatgggcgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctagttgttctcccccgaattttcgagattgcgccgagctctgtagccttgaaaaggattcgctgaagggggtcaatcgcaagtatgaaaaggagcggcgatagggggtcaatcacaaacattctgtttcatctctttttctcttctcaaccaatcacacactttctctaatcatttccacctactttcttaatactcgtaccaacctaaaaagtacttacattttgacacggaggaagtactaacaagataaattaacggttaagatcacttatatcgatgataatactaaatagtagtagataggggtactcgtttgagatcaccataaaggtaagtcgatcatttcattattcagagtacattttaagtaaacaaaataactataggactctgaattttcttttttcaggagaccatccatcctatgaacttgaaaagattcaggacacttcatattacatatttatagttgcatgcgtgtgttagttagacctaaaccactgtgctacttaaattttgcctatggcaacacgacaaccagttgctatcttcagggcaagcagcagagagaggccccaaattcttaccagattatttgtcctgcctttatgtaaagcagcgtcgtcgtcgtcacagtggcaaagatcatttgctcaccagctcgatgcgcatttcgaactgctgcctgcagccagccaagcccagcttcgtgacacacatgtatttatttaaaagatgatctgaacaatcgatgagatcgactcctttcccagacaaatgcattgccccagctgctactgaagctgaggtgtcgtttaatccctgcactaatctagctatgaaaaaacaaagctctttgcgtaaagataacctaatcttggtcagtgttaaagcaggcaatgattgttgatatattgagatagtgtgatgacactgtggttttgatggatctgtgcataatatcatattatcatgggagagatatctttgcgtaatctgttcagtttggggctttgtagattgtatcattgtggtgtttgcctttggcaggtattatctctgatgatggatgattatacactgattgattaagatccagcttagcaatgtgctatagtactaaaactaactgaactgctgaaggtgataatttatttaatttgcaaaagatgagaagtgcaggtgtggtgcagttatcaagtttctagtatagtttttcataaaattgttgagtttctactatttgcaacagtgagctggtggccggccaggcgctctccttttctgcaaaaaatttaccgtgaccttaaaaattaaaggcataagggcatctccaatgtgcatgtaaagttaaccttaagcactaaaataatatttgtagtataactttatgtattgggaagtaaactcacaagagaatatatggctatggctaaccttaagagcaagtataataggaggctgtaagtcggctaaatgctgaggtgatggagagaagagaggagagagaggagaagcgggctgtaaatttacagccggcttggacgcaagaaccaaaaaattctgtgagagagacaaatgggcactatattaattataaatagttaactattatatttgtaggctaagaaaaaattgcaaagaaccttataaccaacaagtcggctgtattattagccttgctctaagcttagagctagccataagaaatataaaattaatttatatcttttcaatgtgtatgttggctttgaatcttcatgctaaaatggacgaatacaatttgttttccttggtgggccacaccttaaggtgaagaagagatgttatacattatagcatttaccacgagtaaaaatatatatggttgtgggtttcaccttatggttatggtgtatcttaacactgaggataccctaatgcggggacatgaggagtggtcttgctaggccatgtgggagccaacttatcacgtcaggcgaagcagtggctccgcatgaccacgcgtgccctagagaagctatggatggcttcccaaggaaaaacgttccgaagatgaagccatgctcaggtagctccattgctcgccgtcgtggttccaatctcatcgtcgatatgttctactgcgacctttgctcaaggctgctttgttgctaggacctttgcccagacaactccaccgtcttgtaatcaacctggttactccaccatcggtgccccttgatttggcctgatcatattcgtgacctgatccaatgagcacatgaccatattgctaggagctcaaccaccggaatctagtccgctcggagcgcggtggccggagtaggattgtaggaaacacaatggcgattgaggtagagatggacgatgcgcatagtctgagaagggagatgttggagactaggagaggatagcaatggtgattgaggtgttcgggagaacaaggaaacgacagcaccagtatggtaaagcaaccgacgtgaggcggacaaagaagcgaccggagaatggaggagaggagtcgtcaatgaacatatggaagaagggactgatcagagggggaggggttaggaaaggaaaaaagaaaagaaaagggagggtgactgacaggtgggtccacaagaagcttaagggtctatatgtatttcttttattataatagggtttaaatcaatttataaaaaaaatattatgagagctggtatataagctatccatggactcagccggtttgataaatgataatgaacattttcttcaacatgatatttttaaaggcatggatctaatcaaccattttcaaatttcaaattttttacatttgcatgcgttacaatctgataaaacgctgattgaaaccgctcttccacatgcaatggcagcttttaccagtcaccaccagtctaccacacgcgcgtgcatgccgacggacggtccgtcctcccctctcgcgcacgacaacagaacaagagatggggacgagaaagaaagagaccaatgacggactcacactctcgtatatcctccctcctctcctctttcccagtggaatccatggctcctctcgtcgctttcgtccctgcccatctcacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggcagtggcggtggagcagagtatgccacatgccacgctttgaaagcctgaatcaatcgggtattgttcgatcgatttgtgcgttctctgaagaagaatgggtggctctttcagctttggctgaatctccatcgatcgatcgatcggcaaggcaatcgatcaagctccccaacgttccgaaatgcagccgtcagaaaaagagggaaaaaaataaaggagttaaaagcgactttggtttggtcaacctggtaatcaagcactactgatcatcatcttttttttttacgtgccttgatttgtgtggcactctgccatggaatttggagctctttctttcacattctatctactgaattctgtaccggccaaccaaccagcaatgattgatttttttttctggtgctttgttgtacagccacaaacccatgttgttttggacagatgtgctatccaagcttctgaaactttttaggattggtatttgtaaatggaaattgtatgagtaggtttagctcgaaaagaacttgctttcctgatagcattatgatttaggacaccaaagttgtgtttgggacatgagagagtaggattcatcaagaaaggaaaataaattcagattagggtaattatccccaacagaacatatttgcatcatgtacaaacatggcatgatgctccagtgtccctttgatgatctgttctgtcaatcatttcagttcttcaactaccaaaccttgttcattgcaggggaactcgagttcaggtgttggcacctaacttggcaaatctctagcacttgtcttactaccaactgcatctgcaggaaacaatatacaaatgtgcaggcctaataggccgcgaatctgaagatgtatgcttgcttccaacacataaagctcggattccagctcctgtgttctatgattgcggcgatccaatgatcacaaattcggcacccaaagagcagcagtaaaatacacaagaatccttaaaaagctatctgcaaaggatgtactttgcatcttaaactgaatatataatagtacatcaccctgcttttgattaataaatacccctctgtatgtgccaactctaagatgcaatgcaaattaaggtaccaacttacttcccaagccagaaacaatcttgacctcagtaaaatggcctgagtaagattggtgatttcttacagtgacttggtacctactaactgaaactctgaatatgatgcattcagagctactgatcatcttcttctctgttgagagatgctgaacccaacacaaccaaactgaacatcgcatcagctgaaaatgcacttctgatgaaatgatgagcatgaactctaaaaacacagatcagttcaactggccggccactgacgatcgtgtcagcttctgacttcggcgatgctgtgcagtgatgggcgccattgacgatgcctagaatgtgtcgccgagctgctccgttggccgtctctgtcatgctgcaaaccacaataggatgggtggcagatgagtaatcagaattcagaacatggcactttgttaatcttttatatagtttaggagaccttggaatcaaatcaaattaaagataaagcaaaaattggtacaatccaaagaattagtgttggatgattcttcatgaccaatagttaatttttaggagttaggagtagctgcaagattttagactattgaaagtctggcctttcttggactttctgctatcatcttgtaaactagtaggttccatattccccatgtatctgacatcttacaagagaatgtcaaacttgcatgtttttatttaggagatgacaggaaagaaaaataagtaaaccacccatccatgcctttttccatgtggtgtgaggaaatcatggtatggcacacaaggttgttgtttaaagcttggtttgggaataatttgtccactaagtacataactaaacagagccattatatcatgtttaagagtacattattgctaaacatattcctggtatcatgatcaggtattatatgatatctataatggatctggttagttggttaggtactagtgtgtcacaaggagggtggccaactaaacatagaaataacagttgggttgagcaatagcctaagtaacttacttgcctcataatatactccaaatttagaatgttaaccaactatgtgctcacctactcctagactcctagtgttcactcaaccaaaagaaagaaattaattgcattggaacatagagctaaaattcaacatgcaaattcacaaatttaaatttcaaacatacaaaaatctgtcccttttgctcagaaattgagttctggatactttacttatgcaattagcacatatatcaatcaaattgttgcttccattataggagtataattaagttgatcgaatagtaggattataggagtaaattggccatggtaagaacagctgagatgatgaaaatcttgcagcaagaagattgtgacaaacctgatcaagattctcatcgagctgcgtgtggtcgtcgccgccggaattgatcctaactccggcggcgacggcggcggcggcggcgggcttggattccaggtgatgatgctgcgccgccgccctcctcgacttctcctccttcttcgcctgcagcgccctggtgacctcgtcgacggtgatgaggcggtaggcctggccgaggagcagcgtgtcccgcggcttgagcagcttcacccgcgtcacccgcaccgtgccggtgccggtgccgcgccgttcggcccgcgccggcggcggcggcggcggcggtggcggccgcttctcctcggcgacgcggagggtgacgagcgcgacgtagtggcccgggttggcgcgcatgacctcggcggcggtggtggcccagtagagccgctccacacgaccgcccgggtgctgcaccaccaccgtcgccgcctccgccgcctggcagttccccatcgagaaccgagaacaaaactaaagcttaacttccttcctccttgctggcggcgagcggcggcgccgcgtggcggcgagagcgcactggtggtagtacggtcgtcgcgggccgcggcggtgggcggtggcgcgacgcgacgcgacacgagagcgatgcgatgcgatgccgccgttggcgctcgcgttgggaactgaggagggtgaccgtttatatgtcgccgcgccagcgcggtgggtcatttacggcctaccgctcacaatttcgtcctactttttttaatgttttttgaggacaaagttttgatttttttttttaattaggcaaatattgttcaaacttagcaaaattttgtttaagttttttttttgttttcaaattttagccctctataattgtttactcatccagaaatatagttatatgctggcgcatatgcatgactttactctaatccatttgtcagggacttaaataagaggatcgcatcccgtataattgtggcatcacaatataaactctggtgggtttgagctatacaataagaggttaatgttgtttcccgtattcgatcgtttacatttcaacattaacctcttttttaaaaaaagattaataacccggcctttacatccacaaccaaagttaccctctcttttactctcttttacatgactgttgtttgggtttacttgaaaattttacttttccatgtcatggaagaagattttgcataagaacaaaggatggttctaaagggtcggtgatcatacatcctatcaatgatctatgcctctatggtctaacaaccaagcatgcagttttcaagaacacttgatcggaaagcaagaaaaaaaggcacaagacaaatgaaaagttattggcgatggcgtgtccagatactactttaatttctatttgacatctagtgttggcaatttgctgtagtataataaaagaagctttatgaagattatttaacttacttttcttggatacaaatagccgttttcggcgcctcatatctggaactgccttttcgcctcgttgataataatttttttagataataatggctgttgatagtagtgtctgttagtatagcctgtagttctgtaattattttttcccgttatatcgatatgaaacaccgaatcatattttttgtttgttttaaaaatatgtatagcagttgttgttactttctactctctctgttcgatatcataaactgttttagttttgtttaagtcaaatttctctaactcgtacgagcatcgatctctcgtgtaagatgttttcttagcagagtaatactgattaattaataaatgtgtccactaaacatgaacaattcccttgtacgagcatctcgtataaacagtatacttaatttctcattcaagtaaagactttgaagccatcccagattagtactgtacggtctgtaccagagcttacagccacaagcgttaccgtcagatttcagaagtactgaagcaaatgtcaatggtttcactctgaaaactttaaccaccaccgatcgctcggagtacaagtatatgtggtttgttgagattgtatacgaaatactcttgttgtatgacgttgttaatttttagacatgacgtatgatcatttatttggtttgaaaatttagtgcaaacacaaaatatatttctcatgcttaactcatcatgtacgtgagaagattgaggactatacgcatacatgtagctactcgggtttcatcaatagcactacaaaacgaaaagacaacatcttcatttaagttttggatgcatgtaactataaatattttatcttatgtgaaaaaagtaaaaaaataaaataagacttttggatgaagagaatacttttaataaaaaataattcacaataaaataaataatacttaatatcgttattctaataaaataattggtcctatgttatagcctagaaagtcaataactacatctagatttcctgaaatcacacacagccgcaggcatatgtcatttttggatcttcccatgaacattttccccccatcaacgcacaatttctccgccacggttgggggatcggctcggccgccacggtggcatgaggtcagcgccaatgggcctggcgctgacacgcgctaagccgacggcctatttttggttaaagtttttggcaaggttagtttcgaaataagttttcgaaaagggtcaatttgtcaaaaaaaaagggcaaactcagaacaaaaattatcaggatccaatacatattaattatctaaactagctgggtggtccgcacaattgtgcggctagcatcaatacaaaattatctattttttaacatgttttttcttgaaatttattaaatagatatctcatcgtcttaagatttgaaagaccaaatcttatcatctctgtgtttctaattttatagtttttaaaagtcacaccagttactaatgttttacttctatcatcccttctttatttgcttgctcgatcgatctaccactacttctattcattctctttggaacctttaaaaattggacattatagcttttagagtttattgtcttattgggttttggtttttataatgtttagaaatctcgttaaatactgtcactatactcctctacatcttgttaactgccttctctctttattgttattggcattttaaaaatcaaacgcttgccttcattttttactttctagaagccctgccaaaccgttaacggctttgccactgtactcttttgtgacttgcccgctgcctcttatctttattgtcattgagattttaaaatcgaacatgattattattggtttattttttactttttaaaagttttgaacctttaaaaattggaccatatagtttttagagtttactttctcgttgagtttcatttttataatatttagaagtcccgtcaaacacgctgctactatacttctttatgacccgtccactgcctcatctttttattgttactgagattttaaaaattaaacataattatcattttgggattttttttttactttgtagaagtcccgctaaaccatccacagctttaccactgtactcctctatggctgcacgttgcctcccctctttgttgtcattgagatattaaaatcaaacatgattatcattatcttttattttttaccttttaggcgtcccgccaaccgccttgactatgttggttaacggcctgtccatcattcctcgttttaatcataattgggattctatttagagttttgttagtagtttttagatgcccaatcaaccgtcaccactcaactctttacatgcacattgcttctcccctctttattatcatctgtcatttgtcatcgttgtgttctatatgtactttatttttttattttgaaaatttcatattttcattccgatatgttttatttacaaaattatattcctacttgaactcttatagttatttttctattttcaaaatttattttatttgttattctgatttttaattaatctcgtcatgtgttctggatggtctcttctttcaatagtctttatttttttattacaaattttggttatttataaattgtattcaacttttttctaatttcagaatttattatattttccttttttcctacggttaatgtggtaatttctagcatccggattgagtttttattacatttgtattttgaatttaaaggatttttttcaagaatatgcaaaagaaacatagaaacaatatagatctggtgataatgcacatgttcttttgctagtttttagtgtgcccgttaatttttattggaaggtgtaaatcactgttaaaaacaatgataggattatacgcgtatgcaaaagaaagaaacaatctagatctggtgataatgcacatgttcttttgctagtttttagtgtgcccgttaatttttattggaaggtgtaaatcactgttaaaaacaatgataggattatacgcgtgcggtacaactattttactgctgcctcacatgaaacctactctagttctgtttcgttttgctaagttatattcctttccaaatagagtctggtgtcctgatgctactactatacgccatactcaatctgagttgtatcatactaacatgtccgcttctatagtgcttatgtggaacaacagtatatttccaaaattttacgcattaaatcttaacccttgagatctagatttactatgatttagtggtctatatttttctctttttctccgattaatgtgggagtttctagaccccacagcgaacgtagtgccttctttcaaaactgttttaataatataataaatagatagattatttagtgatatactagaattaaataatttaaccaggatcccgaccctagttaatagtactacgtatgaacgctcctgtgtataaatgatgagattgtatacaaaatactctcaatggttttaatatgtatgatgccgttaatttttagacatgacgtatggtcattcatctggttcgtaaatttaatgaaaaaaaatatctcatacttaagcacttttaataataaaataaataatccccgcaaaaaaataataaaataaataatatttatagttatttcaataaaattgatggttatatgctatagcctaaaaaagtcaataactacatatagatttcctgaaatcacacacagccacaggcatatggcaattttggatcttcccataaacattttcccccatcgacgcacaatttctccatctactcgagataccagatgtgactgatcgagctcaagctagctcgtggaatagaagaaaaataacttgcagctccaagtggccggcggtgatgtgagagctgaattaggttgatcagttgagaattgaatgccaagaattcagtcggcaacagcagaagtccacgtactgctcaagggacatgagaattgaggattcataaatctcgtacttgagtatcaagaatcgctttccgacgtcgtcaagatcatcaaggatgtagatacacgacgctatattcaattgtactgtgctgaatttaagaggccatgtgaggatcggtttgtgatgtccacgtattcaggattagaccacaggcccggctagatacagatgttacttcagttttcgttagcacgttttttaaattatattaaacggcatatttcatgagaaaatttattatataaaagctatttttaaaatattagataaatctatttttatgtttaaagtaactaaagtttaattaattatatgttaatgattttcttttcatgcccgtacttaatttactgcagtaaacttgaacggagccatagtagcactgtttccaggctattacaaaactgtaaggccttgttcggttgggccgggaacggctgggatcaaggtccaatccccatggatcaccctggcgaggaaacaatctcggcccatatgaaattgtacgttcggttaagccctagcgtaaattttagcccggcccaccacggggtttccctgtgctgtccgcccgggaaaaaatcacctactctccagaggagcggaaaaattcctcgagaggagcggcggcgcaacgaagacccggacgcgacggcgggagcggcgcgatccggaggcgcacagctctctcctccggccgccaccttctctccggtgagcacgcttccttcccccctttcccctcctctttcaaatttagggttagggtttccttctcttctccctttcctgtcgtcgcacgcaccgtgccgtagggcccggccatctggtcgtgctccggcgccgacgccgacgccgaccgcgtgttcagctccggctccgacttgggcggcttgggcttgggcttgggtggcttcggcttcggcggcgccttgtccttgtccagatccggcggcggcgccgggacacgggagggttcttggacgccggagaggagaggagaaggaggaggagagggttcttggttcttggcccgtagcatctctgtaagactcgccaaaaccctgatgaaattcagagtcatgtagatgtagttgcagttgcaggtttgcgaaatctgaaggaattcagagtcatgtaatggcaggtgcagtacagaggagtttcttctttcttttactttccaaagttgcagggttcgaacttgattcttctcaagattgcaaaatctgaagaaattcagagtcatgtagatgtagttgcagttgcaggtttgcgaaatctgaaggaattcagagtcatgcaattgcaggtgcagtacagaggagtttcttctttcttttactttccaaagttgcagggttcgaacttgattcttctcaagattgcaaaatctgaagaaattcagagtcatgtagatatagttgcagacttgcagtgcagagatttccttttttatttgctggtaataaggtgtcaacaaatacaggaagcttaatagcatcaaagtgaaactagcatacatatatctgtctaggggccgatcagcaggagcactgaagtgctaataagagttgttttttattagtcattagtttattgtgatatatatttgattaatcaatcagatttgtactggattaggatcctctgtgtttatctatagctagctcttgctcaaacttcagaatgtcacggtgtttagttgatacaaggaaccatgatgatactttagtggtgaaccttacatatgtgaaacttaaatagaagatgaaacttgcagggctttcctattaagagcatcgttttcaccgtagtgtatcatgttgtcgccagattcagacagcaaatgcagtcagtcctcactgtaaattttggtctaactgaagaaatgaacaagctgctttctcttcttttatctccatttcttgttgtgaaactggagcacacttgtatagctgtacttacaaagtagtgcttgttccagaaaaacaaaagccaattaactgtatttttgttagcttcctagttcatgaactttcaagtctcttttcatcttttgttctatcagactgttagcattccatgtagtgcatcagccttagtttggatatcaagtgtggctcttttctttacttgtctgctcttctgtaatctgtactctgcattaattcaatttgatatttggttgacaagaaagaacatatatggtgtatttctttttggaattgatccaatgttgttccctttttttttccagagatgggaacactgcagctgggtgactgaagctcatggtggcattagtgctaagcttaaacacttgcattcaatttgtagtttagctcttagctggctagttctatttattctaaaaaaacaactgaattgtaaccattttgattactttgtgaccctttcatgtatgcatttgtgaacgtacagcatacatgtgtgttttccctgtgctaaacaatgtttttttttactgtgtcctatggatttgatctgggagaatgcatattggttcattgcttacttgggaacgtacagctgctgccttatttttccccgtgctaaacgaaagcagggtttctatgacagggattagaaacgggcagggattcgaaccccgcagggattgagtgatatgggagggattcactcagtccctccctggataggttccccttgagatcatttcccaagcaaccaaataaggcctaaggaaaaaggttgcctgtagctggaaaagacggaagtcctttctatttcccaaacaggaatgccactagacaatgtgtatcaattttctttgtgagaagggtattttttacccagcctctacatccaactagatgatatatacaatctttttaacttagaatatagcctatcaaacagaaaacttagcccttaaataacctaatctgaaattcgctcctatagagattggacattgtatattataaggtagttggagtgttgtcggtggaaccggctcactggccgccggcaaggcggcaacactgccgtcaaggactccaggacccgttcagtttatcgccgcttgcaatcttaccaaattttaataacgcaacaaactcaacacacttcaatcattattatcttattaaattttgatatttctaaaagcttcctctcttaaaactctatcaaatcaaagccaacactatcaaaatttgaaaatgccaatatgtgctaaaatgtgacattaccaaaatttaatatggttgatttcggcaacgaagtgaacaagccccccagtctccgggctaccaaatggcatagcccttcttcatctacacgagtggaataagttcactttttttactctcttaactagtggtcgaaactgattcgtatccctaaaccacaatactggatatctcaaccttcccaactattaaaaccggaacagtttgatttcctcggtggttttggaggttcacgtggtattataattaaaaaaatttacgtgggacccatttatcattcacaccaaattattatatgacccacttatatgtggggcctacatgtcattctctctccttcccttcttcctcctcttccctctctctcatctccccccccccccccttcccattcggccttcctcgttgctcctcctttccccccaccctctgtctctctctccacctcttgctctatttgtagccgcgacgatgccgatgccaacaagctcaagcaggggagggcggtcggcggtttcgacggaacaggacctgggtgttggcgtggaccgagacagagccatctccaaccgaggaggccgaacggctacgatgcttgaggaggccattgccgccacctgggtcatgaccgtagcgaatcgcgtgcctcgaattgggaagggaaaatgagtgacgtcgtactcgcagtcgaggctctcgacggggcacacgtcgacaccgacgagggccacctaggaggtggtgttgaattgggagcggccggtgaggaggaacctccaccgccatccctgcacctctttgtcaccctcgtcgttctcgtgtgctaggtcctggaagaacgagaagccggaggagaggagtggagcttgatgtcaccctctggatccacctcaccatcatccccgcatgaatggtcccttggctccatcacctcagccactcagctccactgccgccgccgccaccgctggcgctccacaaacacgaacaagaaggggagaacagctctgccattgctcattggccttgtagcagtggtcgtagccattggagatcaccccggtgactgcgaggcaaggaggataagcagcaacacaggggccgccatagccaacgaggccatcgctctcgctagggcctacatccgcgagccttcgcgaggccgagtcactgccaccggttccgaggcaccctggtgggagctcgccgccgctgccgctcccctcgtcttcctgtcgccatcaccgccgctgccctcgtcctcccgacgccatcgccgttgtgcagaagaaggcggaaggggagagactcagcgagataagagggagagagagagagagagagagaaaagagggagaagggaataagatagaggatgacagatgagtcccacatgctggctcggtgtttagactaggtcaacgagccacgtcagcgaaagccaccctcaaaaccaccgaggaagttattttgtaccggttttaacagttggatgttcaagatatatggtattgcgattgaggggtacatattagattagacatatatttgagggattcaaagtgaacttatttctacacgagtagttcggtaattctggttcgacatgtgatcgattcgggatgtgcctcagttgggcctctagccctccacggaaataggccgaactaggcagcagtacgtagagcttaaagggaaaaaaagtacatacaaggtccctcatcttatcatcagattacaaaatcatccccaccgcaaaatcagatgtatgccatcattttgggtcctcaggcggttttgtccaacgtggtggctgatttatcgcggacccatatggccccgcatttaagggtgaccacgttgtcaccccttctctttcccatattctctcccttccacctctctctcactcttctcataatctgggctggcggggcgagtcgggaaaggaggtctgtcggcgtctgccgtgaggcaccgccgtagcgaccagctatggagggcggcgggtggcaggagtggagctaggagacggcggccggcgggagaggacagccaccatggcctgctgcgggggtgaaggcgagcactgcggcggtgggtcgccacccgtggacgatgcccgtggggaggacctgaactcgctctgagtcgtggctccttagggcggtgacgtcccgcacgaggtcggtggtgggcagcatccttgatgtggcatcgatggaagtgaacaccttgaggaggaagacaagagaggggaggcgcaagatcatggacaagctccgctgccgctcttccctgtcggctgcgccgcgcgcctccagtctccccagctgtcgtccgtcttcgctaccgagcgtcgtcgccgctcttctccgcttcagctgctggtcgcgccgcgcgcctctgattctccccggctgccacccatcttcgccactgaatgctaccgccgctcttctcccccatcggctgccgatcatgccgcgtgccttcagttctcccccggtcgctgcccgtttttgcctcgaactcgacagactcgaaccccggcgccccgacctgctcccacattgcctgttgtcggccgttggaccttgtcctctcccacttcaccccgccggcctcctccccacccgctagctgccttgcccagacgaggaggagaatgagtgagagaggaggaagggagagaaggggggaaagagagagggtgataacgtgatcacccttatttttggggcccacgctaactcaaccatcacgttgaacaaaactagggtcaaaaccgtctgagaacctaaagtgatctggttttataagctgagggatgacatgtatctagttttacggttgtgggatgattttgtcaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggacctcaagtgaacttgtacctatatattttctcgatcggtataccggcccaagtggcttccgatgacggctataaataggaaccaattactgggcctctttctccagtagcgcagaaggccctctccctcatctcgaggcgggaaccgctcccgaatattctagaagcttcgggaagggcgtcccccgcgcgtcgcctctctgctctcctctccaccctctcttcatggttgcgtcggcggcggcgggggcgagcggcgagccccagaagaagctcccctcctggccctcgatggtccgcgacttcgccaccgacgagtcccacggcggtaagctagttccgacctgcctcgccgcggggccgccgctgagctaggctgctccagtgtttcgcgtcatcggctaggctgatccgtggcctccgtgcagagcgcggcatgtccgtcctgaagctgcggctcgacggcgtgcgctctgcctacgacgcggccgcggcggagctcgagaccgcgaagcgcgcgcgggaggacgcggagcaggagctcggcgggaaccaggtgcaggtcgccatcgccgtggtgtccatccacgggctcgaggtctctacctctcttcctcatctctcctcgattacggccagtttcgcctgattcgattgggtttatttcgtttcggtgcgtttaggcgacgatctcgcacctccaggaggaaatatcgcaggtgcgctctgatctggacgcgcttaaggtcagtaaattttggggtttcatctgcggtttgcagtaatattcgctgttcgatttttttttgtttaaatgtgacgcgctgatttgcttatgtttctgtaacattgcaattgggaaatggtgctgcgctcttggtgtttgatataatgtctccaaaagggcaagggagacattgagaggtgagtacgggagttttgttgattgccctgctgctggtctattgaatgcattttggtgaatacttggttgcaaacagctaagacatgcaacttgctccttgcagggatgagttcatcagccagatggatcagttaaacacaaagataaggtaagcaatgtttgtcctgccgttgaatctgtgaggattttcgcatgttgtatagttgcacattggatttgctacaacagatgctgcatctcttgcttctttgcttggagccagcttgatactctaaaaacatatatgttagtctgtattaaaaccttagtttagggcttggataagggtatcaatggatgtattgtctcgatctcgaaattcctgatatgcatgaactaaggatcataagggaatgaaaatgcttcaggtttttgttactgggggactcgtggtaataacacctactttcagaattcagatgtttctttttttttcttttttggcatggttagcactcattagtatggaggttgactacctatatggaaggatactaccaagttggttttggtgcttccaaacaattcaacagtcagtagcactgattatttgcttttttatgtccatttgcatttgctttgctaggtgaaaattttcttataagaccttcttgttgattatcaaaaggtaaacaatattcgtcttgtgcaggaagttccagcagatggtttctgtagaattaaatggtaagaagtgctctgagctgtcatcaggagaaggtaagcaaggaagtcacgatgcatacataatgatgtcccagaattgtgtttgaagttgcatacataagtttgttactgagatgttcacctttccaggccaacaggtcacggattggagtgaggtcattgagttagaaggtagtttcgaagagttgaatggaaatgtgagcaatgctgattctgagaggtctctctttgaagaacaatatgaaaaagacgatcatgataaggttcatctctatttcccccaaatgctgcatcatatctcaaagaacactttgtacatgcaaataatgattatgaataaccacatctggcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtatttttggcttggttgcaggtgacaggcaaagaatgtcacagaaaaggctttaccttcctccgttccacaggcaagtttgagagcagcgatgaaggctctacttttagcgatgatgagaccattttagagttactgccgttaggaccatccacttcacgcattttggtggcatccacttctgtcaacaatggccaaaatatatatgcctctgaccagccactatctacattacctccacttcctgatttggagataccccaaagaaagggtcccttgtgtattgatggcgatgccaatgaaagtgacaatgatgatacagctacaaccagcagtcaggggtcctacattgagcttcataccattcaggatgagtatgtgataggaggtccttcttgggaagcaatgattgcgccaattactgggctcgctctagaggaggaggaggagttgatgatagagggtcaaatcttactggccaatgatcagaaagcgaaccgcctcatcactttgtttgatgaggaggaaagagccatggttcgaatgctagctgctcttggacagccattactgacaatggggacgtttccaacatcaaggagtttcctactcaaccttcccctgatatttgtttgcaaggagaaggacacagaatgctccatctgcaaaagcacgcttgctacaaaatatagatgtcatgtgcacgcctcccttgtcaacacgtattccatatgcaatgcatactgaagtggctcttggcacaacatacctgtccagtttgccgatatgaactcccagtaaaagacattcaggggtaacaaaaggtatgattactctcctctgcattcatcaacttcaagaaagaaagataggttcccaatccacacattagacatgaaatgtctcatacagaagtgatgctctagtgctagtggtaaaatcatttgttcttgttgtgttttaattcaaactgcattaggtacctatgctgtgtaggaagccaatggttattgtgatccttagtgaaaaaacataatggtgctgccagaaactgttacactttcattatcatggtactagtccagattgtattatttgctccgcatagcagctatttggggtgaaatgcttaggaaaaataagatggcatgattactttgacacttgtggcagatgaattatgctctacacaaaggatggaaaagtaacagagtattagagtccattcccatgagctaaaaatgaagcgggaaaagtgatgccagtactcttcctgatgtcccataagtccaaattactttcttcaccttctgaaatgattattgacttgccatgtaggtactcttcttttgaattgtgatactcccttgctaatcctaggatgtttatgtcttcttttgtagggttttacacatcagtaggcaactactttgttcctgtagtcttattatatgtacttgtctatattgtaggtttgctgattgaacagaaagaagtatcatgtactaagtaagccgaccagtgctaatccaggagaatgcactatctgatgataactggacatgccaatagagtgctgaactgctgatcaactactgcttttcttgtccagttttttctgatgaaactgcgatctagtattttctttgtttggtttaccgtgtaaacatattgattatcttccttgatcatgtcttcatgatatacattgcaacatggcctacttatgacctcctgggcattggcatgaaactttgaaagttcatgcattttgtttcccttagtatcagcaagattatggtccaaaaattacctctggagaattggcatcctcatatttagcttatatagtggcattcgtttatttttgagtcgaatagcattatgaatatatttgtttcttacttgtctcagttttacactgaagacgtgtacctcatgttacccgtctcgcacaccggacgttgtgacagcgacctgcatcttaagccatctatgaaaagaaataaagaatcaaccttaaattcatctatgaaatcagcgagatagcaaaaactggaagtatttgaaataattgagtcttgccttgatacggagttgttgatttcgcaggttcgtcatcgtcaatggccatgtgatcttggcccagcacctcctccttttcctcctattcatctgctaccagcacatcctcctataccgatttgttggcttgtcgcacttcccctactaccacctctttcgccgctacgtcggagcatgtcttgtgcatatggcaaggagcaagaagtcgtggcgcaggccttcttgttgctgctcacagcggtggacttggtgctgctcggtcctccaatcctcgttgaagtcagcacaggcctggatctccatcccggctcagcatggccaaatccggcttctctagcggcgatgctgagagaggactcagaggaagaggaggcgggcgcgagcgcacgtcggcgagagtgagggggacgggaggggattcagcagcggtggccgacggcgacgggaatcgccatcgcggagtagccgggaagggaggtggctcattatatgaggggcgcaagggtttggagagactgcgcgagtgcgaggtagggacgcagggtgtgggccggtgtggcccgatccaagccgtttcgcaagtggaccggttcgcaagtgtaaccggtgcatttaaaaaaaaaggaataagttcaccggagattactcaagttaccagcaagatttttttaagtcctttaaccataaaatcagaaatcttcacccctaaactatacaaaacggtctaatttaggtcccatgatagtatatatgcctggtttcgctgatgtggcatcatagttagcaaaaataataaaataaaaatgcggggcccacatgtcagtgagagaaaataatttgggccccgcttctccattttcctttatttttctcttctcttctcaacttctcacgcgcaggcgggcagatgcgggtgtgcggccgacggcggagcgggcgcggcggcgagcgcagcgggcgctgcggcgcgcggggaagaagcgggagagggggagtggaggcggccggcgccagagaaggggagagagtcggccggcgtgaccgcctctccccatccggagatgcggcggagctgccccaatggtggagcctctatagtctctcccctccaccacccgccgcgatgtcttccgctgctccgccgctgccgcgctcaccggcggcgacgcccgactcgacggcgtcaactgcccggacgcgcgtggtccgtgcgccctcacgaccgccgcgggcgccacgccgccggagtgggcggagcgccgccccgccgtgtccgtggactacgaccggggccagcgcgaggcccgcgccgaggtggagggcgtgggcgccgtggcgttccccgcgcgccaccgcctgcgcgtggaggggagccggtggcagcgggactggaaggtgttggaggccgccgcgcgcgtgctcgcgatcccgcgcgccgaggccggcgctgtcgacgccgtgctcaactgctgggccggccgcttcgcccgcggcaacttccctctcctcatccgcgtaagggcatcatcccacgctctgaagtatttcatgaattgaattgctgtgatatacatcgatgtggttgccatggttgcgttcttatgatttgccatcacgcaagttatcgattgcttgaaattacgaaaagcgtcaacaattctatcaatctagctgtgttgttcattcaacagccgactccgctctcagccgctgccgcggcgactgctgtatctctccccactgcgccggaagccgcgcccgctccgccgtcaccgcacacccacgtctacccgcgtgtgagaagttgagaagagaagagaaaaagaaaagaaaaaaagagatgtgggcccacatcattttctctcactgacatgtactgacatgtgggccctcacatatttattctattatttttttctaactaggataccacgtcagcaaaaccaaaaccagacatatatactgccttaggacctaaattagacggttttgtatagtataggggtgaaattttctaattttgtggttaagggacctcaaaaaacctcgctgttaagttgagggacctccggtgaatttattccccaaaaaaaacaccacggacggaaaattagcgcagcgattagctcgtatggatgaaaaattagtgcggattaacagtcgaaaaattttgtgacgattggaaagttgcagattttttaattagttaagattattactagcaaagatgtccgtgcgttacaacatatgaaattaaatttattttctatgtgtactttgtgttgtgcaccaaaaaataagtagggccatgtttagatccgaaatatttcttcaaacttccaacttttccatcacatcaaaactttcctacacacacaaacttccaacttttccgtcacatcatttcaatttcagccacactttcaattttagcgtgaactaaacacaccctaggttcaatagggcaaacctcaaccatggcggtgccgcggcggagggagcaaaaggaatactaatgagtgggtacgcacacccctattcagatcgggggctgccttgcttggccctactaagcacaccagcttgcttggccctactaagcacaccagctccccatccaaaaccatcctcattcattcttgagtaaatttcacaaaactacatgttttatggttcaagttgtagaaaaccacatacattttgacacttgccacttaagtacatatattttgggagtttagtttcacaaaaccacactatcgatgaatggattcacccgtgatatgatgtg

SEQ ID NO: 71606 - DNA, 7151 bp, Oryza sativa
cgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggtggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggagtcggaggataacaagggccgccttcccacagtggcttcggggccgtcctgggggtcgggggctcctggcgtcgtcggacaagcgggcaaagggccaactccggtcgtcaggggccttaggcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccctgggccaccgttcggctcgggagcctctcctccctgctctctcccgggccaagtcggcacagggtggggaggcgtgaaatgagaattgtcctcatcgcgctccacaaccaatgccgcactaactacttgcggggtcgccgctaagtagagtaacaagggctcgtctggctccggggcgaccagaactggggagagcttagacatgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactctcaaaagtttccgctagatctgagagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgtagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactctggatggaagacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccaccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgctgcctcggggtggcgggggcggaggcgccaagcctctcgtcgccaccctcgggcttgtacgcagcggcgaggtggtccgcgcgctgctccagacaagcgagcgcgactttgaggtcgccatggacagagatggggccaccgcggcccggcatcttcatctgtaggtaggcgtagtggaccgccgccatgaacttcaccaacgcgggcctccctaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgcccctacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgagggccttctgcttggcctcacttcgccgattaccggaaggaaacgccggggatttgccctctcggcgctcctgcctcctctcctcctcccacttcctcgtctgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggcgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgccggctcggccattgggctgaacaggaaaagcttggcgcacacgaaagagtgcgagagctcagaaaatccctcgcagagacccctacctggcgcgccagatgacggagcgcggggctcctcaccgggagaccgcgtaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgttttgggagatctgtgtatgaaggagctacaaagtatgagccagccgctcccttgttctgggttccctatctggaaaaatcagtcccctctctcagtgggctaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcaggtgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagcttcagctggggacgagcgcctagaagccctcgtcctgacgggatggggcgaggcgtgcgtcagatcgcctgtcgccacctaacccgcgatttgaccggtctgtgactggtcacagaccggataaacgagtgcactgcactgcgttacatgcggcgtgacacgctcagccaaaccgcaataaatgtggttaggtgagccccactgtgctcacctaacccatacacgcggatcaaaaacccacgaggggtcggggtgcctcggccctcggggccgaggcgggtgcggcccgaccccctcgggggactaagaggagggcgaacacatcaccctcgggcccgacgtccctcgggggtgccaggccacgtgtgcgattgtgtctgcctcaaacctctagtcatgatactcctgatcccatgtcaccgacagtgaccgaccgggaaattctttctgggtactcacgcttggcctagaacaatttgggataggtgaccgaccgggaaattctttccggatgcacacgagtgaggacaaagtgtacagaaaagacttgtgttggtctgtgagggcagactatgacctatgaaagttgccagatgtaagcgggtccggtataggagaggcgagacattacaaattgtatgtatgattttttgctgcgtagttatacataagttaaggaacaggtaaataagaccaagtaagatattggcaagagaaggttgagaatgcaagttgacaacatacaatatatggagcaaacctttcacggtaatgttcgaatagatgttttgaatcaatatacagaacaaacctgaagtttgtctacttttcttgtattcttgtttttttttcccaaggccacttatttatctcctgccattccacgattttttaaagctttgttactactagaacgatgatgttaactatgagtaatatctcttgtttggtcgttgtctcagctatggctgcaactcatatttacccttgctgtagtataggctactaaaaaatgtttatgggttataaaaccacttcataacatagataatagagttcctcataaaaagagataatagagttaaaaaaacaactcgctatactttaagttgcaataacatggttgtgtaaaagtggcaatgagcttttggtaggtgttgttcaaggttttaggatttatccccgttcattcgaatacgtagttagatggttatatatgcttacaatgtttacttccgacggtgtgcacataagcattcatacttctactagcttggaatagagtgatcatg

SEQ ID NO: 71607 - DNA, 1392 bp, Oryza sativa
ttgctattgaggtatgcatgataagctattctgaacccacaatcaggagcaatatgaatcttatttttttctaacgtactgaaacaatttccctaacaacattcttggcattttacagtcgtttcataagatcgagaactttgtcattgaacataccgttgacaatccggttggtgactcccaggctgactcacgtgctcagaggatacagaccttgtagaattttgatcttttttgtaccttagtgttaccttgtagcgctgttgagttatttgttcgttgtaccgacaagatgatgaaaagaaccggaagtgtattttccttgtaaactgtaaagaaaaggaataatggagctaatcagaaaatcagcgtttggttgcaataccttggggattttggccttcgttcttcactgaacagctgaacatcttagttccaaaagatgaagatctccatctgaggtctcagaaaaatacaaaatgccacaggagattctaccggaatcctgaggctgagacgaactgggcactggccttctcaatcgtccactcaccgtcgtcctccatggttttgttttggataacgatgggccaatccgtagttggcgcctaatcattgtcacagatacttcgacgtcgccgtagtaggggcgctggtagggcaggatactccgatgagatcggcacaggagcaacgcgagcatgtgctccaaattggcttgacccaccgggccaccgagcgcgtggagctgagtcagctgactaagcacgccgatctccacacaacgacggagactgttgcgcttcaatccagatcctccgcagtcctgctcactgacatatggcccgaggatctttgaagctcacatgtcagtgagcagtactgaggaccctcactcgttgtgcttggccgcagcggagaggaatacgccaacgccctgctgcttgctcttgcttgggcatcgtgaagccccttgaggcccttcctgctcctgtattgtactcgacgcaatttacacggagactgctacagatcggtgttgcagtgtgttatcaagaaatgtttcacatgtttcatccctcgctaaaaaatgtttcaacaaaaatgttccagatgtttcactaccaacgaaaaatgtttcagtgcttgagaaaaaatgtttcaaacaaatgcaacattcaaatatactgattgcaacactatgctccagatgtttcactaccaacaaaaaatgatacagcgcttgagcaaaaatgtttcaacaatgcaacattcaaacatgctgattgtaacaccaagaaatcaatgtatgcaacattgagtcaaaatgaaaatataacaccttaatacaataaaatgcaataaaaaaatacaaatatgattcaacatcac

SEQ ID NO: 71608 - DNA, 635 bp, Oryza sativa
tatagggcgaattcgagctcggtaccccaaagataagcatggctagtcccctacggtatctacggatactgtcaggagagacatagcgctgtctttgatctcgccggatgcggattcgaggaggaaggctaccctgttgtcgactacgagtcagcacttcagatcgccaagtcgacaacagttagataggctacctcaaatattatactggtgtgattatggtgcataagagcaacgaccggcttcagccaaccggagtagggttattacctgacaattcaggggcccgaacctgtataaaatcctcgcccccatctcttttacctcaatctcgcatatatcctagtaccaatgatccccatactatgcaaataccgtagtcgtgacatcaaacgtcgacagtattgaaatactttccgagtatatgaatgcgaattttacattatgttcgtgttatattgaatatactgctagcttatctgggagatgcgttggtacgggtataatgtttggttatgcaattactctatgtcatgaagatgatattagagtagtatctagtagtttaggcgtggtgtctagattacgggatattattatttacggttatatgctgcggatgagaggtgggccga

SEQ ID NO: 71609 - DNA, 1562 bp, Oryza sativa
attggtgatatttggaggaacacatggaacgggtgcgttgattcggtcaaaaaaaaaaaaaaagcttgcaagtaagaaattaggtggtaaggctggcttcgaatggatcgaatactgcaaaagttgtgcctctttctgttgtttgcttttgctatggcgtccattttggttcagattttgagtcctattgttcggattagattgatcaaaatggataggttgattgggattattattggaaaggtaggaagagatgaagtttcgcctatgattggtccttctagatcaagccaatcctgaaaattccacgaggtgtgatttatgtcttcacaaatttcagacaaattgacgctcctcgttatattgttcctgtgcaggtcatgaaacattgcataactcggttgatgaagccctcttgctaaaggtactgcataatcaaatcaaaggcgacactggagtttgcttgttttcttccatcactctatgttctaaccatctgttttattttcagagaaaatcagaagaagttctcttctatttgaatggacggtgtatttacctagttggttagttctgaaacttctcattcctccaaattatcagcactgaaaaagatcaatatatagatggcatctgaatttctggttgataaattaaaacatgtctgcaggaatgatgggttctggaaaaagtactgtgggaaagatcatgtctgaagttttgggttattcgttctttgataggtttgtatttttgctatttgccaaggagatcttgcccttggtgctcatggtaatctaagcttttatatttctggaattgtttgcagtgataaattggtcgaacaagctgtgggcatgccttcagtcgctcaaattttcaaggttcatagtgaagccttctttagggataatgaggtaatctttttttctgaatccatcttctgctaacatgatctactatcttagcatttgtttacttgtagttatcagaaggaaaatctgagactgattattttctctgtggctctcttttatgcattacagagtagtgtcttgagggatttgtcctcaatgaagcgattagttgttgctactggaggtggtgctgttatccgaccagttaactggtatctggagttcacttctatttttcctgttggaatagtttattttgtggcttctcttattttgattaacaatattgtgatctctttgttgtattatcaggaaatacatgaagaagggcctatctgtttggttggatgtgcccttggacgctcttgctaggcgtattgctaaagtggggactgcctcccgtcctcttctagatcaaccatctggtgatccatacacaatggtgactacttggcccatgaatttatgccatgcatgaatatgatattatttcagatgtatttttttaaatttttaatcagtcaatataggctcattcattcaatgtagaaatgaaaaactgcaagtatgatcctgcacatctgcacaactggtagtgtaattctttcatttcagtgctagtatgagttgctcactggattcttc

SEQ ID NO: 71610 - DNA, 511 bp, Oryza sativa
tcgatgccgtaggcgtggaagaggccgtagccggacgccgactcgaagagcaagtacagcgccatctcgccggcggcgtcggcggcggcggcgggttgaggtttgggggcggcggcggaaggggggttagggttttaggggagcgaggggaggcggacaacggcgcgggggtggatgatttatggctcacgctgggttctccgcagccgttggatcgcgatcaagccattaggtgattattgccccttttttttctcatttctcttcctctttttcctttttgtttgatgagggtccttctttttccttattattgcatttttttttacaatgatttgaattattgatgagaaagtggttggttggatagtaacaaatagagtaattttcactttggtcaccttttattactactggtgttttgttttggaccacattttaactaatgtttttactttgatccgggtaattttgcatttatgttattttggaccacccttaacttcttttt

SEQ ID NO: 71611 - DNA, 603 bp, Oryza sativa
ctaataaaataaatggtcaaacgtgtcttaaaaagtcaacggtgtgatatattaaaaatgatggagtagctatttgatagtaagattgttcaattgtgtcattattttcttctcacttggtttagcaattatagtacaagaggtagtgactagttaaaacaaaaaaccttgtgagactaagcgaaagtaggggtggatatcgagctggctcggctcggctcgctctagctcgttagaataacgagctggctcggctcggctcgctatcctaacgagctaaaagtctgtctcggctcgggtcaattgtaagcttgagccagctcgtttagctcgcgagctagatttggacgacgcatgcccagagctgagctggatctggaagggcgagcgaacgacggactccatggccgacgagtcaagaaggagcaccacatagcagcgccggccagacctcgtcggagcagtggactccacgacgaccaacaaatcgagcaggaggagggccacatggctatggcgcggcggtgctggctggacctcgtcggagcgacgtactcctcgggcgacgaatgaaaacacgcggatgggaggtgatgccggcaa

SEQ ID NO: 71612 - DNA, 563 bp, Oryza sativa
tagaagacgtgtgcacctgtcagcatggttggagctgctgtcaaccatgaccacgagattaggagaggatgcagcggtggccggtggcagtaggcggaggggaggcagcggccgtgcgcccgtgcgacgctggaacagcgcaccagattggcagtgcactggaatggtatactggacacgtggcgtgattttaccatacgcaaacttgcgttcaggttttgccacgtggcccaatcagcgccagggtccgatccctgaaatcggtataagagattgatagcaactggcttaacttcaatcgttgaggtattggaggtaattttcataatgtgcgtaatgatccatatgctaaatttaaggttacgattccctcttttcattgtgcctatgatgctgaagcttattttgattgggaaataactgtagataaaaaatttagtgcacatttattcctggtgagcatagggttaagcaagctactagtgaatttaataattttgcaacagtatgatggactcaaataagtacagatggactagcacctacaacatgagaagtgttaa

SEQ ID NO: 71613 - DNA, 732 bp, Oryza sativa
catagacaatcttgaaagctcttctacggcgtggattcaaagtgagccaaaatgcgtcacaaaaataagaacaagggttaaaacattaaaaaaataatcctgctatatgcaatgatttagagaggcaatgcacaatgatttagttctccttcaggctttagtcactttatacaaaaacacaaaaaagaccaaaaaggaaaaaagaaaaccaaaactattttatatataaaaggcccactacaagtaattacccactaggcccataaaggaccactacaagtcattacccattaggcccatcaaggcccatctaaaatttctagggtttcctcatcctcgatggggtttatccttcgagcacatatataatccgcacgccgccgcctccctctctgcttcgcactccattttccctctccccgctcgccgccgccgccgccgccagccaagctcgccgctcgccatgggtaagcctccccctcctctccctctctccggttcatctcgattagttttagctctcaatcccttccggatctgaccgtttcttggacaaatgtcagcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatgtgcgcctccttcctccttctctctcgctcgtt

SEQ ID NO: 71614 - DNA, 970 bp, Oryza sativa
gggaacccgcgcgccccggcgcgggcgaagttgccggccccggcacggcggcggacaaggggaagccggcggggcggagggtaacgaaggtaagcgaagggtgcccatctcgtcggcaggtggggagtggtgcgcggcggagtggtggactcgaggagtgcggcttggcttggcttggctttgcgctggcttgggaggcggagaggcgagaaaggaaaagaggggtttgggtgggggatggacgggcggggatctgctggtctcccgatcggacggtgaaggcgctcgagcgcgcggcgtggcaggaggtgtgtggccggcggtggggatgatgcggataaggaacggatgattgtgagtaggctgatcgagacgggaggatagacagaccgccactgcggcaacaacgtctactctgtccatcttattaaaaaaccaatctaatattagacgtgacacattttaatactataaatttagacatatatctagagacgcggtatggagatgaatctggatatatctctaaggacacggtgttgagacgggcgagtggattcttcagagatgggagcatcacgagaggctgcgtcacggaaggatgctatagctagaaaattgaagggttaattggatccatgccactgcaaatgtggcaaatcaaaaaaataccactactattcacgttatcgggtagatgccactgtaatcttctaaaattagaaccatgctactcccgtcactattttcggcctcctctctcacgtggtcatcctcctcactcacgtctgcaaggggaaaaggcgacgtggtgccggcgagcggcgaagatgaggcggtgccagcgagaggacggggagcaggcaagcagcgaggaagaggaggcgctggcgagcggtggaggtcaagaccgccgccggcaaggatgctcgcggggaggtcgtggaggggcgcggggagcgggcgcagt

SEQ ID NO: 71615 - DNA, 538 bp, Oryza sativa
aaaagggagcacacgtgccttgaatcttctgcagaaggtgaggtcgctccaggtgttctcgtccaattgcaaggcagcgtcatcgtcctcctccggctgaggcctccacacgacggcggtgacggaggagttgaagaccaccctctccatggtgtccgtctgcgcgcacgcctccagaatgttgtgcgccgctcgcacctccgcctccaccataccctcctcctcatcctgtttttttttttttggtaaattcaatcagttaggattaacataatacataatcaagccaagtcattctcatgctcctactccggccggtagttcgccggaggagcagtgtgtacatgcaaagcagggcaggggcattaattgattgacgcggaaaggctggttggtaggtgcagttattagtgtcatcggtcatcctcttctcggagccagctagctgaaactagaactgtggaactggaaggaggaagaaggagctagatagatgatgatgatgatgatgatatgaggcgcgccattgcccattaat

SEQ ID NO: 71616 - DNA, 529 bp, Oryza sativa
caaatatgattgtgcaatataatgatcaaccttgtaatcgaccaagaacagctccgcttgctagcccaccaacaacggagttcatgggatcatcaggtgttgaagcccgagcatctcttgcaagttcacgtgctcctgaatggaaacaagcacatgcattacataaacatgttgatatataatatattcatccagaggctccatgtcccttattaacatgagcttacagaaaatataagtgctgcaataaatgagaagacgctattccaccttttacaaacatgtttaatatgttccctaaaatgaaaatcatagtccaaaacgaacagtgcaaaagtatgtattctaaatcccactaaaaaagttatgtattctaaatagtagattaaaagccacaagatagaacttgtacagttgtagtaccaagcagaattaaaaccaatgccagattctgatgtgaaaaggacaacaaatgttcatacttcatactgtgtacaaatgtaagcaataatagctcaaaacaagttca

SEQ ID NO: 71617 - DNA, 44558 bp, Oryza sativa
caaaatcccttatattatgggacggagtacaaaaatgactatgcaatagaattgtacatactgcttgcatttcttgtgtgtatctgctggtcatctcagtgaactttgccaaaacctgtgaatctcggaatatgaaaaatgttgacagctgacgcccagtgcatagaaagaatgtgagggaaaacaaggggaaaggcagcaaccacatacttctctgtactcggtctcaaatttggatagctctgctcgttttgtgagtatctttgcctcaacactctggagcttctccttttcagcagggaaagattcaccacatacaacctctatagtatagttcacacttctgaagaaattgtcacctgagtgaagcgtagagtttaaggggattcgtactgtcttaagtaattgacactgcaccaacaaacaaagtgattaccatagacagcaaagaagtgtgtgcctggttttagttcatttatatcacatggttggaagctgtccaatcttttaaagaaggcactatcaggatcctttgcagcagctgcctgaaattaaaaggaacttgtgagaaatgaatcacagagaagcacttggaggattcaacaacgatgacacatatgtaaactcaccaggttgttttgttcaaaacgatacacaggaaagccaagaaaatacatcccagcagaagtaaccttcccagtctttacactgtcttcctgcgaaaggttgtgcagatggaacaagagaaaacaaacttaagccacttgcatattgcatgaagcaaaggttgtcaaagcaaaaacatattcaccggtttgctcattacatggtgttacagtttaatagcgaattcaatagacaagagtataggactactcaaacttgtttgtgaatctgcaggactgacaactatgcagcattttatattgctacatagttgaaactatgataattttgcagataataagctaacttttaagtcatttttgcacacacaatgtttaaatagcgagaccaatttcttagtaatggatagtttagatagggattgcgcgcaaccccttgaggtaggcagggttttaatctctatccaaaacctctacatgctcagatgtaaagctgattaaatttatgtgcagaagaacaggattctggcactcttacctgcaaagcaaggctcaggccaccattttcttcaagctcaaagtaaagcaactgaaattgtatgcaagaataacaatgttaagggtctaagtaaaggaaaaggacattaaaccaagagaattttatgtattcaatcaatagtattgaataaatgttttacatgctaagcattgtgtgactcaactttatcaaagccatgagataacaggataaacaaaagctgacataattattacagaaacacatgtggatgatgcatgttgtattccatcatttaaactgccagatcaaaataatttcattatcagagccctctcaaagaacccttccaaaagtgaatacaacaaaacaatatttttttgtaccataggtgtgattattctatatatgcagcacagccagtacttattgatcacacagaacatgcatttaaaggacaggttaccattgtttattactccctccgtttcatattataagtcatttgacttttttcctagtcaagtttgactaagttcatagaaaaaattagcaacattcaaaataccaaactagtttcacaaaatctaacattgaatatattttgataatatgtttattttgtgttgaatatactaatatatttttctataaacttggtcaaacttgattagaaaaaaagtcaaacgacttataatatgaaacagagggagtactatatgtcaaaagtaaatcatctaaatttcaccaactgaagggcaaattttctcattgtcaaacaaggatagcttcactacgcaggataaatgtacacaacttgaacaagtctagatcaaaataaattaaaacagaactgacaacaccagaaccgcatgaaatgtacttacgaaacacaggttacatgataaaacatttgctaacaaaaaccaaccttaaatttgcttctatcagttgatttcacacgacaaactaaccccattttagcttccttttctgttatgtcaacagaataaaaatgagctgattgcttttccacctggccacatgcagctttcaattatttagttgctaacatcaagaaaagaagcattggatgatggacagctagttgccattacctaccttcctgtgaacagagtttccaagctggagctgagaaaccataaccgatccattcaatgcctcctctaaaactgttgctgatacggttgtctttatcggcacaccaagtttgctgcacatacgtacgcacagttaagaagaaaaaaaaagcagcataacaagctagtagcaaacagtaaaagaaatataacatcagtaaaatgtttttacctgaaaagagcagcaaacacggtgttcacggtattgagactcgataggtccagctccaattcctggctatcggcttcgatggcctgaacaaattgcaccagttgccataacatggtagattaaaaattaccagttcatgcaagaactaacctcaaatcctgatgtgtcgtactgccgcctcttatcgggatctgacaggatgttgtaggagaatgtgacttcctggaacatgtctgatgcaacaggatcatcgccattcttgtccgggtggtacctgcctcaatttgcaaggaaaacttctgaaaccattgcaacattgatagcaaagcaaaaaaagaagaaccaatctccacacaagaatggctagcaagattaaatgcgcccccaaatccctccaaaagttcactaaacagtaaataagctcctataatttatcttatctcgcacgaattcccgcgagacgcgttcatctaggactaggatgccagaaggatcgaatgagggggccgaatctgagggtgaggcggggagtgctcacttgagcgccatgcggcggaaggcgctcttgatctcctggtcggtggcgttgcgccccacgccgagcacctcgtacgggtccctcctctgcgccgccgtggcggccgggtcccccttctccgacttgaacgacccgaacctcgaacccgccatggcctccgcctcctccctgacctctcctccgccgccgcgtcaacccctcccggctcttcacagcagcaacagcaacagccgcgtcgcgctcggatctcgcgccgagcggtggggggcggcagtggctgctgcgctgttgcggccggggcagtaggcgcaggctcaccgccccctcatccccgtcgcggcgaagacctccgccccttctggctcgcgccgtagcagcggaggcggaggcggagtggaaggcaaggggaagccgcgcccgcgcggcggtggcgtgaggtggcggcgcgacgcgacgcggcggcgagcgaggccggcgaaaatgggaggagggaggcgtgggagtgaggtggtggtggtggggggaagaggtggcatagtaggtgtacctcgtggtggggccgtggggcccgcagctcagtgggtgttggtgtagtgtgggccccgtcagttgtagccattcgctgtacacgtgacagcggttggcctggccttggccttgtggccttgtgggggcacgcctgtcagtgatagcggccattattctctactagagtatatatttttctctttgaaacattagagcaagtttaatagtatagccaactactaactctaattcatctataaccaatctaatagctcattcatacaatagttatatactccctctatctcaaaatgtttgacgccgttgacttttttaaatatgtttgaccgttcgtcttattcaaaaaatttaagtaattattaattcttttcctatcatttgatttattgttaaatatatttttatgtttacatatagttttacatatttcacataagtttttgaataagacgaacggtcaaacatattttaaaaagtcaacgacgttaaacatttagggaaggaggtagtactacactattaatatctggtcccacatgtcatatacatactatgtcttggagtccgtgctatatttggctacaaatctatagcccactgcttttctctcttcttatttatctctttataatatgtttgtagctagcttgtagcctgctattgtacctgctcttaggtacatctaggagtactccatatctttgatgttagtgatagcagctattagcctaataatctctctttttttttttctttttaactgttttgaaaagcaaagtcgttctctttcctctcctttaaagaaaggtttcaaaaaaactcaagtaaactgatccataaaaaaaccacccaaaaaacttatgatcccgttatagcatacttgtagtgatcctccaccatcacataaaaacatttttggtctcataaaatccgtaaaccttgataaacagatttctttaaaagccaaccatcgtaaaaagaccgaacaacccaccattgcaactcatgcttcatctctcctggagttgaagcccaaccaaacagtttcagctccacataaactaggagcgaagttggatggaacactatcacaaaatgaactagagaagtggagctaggtttagattgctccataactctactccagacccaacttctatagctaaatttagaagttggagctctaccaaacagagccctataactacatactctctttgttttatattataaattagtttgattaaatacaaaatattttaataatatgtttgttttgtgttagaaatgctatctttttttatgaatttgaaacttaaataaattgaacttgagaaaaggtgaaagtgactcgtaatatgatgaaacagaggaagcatttatgcgaagtgagcgttccgattagatttcttgtggtgaaaccaacccactcagattcaacttagacacaggtgctcggctattttgcggtaggcgacgtatccgtcgataacaaggcacccgtggtgactttgtaaatctcaagatatatcggttcagtcttctggctatgctcataggggtaggatgtgcgtgtgtgtattcataggaggtgagtgtacgcgtgttgtaagcgtcttcgattgcatattgttttaaaaaaaacggaggaggtatgtatgaagtttcagttgccctctcgcccctggcatgtggggcccgtgtttttgattgatgagccgggcccaatgaggctgttgccgaccggagtgactccttttgttgcatttgcacggttgctcacgcctttagactttatcaaatgatgatacttaataagcaaacataagtagtgaacgcttacatgttcttgtagtttaaaactgtcatgatctgttaaagtttatgttttaggctgcagcttatatagacagagacaatgtaatagtaccgttgttaggtaacatcatcacggttttctttatgcgaggataacaccaaaagctttagacctaacctaaccacttccgtcaaagaaatgacaccaccccataaatttctttgggcttgagctaaataaattagcccagtgaataggcttcagatcacaccactgattctcgaaaaaccgctgagtagcagaagtgagatttttttagaaaaaactccgagaaaatggtcaatttatcatattattttcattttaattacgctctagcctacttacttagcgggtcaaccgatcaatttccctaaagttaacgatttcttaggtttgggacttttgagctaaacagattttaagcatttggggattattcttagaatctgtttggaatgcattttttgctacggcttataagcgaagatacgttgcaacctccatgaattctattcttatatattatgttcatgtaataaaatcagctgtgttgctatatatttttgtgtacatgtgtactcactaactttagttttgtgctttacaatttcattttcactgaattagatggatagtataaatatatgataaaatgtttcttcgaaagaaaatccaatttcaccttgtcgcatcgcattattttcttgctgtctatactcattacatagagatgacattaacaccatcaatttaaaatcctagatctgaccctcgtagtttatactttataggcctacccctccgtctcaaaataattcaaaggttgagttattttggaacgaagagagtacacgagtatgactggtcgatccaaatacttcaaaactataagttaagacacgtgatctaggatttgaggcaacgaaaactaattttaggatatgacttatacttttacgtttaacattttcaaaagtcatggctgaaaaaagaaaaacactaaagttaattctaaaattaaaatttggctatggatcattagagcttaagctatattgacaggcgcgatgttactacagctcctttagttgatgacatgatcaatatttgaagctaagaccatagctaatcatgatctatttcctcgatttgtactgttaaggtgcagaaaaacgtgcatacaacattagaccactatagcattatttactgtagctacatatattgccgatcgaacggtgtacgtgcaccccaatgcacgggcgatgcgatttactgtagctgcatctattgctgatcgaaaggtgtacgtgcatcctaatgcacggacactgtaaaacctccgtagatagttgctacggcagaggatccatttccaattgatcaaggatatatgacagttgtttaaaaaaagatatatgatggatgcaggtcctctagaatgctagatacatatgagcctcataaatcctcgagcctatatatacaagtgagcactactacatactccctccatcccaaaaaaagataaaccttgagtttccgtgtccaactttaactgtccgtcttatatgaaatttttttataattcgtatttttattgttgttagatgataaaaatgattaagggcccctttgaatcgcatggtagaaaaaacggaggaataggaaaaacacaggattctgacaggaattgaagtgtaaaacagaggattgcaaaacacaagaaaaacacaagaatggtcgtttgattggagcacaagaaaaacacaggaatcggatgagagagatagactcaaaggaaatttttcaagaggttggagctcttgctaaatttcctccaaaatccacatgcaatgtgccattccataggaatttcataggatttggaaagcttcaatcctttgaatcaaagggccaaataggaaaatttactataggatttgaatcctatgaaatttctacataaatcttttgattcaaaagggccctaatactttgtgcgtgacttgtctttttaatttttttaataattttttcaaataagacagatggtcaaacgttgagcacggaaaccagggtttatcttttttttggacggagggagtatgcaatactgcattaaataatactgtagaggatctagattgatattgtatttaacagtgccctgatgatgcccattaagtaggctcagtaagtcgctataaaacccacttaataatgtagttatatttataactctatttttactagtcaatcaaaaataaactactatttctgatgaaatttttttgacatttataataaaattcgatcatctatacccacaactagcgtatagggtcggcaaaaagtgcgagaagactttaccttttttttaagccacacaggcaagtcctcacacaagataaatacgagaattaaatacccttattatggaatatttcatcgctctatctctatgatatattaattaatagtaataacttctcttagaggctttaaaaatatatattaacttttttttaaaaaaaatccgttgcaatgcataggtattatgctagtacttttaaaattcagacaattaataatttcccaaatgcttagttctaaaacaaaacaaagggtatacgtagatttgctaaaaagtgctttcatgatcataaaacttagattttataaagttctacaaattgatggttggaatcttaaaagtttaaacagatcttttcctaaacattgaatatttatgacaagagggagtagtatgctagtttttttttttcagccagtggtacagcccacttgtatctctgttagcgttaagacagatcaataactgtaaaaggcacttgactttcactccagatgttcccattaagacaagcctctcaggttaacttgacagagtgcattgcaacctaaccaaagatcaaatcaaatgattcgcagtactaaacttcgtgtaaagcaagaagcaaactgcccagctgctccatcacatcacatggcagcacattgctctactccaaagcatacggtaccaaatgtgcatcaaggtccagtacgttgtcaatcaagattttcaaaagcgactacagttaagtttagtactgaaacctggttgcacaattgcccgtcccattggggcaggtggggtggcgagactcagatgggattgcactgatggtgaccgagaacatatgctgaatctaagtgacataccagaatctttagctcaccgtcagccactgcttgcctggaaatcacaagcctccttgtcaggcacaagacatcatgtgcaccagaaaagtcgaggatacctggtgcatacaattggttttggttgtggtctgttggtgcctttttctctgtttagcgcactttagagcaaaaatgttaggattcctttggtcagtgtaatcaatgagatatgtatcgattaagtcgatattcccccagtgttttgcttctcatccaaagttccaaactaaattccctagctagtgtcacttacatggtagaaatgagttcatatcatacaactgaagcctggaagctctctagtctctactgataaaacaagaaaccgaacctgaggtttccatcagatgagacatttcagcgcataaatccttttaccattagcattgttgggaggttatgacaccaccttcagaaaatatcaataaccacaaacaattcctacatttgcaaaagattatgtcatgaatgattgggtggagactggaacagcgattaggtatcatattttacatcattcagagtgcttttgccagtaagaaagtagctgcaagcaaggtcatatgattaacttacaatatcccaacacaataaagagggcatgattcccataggcaaataacacagtagaattttcattgaataaatttcatgacaccagaataaaacagcattgtaaaaactcagcatgttacccatgaagtataactctctttatttttgacataccaactataactctcttttaaacataggtacttccttaataagcaagaagcaagtaatagttgacctctctaggataaattttgggcctatattatgcactttaagatgtgcagcagaagtgtagtgcttacgaaaattctaaagttgagaaaccagctcatgatctaactttcgaataataaaacagctagttgaagaacatttactggagagcacaatatagttggcacgcagcatatacatatcatttcgaaatgggaccaagtagcttaccttggctattggcctattgcttcatcttttcttcagtgcaacaataacttgctagggggcacatagaatttgaaccggtggttttctggcctcctaactttttggaacatgattgacagagctttccatgagttacaaatagacaattcagatcaaattttagatcatcaggaattttgctgttcagatgaagatatgccctctctctgctagctgttgcaggaacccaaccaatagcgtttgtaatacggagtacctattatagaaatgtatgttattacatatacgccatacacactaaactgacttcttggtatggacaagaaccacataaagttacacatacatgagtatctactggaaaatcatccttctgaagatagaacatcagcacacacgccacctgtcataacatgcataattgcatatattagaaagatcatcagctatatgcacacttactcaagcagccaatatagtattaagcaagcaatcaaagagcgtaaaaagatattataaacattcacaagtaaggtcccttctttgatttgggaatgctgtttgaattccactgtcaatcataattgcaaaagtttccattgacaactccagccatgattgtaactaccacccttagtagaaggaaaatagttggacaattgcactccgaatacaagaatctagaagaagctccatgccattgcacggaggctaccaggcacctgtttctgttagccattcattgcaaagcaaaactggttgttggtgactaacacccatccataatcacacagcaatatttaagtataaccgacacaagcatatgatttcagtcacaagggcatactttctctaatttccttttcatacaacttagtaccaacactactgttagccaaaatactttgcaggcttttgcggaaacttgagttcaggctgtattaacttacatggcaacaagaaaagcaacttgctttgcttttgatcattatctaccatcatgcaaactacaactacttctcactagtcacattttatcaattcctcatccttcacaacaaaatcaatactagcattctctacattacgatgaaatccaacaggacgaaaaccaaattcgctgaagaaacaggagaagagagagatggaactcacagtctttggcccgatccctttgaaccgagatagctcagtcttcacctcatccacggacagatcccgcaaatactcgaggcaaatcttgcctcgcctctcccggacgcccctcagcatcgcccttatcctcgccgccttcgtcgccgcaagccccccgcaccggatggcgtcctccagcctcttcccctcctcctcatccaccacctccaaaaacgaaaacgaatcgcgcatcagaggacacgagggagcttctagaagcttcctggatgcggccaccaaacctggtcccaggtggggaacgcggccttgagggcggcgaaggcgcggcgcgagatggcgtcggtggtgttctgagagaggagggtcgtgacgaggccgtcgaggacggtgggcggcggagacggatcgccatccgtgtcctcctccgggtccggggatgtgtcgaggccgaggcggcggcggcggcggcggaagggcgcgaactcgtcggggaagccgtggaaggcgaggagggcgtcgcggacggcgaggcattgggcgggggaaggggaggggtggtcgtggtacggctccggcgagggcggaggcttccgcttgggcttccgggtcatctcgctggcctgcgcggcttggccggcggcgccgtggaggtggcggttgccggcgacgaggtgtggtgtgggcgtgtggccgtcaataggtgaacaaatgggccgaacgtcatggcccggcccagccacgattaggcatggctcctgtagcgggccgtaccgtgcaggcccatgtgctaaggcgtcggcccaagcacggtccatggaaaatacgggcagtgccggcacgggcccaaatatgacatgtgggccggtataggcccattatcacgtttggcccacagaatttgaatacgaggccgaaaaaagagaaataagataaaaaggaaaattaaaagaaaaaaaaagaaaggacctgtttactttgatgaaaaaaaccttaccaaaatttgccaaaaattttggcaggatttcttatatagttaccaaatttggtagcaaactaaatgtatccactattttggcaactttattaaaatttggtaaggttgaaaatgtcatcaaagtgaacaggcctaaaattatggggaaaaactagaaaaaatgacaaaaatagtgggaaaaagaaaagaacatatggaaaatttgggaaaatgagagaaaatagacaaaatatattttaaaaataggaaaaatggaaaaaacagatgaaaaattatggggaaaatttggtggggcgatcgaccatgcgatttttttcatttttaaatttatttttttaatatttacagaaatattatatcggcgaaaagatttacaaaaatagacactaatgctctccatttgggtggcaagctgacgtggcacacggacgcatgacggtctttttagggggctgcgaattttgggcgtggcccccttaccgccctctgtttgggcggcaagaggcctccgtgcaaaattcgcaagggcggcaaaggtctcatatgcaaaaagaaccatccaattgcttttttggcagcgcaaaaattgcatttagccccttaccgtccttacagagggctgcaaagagtctaaatgcaaaatgcgcacacgacaccgttacgacgccgtgtgccacgtcagcttgccacccaaatggagggcggaagggtctatttttgtaaatcaatccgccgatataatatttctgtaaatattaaacaaataaatttaaaaatgaaaaaattccgaccatgctcgtacttgggccgtagcgtgctagcccaatggaaatcgtgtcatcctgtgccagcccatggactcaagcgtcgctccaagcacgacacggctaaatgggtcgtgccggaacaacccacgagtggccgtgcttgggccgactatagtgctgtcttgtcaggccggtatgcctcggcccggtccatatggccacctagccgtgttggtggttggagtgggcaggtttgaggtgaggacgtcgaagagattgaagaaatgggccttgccgtgcttatgggccatgctgaaaagatgatcttggaccaaaacatgaagaatctctttttaaggcttgatcatgctttgtaatggtacatgcccttcccttataattaaagaatagttggttggacagattaggaataaagcacggcctacacctatataattggggattgactggatgggtggattgagaagaaagtaacaatactgcgatggttaagcccaataaaaaggaggacacggtaagaagggaacaaaagcaggaagataaatgtagttccccctgctttgagaaaagagaaaaattattgtacgggataccgtccgaacggaatagtttaatgaagtattctatgacttcctcgatacggacataagtcaacctgatttcgtgcacaatcatacctccagcgacacgcggacatgagcagctaagtgtgttgcaggcctgcaatcctcatgagtactcgtgggcacgtgacacgagcagacatgtcacaccagtatctgagttggtgacaatacaatatgataaagctaggcaaatcagtgtatttatgggtgcatgttcacactgagaagacatgggactttaatagtatttttttaatcgttcgtctctttggaaattgtgctgttctcattccatgaattgtacaagaccatatcccgtttggacagaaatatgtatcagttcttgatatcttttaggtatcatgacctaatatctaactggtatcaggtgatacctctcaagtattacttgatacttggtagaaatcgcgtggtacctaattggaatcatccgatacctgatgagtatcaccgtttggatagaaatatgtatcgggtagtcctaataccagtttctgatacctgataagtatcaccatttggacggaaatatgtatcctgtcttgatacctaaccggtattaggtgatacctatcaggtatcgagtgatacctcgcaagtattatatgatactcggtagaaatagcgtgatacctgattggaatcgtctgatacctaataagtatcaccgtttggataaaaacatgtatcaggttctgatatttttcaagtatcatgtcctgatacctaaccggtatcaggtgatatctatcaagtggtacctcacaagtattacctgatacctggtagaaatcgcgtgaaacctgattggaatcgtctgatacatgataaatatcaccggtgatatctcacaagtatcatatgatacctattagaaatcgtctcaatctagttagtactagtagaatagcgtggtaataaaatagttgatgatgcactacacatgcttgttctgacctacaaactcaaggagaagcgctagatacacgtgggggccaaccattaattcctatgtgcagatttttgtgaaagccatgcatattgatacgtcaggctagccgagtccatctttgatccttatccatatcttgctcggggaggtggaggtgtcatttaattatcctgttcggacggaatgccgtgcactagactccctcttgagaaaaccaaactacccattcaggcaggcttcgcatcctctgccgttccaactggaacggcagagagctacagtgccatgcctttgggggcatttatacccgttggatcaagttttggatgcaagagtttaaacactacagtaacgatgaaaataattaatatatatttttcactgtagctacagtattttccactgtagagactgcacggcactgtagcttccctcacgtttaactgtgcgcctttgccgttctccccccaacggcagaggatgggaacccatttaggcaagactagattgcggtcgacatcttttgcttcaaactttattttggaccattgaaaaaaaagtatattttggaccattctttacttaatattttcatttttagaatttatcattattgtactttagacggaccatctcaactcttttatcaatcggcatccaacatcttctccacgtgggcataaggcacacatgggagagttccttggtgtgcaagagctgctgtgtttgaggttcttgatgtgttagagttggagaaaaataaaagttagggtggtccaaagtataattgagtctgcactctggaccatctgagccgaagacggaaggtatgaaccattgaaagcaccgtcggcccttgccacgaaccaaccctgatttccactcttgggccgcttagtaatgctcaattgcttttgagcacgcctaaccggctatgattatatatttttcaactagtgcttgtctaaactcaaaagatcactcattagaagattaatagtgttgagaaaaagtccattttactcctttagactatctccttgaagaacttaacctcctaaataatttctcagcttattttacaccgagaattattgaaaatggttcacttacttcgtaatagtatttcctgttgtattcttcaactccaaacttcaacttcctcattttccgttagcacatttttcaaattgttaaatgatgtgtattttaaaaaatagtttctatataaaagttgttttcaaaaaagcaactaaatctatttttcaaatttataatagttaatacttaattaatcatgtgctaatgaggtttctcgttttgcaatgaaatttagcaggaggattgatagatgtgttataacttacctctcaacaaattttctttagaaatgctttatcattgtttatatatgttgaaagcgtctgagactggtttaaacatcgagatttccgaatagtcatgataacttttgaaactattttggtattctgatatggtgttatttatggctctataaaatttcagcttaaaatatcactcgcataaagagaaacaaagaggagaactgttattaaagtaaagtgaacatttttaatagtttagtggtaaaatgagaaaaaaatatatttttagtggttaaatgattcaatgaaatagtttggagaagtaaaataattttttttattagtgtttcttgaatattcgacttcttttttacgttgaatgtaagacatgatttgatcacgtcaatatggattatcaaaaaaaagaaaaactatagctatgaatttaggagattcgaaattgttgtagctaggtcgacatggcgctcgagaactttgttcatgaagctatatctagctagccttgcacctttaatttctcggtactgaccaattcatttcttgcctttccagcgcattcaaaaaccagaaggatagtactgatactgatgctggagtattatttgaacctttcccgcagctcaacccattctcctttctcatctcgaaaacaaaaagacagggcaaaaaggaaaagcgatgaatctacaggttgaactttgccgtgcttttgctcctctcttctctttcatggagtaaataaagcactgaagaattttgaactctgaactatgctaaacaaaatgttctttctcatctctgaataaagcagtgaagtttgtacaaaaatcagaaatctgtctgattacacactggctaggatcattagctgccccattcttggcatcgtccgcagcagcatcagatacgtaattccagctggtagcaacctacaggctcatgagctgtaccagaaattctctctcgagggagagaggagcagcaaactaaattggaacacgaaagtcaagaaattcttataaacaacagtgctccattcagacagcaaattagttgagcttaataagttagcgttatcttaatcactgggacacatcccgtattttccgtatcagtctggcatcatctcgtccagcagataagaaaaacgccattgacattctctatgttgacccaagtattgggaggaagctatgaagccaattattgcagttcttctagctaatagctatacatgggtatttctgcatacataatatgtttttgtacatgtgcatttctgaagttcttcgttgtagattcagtattgcaaaatcttagtacatgtgtaatttttgcatacataatatgatttgtgttggtaagttgcttcatatttttcttgaagctttgtgtgtgtgtgtgtgtgtgtgtgtgttggatttaccccaaatttgacgttgattcaatagtactgtatgttctttaaatattgtcagttattcttgagaaaagaaaacactctccttaaacatagacagctccaaggtacaactaactgataaaatgctatttaatcggcatcatcagagagagccaacacatagatctcgccacgataagttgccggatcaaaacttcaaaagaacattatatttttatgagccagcaaggaacagaattcagaatctgtctgttgatcataaacaaatcgagagagatcagagcagtaccaattcctatttcctaagccacaaatcccaaattattttaaccaaagagcagccaactcagcacatcttttgtcaacgagaagcctattagccttgtcttatccgtcattagaaaaaaaaagttccatcatgctgttctaaacaacgatttgctctcttctctgtgccgtaccaccattagctgctcgatcgagacaagtgtaaaacgcacactaataattctacatgacctcctaacaaccgtgtgtttgtgcagaaatgatcaaacaatatcacacgattcaactctctccatgtggcaggatgactggatccaacctgataggtgacagcagcaaccgttaattggtgaggtcagtgctgattgctgaacaaatcgtactgtaaaataattttccgagaacagctgtttcagaacttcagagatcttcaggccagtaggtaggccaatctctttcctccacagatcatgccacaagttgtctcttactagtagtaaacattgttcagagatctttaattaatctctcatcctggtgcagttaatagtcatttccatgccttaattacgaggggagctatcaaggaaagaggcgtgacactgacactagcacagacaatgacactgaagccaggctgaggcacagttactgaatgggatccggattccctatcttaagttacacaacttttacatagcaaagtatagagaaaattttcctgggtacccgtgaaacttcacctaatcccttttatgcccctgagatttgttcattccctatcatacccttaaatttcagtttggatcccttttataccccttccattagttgaccgttagttgacagttaaatttatattataaagcccattttgccttttgatataagaaaatataaatttatgaagtatattgatggagggtataaatttattgtatgcgactattatatgcataagtttattttgtgagatattatttaacaaaagtaatattttagtttcgcatcgcaaagggaaaacaaaataatttttatctatgataaaatctattttagataaaacaaaaaaataatattctttaccattgaaaacggtatatataacatattttgttatactagtacggatttttaaaagataaatcttgttatgcgagataaaagttatttttgttaaataatatctcacaaataaactcataaatataatagccgcatacaataaatttatacactctatcaatatacctcataaatttatattttattgataccaaaaggtaaaatggactttatgatatgaatttaatggtcaactaacaatcaactgacgggaggggtatagaagggatccaaactgaaatttagggacatggaagggaatgagcaaatctcataggtatagaagtgattgggcgaactttccgagatacacagagaattttctccaaagtatacctacatgtcaatagctatatgttcacctatctaagatcacgttctatatcatactttcctaacttttccaaacttgtttttcgtgtgtatgcttctcaaacatttaaacaatacatttttaaaacttcttttataagaaagttgcttaaaaggtcatatcaaccattttctaattttaactaatacttaattaattatgcgttaatccgctgctccatttttcttgcgggaagaaaatgtttctaaccttttcaaaagaacaaaaccttaagcaaagcgagcctaactcaactgattagattccttgtgatgaaacttgctcactcgggtatataccaaacacgggtgcccacccatgttcaagtagacttgacataagtgctcacatttacaactagtttttttttcacgacgtactcgttgacatcaagacatataaagtgactttattaatctcaagatatgccgcctaattttatgagcacatactattgtactacgttttttttaaaaaaacacagccttagggcgaaggatcttgttccgacttaatgatgtggtagcgccaaaagattaccttagaggctagtagtatatagatgtgtcgatcttgccttacaaaagatcactgcaaagcagatcgccgtgcgcctgtgtgtgctttgcttgcctggattctttgcctgtaacctgatcctgtcgcaaagacacagcttaagtagttaagtgtaagcatactttgcagttttgagccatcactccactcgcaaaaagtggccaaaaggagatcgagaaatttaaaaaaggcaaagctagtttaaaatcgaagggaattgtttgaccgattttgtttggatcatatggattctttgatgcttttctcccaggacgtgccttccatgccataagctcagcctcagctgtcgctaaattctatcgctatcaaagagctcgtgcacaacaattcgtttacggacagaagcaactgctagtttttatttctattttttaatttttgcccagctgctagtagaatatatatggaataatggaggttttcagtttccagttatgaaaaaaaaaactttacgtcataatacgaacaaggcctagctgttgcattatgttactggaaggtatttttggaagttgcaacaagtcacgatatcacataaatttgcatgttcccttatcttagatgaaatttaccatttgctagtgaaccaaaattctgtctaaaacaaagtgaacgtaacttgattggttagcctcgttatggtgtgcaacttagggcctgtatagatccactggcaaaatttttcaccctgtcacatcgaatgtttgatacatgtatggagtattaaatataaacgaaaaataactaattacacagcctgcgtgtaaattgtgagacgaatcttttaagcctaattgctacatgatttgacagtataatactaccgtaaccatttgctaatgatggattaattatgcttaataaattcgtctcgcagttcataggcgaaatctgtaatttattttattattagtctacgcttaatactttaaatatgtgtccgtctattcgatacgacaagctaaattttttttacccctaatctaaacaccgccttattatccccctttgagttttcaacccatcataatcgtatgggtgatttgcgcgtgcgaatatgagcgtaatttttttgggactgtatttaaaaaggattttttttgttaaaaagcatttttgtaagaattttttttgttactagaagtattccagctaaaaaagtcatcgtctcccaaatggcgcgtcttgaaacgctgtagcgattggcgttggcgaccaccacaagtagccgtcgctacaaaccacggtgcgcagcgcatccaagcaaacaaaccaatcacacgagacgcagccgacgaacgcgtccatggccaccgcctggccacggtggcggccgtcctcgccgccgatgccgtcctcgtcgtcgtcgtcgccgtcgtcgtcgttcacggcggacccgccggcggagttcctctgcccgatctccgggacgctgatggcggacccggtggtcgtcccgccggggcagacgttcgagcgcgcctgcatccaggcgtgcgccgcgctcgccttctccccgccggccgtcgccgccgacctctcctccctcccgccctccgcctcctcccctctcgtcctcgtccccaacgtcgcgctccgcaccgccatactcaactggtgcgaccgcctctccctcccctaccccgcccctctctcccccgacaccgcgcgcgacgtcgtccgccgtctcatgccctcgccaccgcctcccccgccgaggtcgcaggcgccgccgcccccgccgccggcctcctccgtccggacgaggagctactacagcgacgacctcgtgcagcagcagcaggaggcgaggcgggagggtgggtctacggaggagaggatcatggccatgctcggcgctggccccgcggagcaggaggcggcgatggcgttgctgcggaagatggcgcgggagaacagggagatgcggagggagctctgcacgccgcggctcctcgccgcgctccgcccgatgctgctgtccggggacgccggggtccaggtcaacgcggcggcggcgctggtcaacctgtcgctggaggcggagaacaaggtgcggatcgtgcggtccggggcggtgtcgccgctggtggaggtgctccgcagcggccacccggaggcgcgggatcacgccgcgggcgccgtatacagcctcgccgtggaggacgagaaccgcgcggccatcggcgtgctcggcgcgatcccgccgctcctggagctcttcgcgtgcgccggcgccgcccacctcgcccgccgcgaggccggcatggcgctgtaccacgtctccctctccgggatgaaccggtccaagatcgcgcgcacgccgggggtggtgcggacgctgctcgccgcggcggaggcggcgagggacgaccgcgccaacgaggccgacgccgccgccctccgcaggatcgccgtgatgatcctcgcgaacctcgccggctgcccggacgggaggaccgcgctgatggacggcggcgcggtggccgccgtggtgaggctgatgagcagcggctccgccgcgccggggagcgcggaggaggagtactgcatctcgtcgctgtacgggatgagccgggggagcctgaggttccgagggctcgcgcgcgccgccggcgtcgaggccgcgctcacgccggtggccgagggcgccggcggcgtgggccgggacatggcgcggcggacgctccgggcgatgcgcggggaggacgacgaggcggcggtcacggccacggggctgctcggccggcagtgggacgacgggagcgtcgtgtcggaggggctcgtgtcgatccggcggccgccgccgcgccggagcagctacggcgccggggcgtccgggtcaaacaccacgcagttctgaaaagtcaaagtcttcgcttctcttcttttatttctttcttttttatttctttttttttttgctggctcttgttgaagtatttggaactgtatttgccataggccccaaaaaatctggtggttaactacttctgatgaatggtgttggtgtaattggatggtggattcttttgttggaattaagctgtaatttaattggatctttgcacatgttaaattctttatgactgaatagtggaacctagaactgtgacacctatccaaattaggtctgtacattaatccatcggttctcttagaaggtatgtatgtatgtatgtgttactgggatttctgagttctttttcctgttcttgtgaaatatttgggatgtcggtgttctttttttctaaaaataatatttggaagttgtagcatgtaaaaattctcagaatgcatctacttgtttagcttccatgattgagtttgattagcacgagatggtttcatctacggtttacgattccgagatggccttccgtttcgggatctggcggaattacggttttcgcgaaattcggtgtaaagccggtagattctgaataaatttcataaaccaaaatttgaatacaaattctctgagtttacggataagcttgcgaaaaccggtcggctttgacgaaattccgagtgaaatcatcgaaatttcaatcggtaactagaaaaagaggtaaactgaaagtgttcccctctttttaattcattattattttatttcccattataaatttcactaaatacatggaatacatcattttttaaaataatatatcccaataggttctatgaatatcatactatttataagattttatttattttttcctttttatcaattcaaatttgaatttgatgaaacttatcaaaatctcagacggcttctactttcgagcctcgtcgaaatttcgaaatttcgcggaattcgaccggttttcgtcgaaattgtgaaccctggtttcagctgaagttcggaaacaagtatcatctcagcatttcatggttgtcaccaactacaaattaaattttacattagaaaccataatatttctcggtatcttctcaaccaatgcaaactcaattaatgctgtgtttagttccatcaaatatatggacacacatttaaagtgttaaatgtaatctaataataaaacaaattacataaaccgtatgtaaactgcgagacaaatttattaagcctaattaatatgtcattagcaaatatttactgtatcaccacattatcatatcatggtgcaattagacttaaaagattcgtctcgcaatttacacgcaaattgtgtaattagtttttttttcaatatttaatactctgtacatgtgttcaaacatttgatgtgacggggaaaaaaatttgccagtggatctaaacaccctataacaaatagtatgcgacagtgcaaaacttttgatatgtcgggtgtgttcttaaggtaaggttgggaaccttccgtcctagcatgaaaaacgaaacagtagattagtgcatgattaattaagttgttaactaaaattttaaaaataaattaatataatttttaaagaaactttcatataaattttttaacgaaaaacacaccgtttagcaattcggaaagcgtgcgtgtaaaaaatgagaaggtaaagttgggaaccttaagagacgaacacggttctagaactcttttcattggataaactttgacaaacaaactgtttaaagcgctgttaccaaagctagtcctcattttgaatgcatcattcttttcccaaattacatgtaaataaaacagagttcatgtggaaccctataaaatccttatattccaaaagcctagaagtagaatttaaggcaataccattccttcttccttcgactcttcacttctccagaagaggtcaactcttggcactctggcaatgtcttcaccacatctcagctcatcgaaccgttccacacaacagctacttgcgtaaatcccccatttgacataagcaaagactataaatccagcacgtaactgcgcgtaatcaacagcataataataaattaattgtaaccagttgtaggcattcataatcctaattggctcggataatgaagtatgacccattgagttacacattttaccttggttttttagcacattttttaatactaaactatacattttgtgagaaaattttctatataaaaattgttttaaaatattatataaattcattggtcaagtttaaaataattaaacctcaacatcagtgactcttattttatgcgttggtacttaatcttccgtccgtcataggttcgaatgtggcctatacattttcattgatccatgagatcttccatttcttatgaagttaaattaagggtgaatagccaattcaattttgaacttttgctcacggatcaaattagttcatggtgttttgtattgtccaaacaaatctctaaagattgtcatgtgactaaatatagccattggacacacttgacatgtcacatcattcatgcatgtacagtcaatatttaagggcctatttggactgatgttattttcaatcatatcattttttttataaagttaccaaaaaatgcctatatttagtttgttgccaaacttaatttggtaaacacgtaagaaatcatgacaaaattttggtaatattggcaacttgccaaaatgttatcagtaggtttattttggctacaatctgaacaaaccctaaatatccattttacccttacattttcttttaaaaaagagaaaaaaaagaaaaaacatgaagaaagcaatcataaaacaaaagaaaaataccacattctttagttaccaatgcaacatcttttttccaatggccaaatgcctttcttttactaattctttttatttatttcctacggagaatgtaagggtagctagatggatgtttcaaatgttgaatttgcatgcacgggtgatgcggcatgtagacgttgtatccaaggactatattaaataacataataaagtttagggacttatttggataatacgaaataccaaagactttatggatccttaagcgaaagtttaaggatcatgttgtttgttcacactttaattaataacactcattatttaatcaataaaaacaagaacaacaacaaccaaaaaaaaatcatcttgtaaaaagaaaatttccaaggctaccattcaaccagctgtccagattcaacttaaccctgtcctgtgagacgctctctaaccgccaaaacgaccagaccagtgtgtgcgcctcgccgttgacttgaccacgtgccatggcgggcgccgccgccgccgccgccgccaccccgccggaattcgtgtgcccgatctccggcgagctcatggccgacccggtgatcgtccccagcggcgagaccttcgagcgcggctgcgtcgaggcctgcgtggcgctgggcttcaccccggcggcgctgccactgtccgtggacctcgccgcctcgccgccaccggcgctcatcccgaacgccaacctcaggaaggccatctcctcctactgcgaccgcgtcggcttgccgcgtccgctcgccgtctcgccggaggaggcgaggggcattgtccgccacctcatggcgatgcgggagcctggtcgcgccgggggagtcaacggcgagcggttcgagtcgtcgtcgtcgtcctcgccggagttcgcggcgttggggttgaccttggaggaggctgttctggtgaggctgctcgacgacgagccgagccggcaggagggcgcgctggaggcgctgaagcagacgctgcgcggcggcgagaacggggtgaggcgcgcgctctgcacgccgcggctgctcgacgggctgcgccgcctgatggggtccggccacgagggcgtcagggtcagcgccgccgcgtgcgtggtcaacctctcgctggagccggcgaaccgggtgcagctggtgcgcgcggagctcgtgccggtgctcgtcgggctgctcgccgcggcgtccccggagctccgcgaccacgccgccggcgcggtgtacagcctctcgatcgaggagaggaaccggatcccgatcggcgtgctcggcgccgtcccgccgctgctgcgcctcctcgcgagcgccgccgacggcgaccgcgcgcggcgcgacgctggcatggcgctgtactacctctccctcgacgagatgaaccggtcgaggctcgcgaggtcggccggcgcggtggcggccctcgtcggcgccgcgggggacgccgcgctgcgccgcccggcgctgatggtcatggccaacctcgccggctgcggcgaggggagggaggcgctcatcgacggcggcgcggtggcggcggtggcggggctcatgcgccgcgccaccgtggcgccggggtccacggaggaggagtactgcctctcggcgctgcacgggatgagccgcggcaacgtccggttcggcgggctggcgcgcgccgcgggcgccggcgaggtgctccggcgcgtcgcggagggccccggcggcggggtgcggcgggacgtggcgtggcggacgctgcgcgccgtgggcggggtggccgccgccgccaccggcgagtctctgtacggcggcgaggacgccgccgccgccgcgccgtggatggacgacgtgagcgtcatgtcggaggccatggcgatgccgcagttcccgagacggctggtggagcacgcgcacgcgcacggggcgccgccgcggtcgaacaccacggcgctcgacaggctcaggcaagcgcccaacggctgacgtgtgggtcccagtgtcagtttcgtaccgtgctcgaacggtttgatctttttctcattttgcttaagaaatggtttgcttaaatttgtatatagtgtaaggaaattagattatttggtgatagtattgttgattccatatttcttgctaagcttgtatatacacatttccgttatgtgtgagaacaatttcttcgtatttatttacactgtatcatataccaatattgtcaggcatgtcccaaagtactggaatagacatattacatgtttcttttgctagtactatcttatcagatcaatggtcattgttggaataacaaattcagatcaattagagaagctcagtttccataaacaaacataataacgtttttattcaagatgaacaagatgtgttcacagtatgtaaatatgtacatagcatatataattaatttactgtttatctttacaacatacatataaacgtggtgcgtcgcttaggatgacttcagcaaggcccggttcctgcataaatcataattatgttaaaaaatggtttcttggcaatagatcagatgcacattgtaagttcatatctgcaagtttgttgtatactcacttctcatattcaaggtattcagtgggggatataggcttaggacccccaaaccaatcaatcaaaaatatgtttttgatttccaatttgaagatttggaaatgatgattctttggccaacctatcaaacagccatacatgaatgttgtcataaaataatcaccagttaatctcacattagtaaaagacacaaagaaatacttggatttaccctccatttcaggatgtttagtaaaaagtgcttctttggccaaatctgcttcagatgattgagggtcaatcaacttcaactgaaaacatgcaattcactggttccattacaacttagtaagtcaagaaatgatccaactatatcacatctatgtatggttcttatggctgagattaaatgaagtgcctatagcccctgctacttgcctacttcattgatctcacatgtcacaacagttttataaactataatttcttgatgaaatatcatctacataactttataaaccatgatttcttgaccatctgctgttttcttgctcacagtgaatccatgatagataatttgagaggggacggacacagttaggaacgtgggggaaaaaactataagacaatggagtatagttgttttgtctctcgatcatggttatcatattgtctactgagggtatctccacaacaactggaagactaggcgataacttggtcaccagtccacctagttgtgaagaaaacttgcaaagaacatgtaaaaattgagcctacaactacaatgccacaagctaaaccatccacaaggctccaaagttccaaaagcctgagctctcctgctgaagtctctcaacctctcatccccatgccaagaaattgaggcccaaaactataaagttgaaggcagacaaaacagtgataatgtttggttacgactcaagtccagcagtaagtattcactctacagcaatttataacttcaagctgaattaagtatgaattaataaaaagaaattaactactgtacattcttagaccagtcagcaccaagaaaaatagatataagaagataaccagatcagtcactaccaaagcaaaatagaaatagatagataaacagcaagtgaataatcatggtaccatggatgcaatttgtctgtacctttccagtaagagtaagttttgcacaagttgggttttcaggatcaatcttcccacatgtcccaagagggaactcgctaagggtaaaggaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatagttttattttgcctgcttaatttgaaatttgttttcttagaaatcaaagactatttagaatcttgaatatccttgttttcacctgaacaagtactaaaatattagttaagaaactttcatactttttatgacttttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaacaatttctcaatactaagcagcctcaggcgattagattactagccactaccaacacttggccgcgctaagaacccccaatttcgatcgagccacccattgtcatctcctaaagaaccgaggcatcaaccaatcagtccccccaaacagtaggggatcacgagcaagaagaaggcaaaggaattgggagggggacaacctgaggacgccccacgtgttctgggcggcgagccacctcgcggtggcggcggcctcggtgggggcgggcttgccgccggcggcggcgacgatggggcgggcggcgagggccggcagcggagggcggaaggcgaggaggagcgcggcgccgacggcgacgacgaggaggagggcggggggaagcatcaccggttttcttggtttggtttgtgtgctccgctcgatgggagactggaggaatcggaggatttttcccttcttcgtcaattgtgaattgtctcttccaaattttcttggttcttccggcggatagggttgttgtcgtctgaagcggcccggccggcgataggaacgtctcatagagatggaggagctgataagggtacagagaatcggagagagaaagactgattgatttgcaagcagtgtctttttgcttttggactttatagataaataaacatttcgaaaatagttgtatgtattttagaaacggacttgataaaaagatgtcgacactttttttggctgatctcagtcggttttgctatccgtctgatcgctaaacgtacgtataatatttacaagaaaaaccctccctcattttcagttacttttgaatggctcggattgatttaagattcatgcaactatagtgttttcaccttatactcttcttgacagaatgctcgttcactggatgtcgatgtcgcaacgtccgcctcccccgccctcaccggctggctagaaggcgccaacggcaccggcaagccccttcccctttcctcttctcctccttaagctagcggcagtaaagtgccccgtcccgccgtctttcctatctccgacagttccctatcattggttcccccaccatcgactatcgccttctaaccactcgcttcgctctggccctaccaccaacaccgacccaccgtgctcctccatccttgtggcttcggcaccaccgccgacgtctcaccacctgcccgtgtccactactcactatcgagccgctacctctcacggccatccctttaagcccggcgatctctccttctttctcatcccacccctaccccaacccaagacctcgtcactcgctagagcttcatcggagctagaggagaaggagttgggcacacgaatctccaagcaaatcggttggttcaaaatatatgagaaatatccctcgattttccgttaaataccatcggttggttcaaaatatatgagaaatatctctcgatttttcgttaaatgccatttagcaattacgtgtttagaaaacagttaataaccctaggccttgtaacacttgggcatagcccaagattgggaaattaaagaccactatggacggaaagattgtggtaaattactcatgtatattaagcctactggaatatatcatttaccattgtgttagagagagaaatgtataatatttgcccatctcgtctgttatccgtttttgctatctcttctctcgtgtaagtgaaccatacctcctaattacattgaatcagagtaactgatgtatcaacaacatgttagtgagagcaaaacctttatgcaaagattagcggcaatgttggcggcatgataaaaatccaatgatttgatgaattctgtgagcaaaacacggtcgcatgtgcccatatggcaactaggctcctagtgtttgtccggatggatagccgggcaataagaggacattcttcacaactttcgatccatgtcttgctccatctagatcaagtggtggttcccatgctcttgaggaatggtgtagagtatcatgacgaagcttatcttccttggtgctaggaagatggaacatattacgaagctccagagtccggcaagatatatcaccgcatatcctattcttcatcgagtcacaacattggcaaatccaagcatgggagttcaaatctaatggcggggggctcatgatgaacagatcgaatgaacaccaaagagctcgaagccaagtagatcttgggacggtacaacttaccagcatctggcatacttcctccatgatcaccctgcccaccatcatgtgtagatgaaaaggaaagattggggaaagagagaaaatggaagaggaatatggggtttgtttgtagcaaaatatttcgatacaaatatctctctctaactcaatagaaaataatattttaatgggctcagtatgcacccaacaaattttcattatctttcagcaaatccaaaattttgcaatgtctaccggcaaaagccatgtcctgtaacaaatttttactatactaaagttcattgtaatgtttttgaatatgcataggcatattccacagaccggcctatagcttggctcaaagctaagggctcttctaagttctaaccctataggcttcttgttggtctttgcatgcttcaattcatttgatgagtggattatagtggtatctttggtaccgtatcatctgaccacattcagttcctaccgcctatggaagggttccagaaacccaaaactttagacttcagtccaactctctagctgctccaaaagccactcccatttcagctaaggagtactcttatagatttagggggtggttagatgcaggggtgtaaaattttagcgtgtcacctcatgtattatatagggtgtcgcaaagggtgttcgggcactaataaaaaaactaattacagaatccgtcagtaaaccgcgagacgaattaattattaagcctaaataatctgtcattagcaaatatttaccgtagcaccacgttgttaaatcatagagtaaataggcttaaaagattcgtttcgcaaattagtcacaatctgtgtaattagttattttttagcctatatttaatacttcatgcaggtgttcaaatgttcgatatgacagggtgaaaaattttggggtgggatctaaacagggcctcaagtctaggtataaccatataagctagtccttgtttagttccaaactttttcttcaaacttccaactttttcatcacatcaaaacttttctacacacacaaactttcaacttttccattacatcgttctaatttcaaacaaattttcaattttggcgtgaactaaacacaccctagtccattcaagctgaccctaacctagctaaatcttcatttaattagatgtaagaaataagcgaatacacacctttgtacacacacatcgtacttgctttgatcgagggtgtaaaatgtattttttttcgttgtgcatgatcaactgattgttgccgctgatgagatgaggacgatctgtttgttgcaggtgaacgtcttctgcatcaagaagggaggacactgctttttttcccccgaaacttgttagtagctttcttggcaccttcatatcattcttgttttcctttgagttgatcattgtaatattttgattcttccttcacggaacatcattcaattctttttgatgattctgaatatgtttgccagaatgtataagttctattatgcatttccttttgtgatttctgtgaggttgtgacaagcacggtgggcgagctgttgacatccgccagtgtgccatttctttcttttatgtctcaataatccacatctataacctatcggtttataacttgtaaacggaatatttccccctaatatttcacatctataatagtttataattgtgaacctattataaaaccaacaccgaaatagacattggcaatcaaacgcaaaaatacactaagatccaaacgtggtggcgacatcgtgccatgatatttaactaaagttcagctggaacctatatccccgagacactaattataggcgctcctccctaatccaacataattacacatataagggtatcaacaaccattaactggcaattatactgtttgacttacaacactattggtcaatcattccctcatttgctacagtcgtcatgcggttataacaagtgtctctctatttaaagagagtttaggaagagtattactctacttctattagaatacaatacaactttaatcctaatttgtaaccgactttatatatatatttgacacaaactttaacaaaaccgttagagatcaatggatctgtaacgggtcatgaaccattatggatgatatatcccatgccagtgacacaaatactgtaatgggtaaaaggaaccattattgatgatgcttttcacctattagtgataaggtactctgtagtagtgcctagtaggagagctttctatagcatgaaaaacaaattctgttacaaaggactacagctacagttcgatagcaaagcagcgtattacagaaccacgactgataaaagcaacagcagtagccgagaaaagctaagagattttcacaaaacctcaactggggtacaaagcaattaggtcaccatgttggatcacacacccgtgccagctgcaaaattctatactactaggagtgacattttcaatctccacaaagaaaaatgcgagaacaacttcaaggacagagaacacggtcatgagaaaaccgagggatacataaacaagaaagatagctgcagctattactttcagtatgtcctgccagaaatgcagatgattgcccctccacaactgcattggaagccgccaacatatcgggattgctaagattgacaaaacgaaaatcacccgaccaaacatcagaagaaatacgaacacaccgacggtaatactgaaaataagatcgtcccagctgttgccagagtccaatgttagatcagttgttaccaccagaaatgtaagaaccatgcccacaactgctaggaaaaccagtccagcagacaaagaaagataacggcggcggcgccttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcagccgaaactatgtaatataaacgcaaacgaagaacaagtagaaggcggctaagaactggaatatgcgcggtggcgtaggcggcggcggctcgatccttcggggttgagaaatcttgtatgtgcaattcgtgattaattccagttcctgagagataatcgttgggagttcctaacaatctggtatcagagcgcaaatttgagccactcttcctacaatctctcggttcggctgtaaaattccagttcaaggattggaatccgtctcttcggaggtggaatttccgcgaaaaggcaacttgccttgactggttagctgaatttggagcgggaatttgaggggcaagtgagagagtgtgtagcgccatggatatagaaggaaagttcgatgtactcctgaagaccatagctgagaatgagaagaagaggatggcggcggaagatcggacccgagaagatctgatggaactcaaggcgatggtggaggggcgccttccccaggtagagaagcgggtggaggatctgaactctgccctgggaaagctgaactccaaggtcgagcatttggagaagcagctgccgcgcgtgatgaacacgaacgaagaggtggcggctgcgtccgcagggttcaggactccggcttctgcccagggtacgcatgaatctcctcctgactccgctgctcctttcagctttgattcgtctgcgcaacacagtactttctctgcaatgtccactggagtttgtggtagtgttcctccgatgacttgtccgcagttcaacggtgataatccccagatgtggcgagcaaattgtgaagtttattttgacatctatggagttttaccgcagaattgggtaaaagtggctactctgaatttttgtggtaatgcggcattctggcttcaatctgtgaggaatcaactgattggtattacttggtctgatttgtgcgagaaggtgtgtgcaagattttcgcgtgatagacaacaggccttaatccgacagtggattcatctgaaacaagggggatcagttggagagtatgtagagcgttttgattgtgtaatgcattagttactggcttatgagcaagctgttccgccgatttacttcgttacaaaattcatggaaggtcttagagatgatattagatccatggttctgatgcaaaggcctcaagacttggacactgcgtgttctttagctctacttcaggaagaaactgctgctgaatcaaaaccaaatagtttcaagagatctgatagtggaacttatttgaaatccccacccagaagtgctactcctcccatttctcctaactcatacagatccagtcccagccaatcccctgaagacaagagaaacattgaatcacctagagtgagagaagataggatatcagccctgaaagcttacagaagatctaagggattgtgttttacctgtggagagagatggagtagagatcacaagtgtgctactacaatacagttacatgtggttgaggaactattggaagcaattcaggctgatcctgagattatttcaaatcaaagcagtgttcctgagggagatgaagatacacttatgtccatatcttcacaagcattacatggttctgaatcttctaagtctatcaagttaagaggatgggtgcaaaacagagaacttttaatgcttgtggattctggcagcacacactcttttattgatgagcaaaaaggtcaacacatgagaggcttgcaagctcttcagtctcctttgaaagtgcaagtagcagatggtggccagattccttgttccaggattataccacagtgtagctggtggactcagggacacagttttaagactgatttcagacttttacctttgggttcatatgatgtgatattgggcatggattggttggagcagcatagtcctatgcaaatcaattggtcccataaatggttagaattctagtataaccagcagctcaccaggttacagggactgattcctcagttggatcagtgtgatactatatctgtccaccaattgcaaggtatggctaaaactgattcaatagaatgtatggtgcaactcattcaaactgctgaacaagaaactagtgaagtgcctgctgaggttcagcccctgctacaagaatttcaagacctcttcactgaacccactggcttacctcctaaaagaacttgtgaccatcacataccacttattccaggagctaaaccagtgaacttaagaccatacaggtacaaacctgcacttaaaaatgagattgaacgacaggtggcggagatgctgaaatcaggagtgatccaacctagtcagagccccttttcatcacctgctctcttagttaagaagaaagatggctcctggcgcttatgcattgactacaggcagctgaatgctgtcacagtgaagagtaaataccctgtcccaattattgaggaattactggatgaactggctggctccaaatggttttccaaattggacttaagagcagggtatcatcagataaggatggctgagggggaagaatttaaaacagcgtttcaaacacactcaggtcattatgaatttaaagtcatgtcatttggactaacaggagctcctgccacatttttgggtgcaatgaatacaaccttggccactgtattgaggaaatttgtgctggtattctttgatgacatcctcatctacagtccaaccctcacagcacatctggagcatttgagacaagtacttcagctgctatctgaacacaactggaaggtgaaattgtccaaatgttcttttgcacaacaagagatatcctatctaggtcacatcattggttctgagggggtttccactgatcctaagaagatacaagatgtggttaactgggctgtacccaatactgtcaaaaaactaaggggatttctggggttagcaggatactacagaaaatttgtgaagggatttggagagattagcaaatccctcactcaattgctaaggaagggggttccatttcagtggactcaggacactgacaatgctttccaacatctcaagaaggctctggtatctgctcctgttctagctctccctgactttacaaaacagtttaccctggaaacagatgccagtgagtttggcattggtgctgttctatcacaggacaatcatcctatagcatttctcagcagggctctgggtcccaagtctaaggggttatctacttatgagaaggaatatatggccatactgctagctgtggaccactggagaccttatttgcagcatgcagaatttctcattctcacagatcatcatagcctcaagcacttgtctgagcaaagattacacacaccttggcaacaaaaagcttataccaagctgttgggactgcagtacaaaatatgttacaggaaaggaattcacaactcggctgctgatgccctttctcaaaaggaagacactgttaaagctgaactagttgctatatctgaaggagtaccactttggatgcaggatgtcattcaaagttatgagactgattccaactccacacaattactagcagaactgtctatcaatcccaatgccagacctcattttacactgaagcaaggcatattaatgtacaagggcaggatctgggttggccagaatggtgacctccaatccaaaattattgatgctctacactctgcacccattggtggtcactcaggattccctgttacttacagaagaattaaagcgctttttgcttgggctggcatgaaaagaatgatacagaccagagtgaacacctgtcaggtatgcattcaggccaaaccagacagagccaaatacccaggtttgctacaacccctgcctgttcctgcagcagcttggcatactatctctatggatttcattgagggtttacccaggtcccatcattttaattgcatcctagtggtggtcgacaagttttctaaatatgctcacttcgttcctctttcacacccattttctgccgcaactgttgctcttgaattcttgaaacatgtttacaagttgcatgggttacccaacattatcatttcagatagagatcgagtctttaccagtaacttctgggagcaactttttgcgaggtctggaacaaaactgcatatgagctccgcgtatcatcctcaatcagatggccaaacagaaagggtgaaccaatgccttgaaatttatctgagatgctttgtccatgccactccgactaagtggtcccaatggttatacttggcagaattctggtataacacttcttatcattccacattgaacaagtccccatttgaagtcctgtatggctataaacctagtcactttggcatcagcctcaatgactgtgccataccagatgtgtctcaatggttgcagcagcgcaaatttatgcaacacctgcttcaacaacatctgaacagagctcagcaacaaatgaaacacttggcagataagaagaggagtttcagggaatttcaagttggtgattgggtttacctcaaacttcaaccttatgtccaaacatcagtttctactagagccaaccacaagttatcttttcgttattttggaccttttcaaatctctgccagagtgggctcagtagcttataaactgcaactacctgcttcctgtcacatacatccagtattccatgtctcacaattgaaagcagcccagggattctctcatccagtgcactctaatcaacctcctgatctgaatcattttcagattcctcaccagtttattgattatagagtgactaaaagaggtaacactcccattactcaattgctaactcaatggacaggttgtgatgcttctgcagctacatgggaggacatggaggacttgcagtcaagatttcctcaggcaccggcttgggggcaagccggtttccaagaatgggggcttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcagccgaaactatgtaatataaacgcaaacgaagaacaagtagaaggcggctaagaactggaatatgcgcggtggcgtaggcggcggcggctcgatccttcggggttgagaaatcttgtatgcgcaattcgtgattaattccagttcctgagagataatcgttgggagttcctaacacgcctatttgttagactgtcatgcacaagcagacatgtcgcaaatgtggagcaatagaacgacatgctatttgcagccacgtagctcgagaattcagcatattctttgagcaatggcatgccagcatcctcaccgtctgcaatgtatcccccaggaggagtgaaagcagcagcaaatgaacctgctgcgattagtacggagatacataagatactttgggacacattggtgtaaacgcttgattcctccttgtcttccaagaacctcttatcagctcgatttaggaatctgctggtataagcattacaagcttgtaggcacatggtgatgctggtactagagagctgcacagaattcagaagagaacaaaaattaacacaaaattaaggtgatacagaatgttgaaagagcagaatgcatgacataggaaacgtacccatgataatgaataataacgagtgctcttgttgaaggcaacatctagaggtgttgatcccccatggttaataatgctgagattcactctagtattcatcataagacaggagatgataattgcattgccatgctttacagctagatggagcggtgtgtttccttcacaatctcctgcattcaacaacctcgtgaactttgggtttctgcatatgtaccacaccaccattaaccttccatattcaacagcgcagtgtaaaacatttctctgtttgttgtcaagcaactcatcacagtttaaacacatttccatcaacatacgggtaacactggccttgccggctatagcagcaacatgcacaggaaataggccatcattatctggaatgtatgcagctgaactgttgtccagtagaagttcgaccaatccagtttccccagttaatacagcatagtgaagggcagttcttccatcgatgtcaaccttttcggcaagtgttggctcccagcgcctcagggactcgctcatttctctagtggaaaaagaagtaatataggttatcagttcactaactaaagctgtgttcgggagttagggttgggaaccctcactccccagcacggaaaacggagcagtgattagcgcgcgattaattaagtatttgttaatttttttttcaaaaatagattaatatgattttttttaagcaactttcgtatagaaactttttgcaaaaaatataccgtttagcagtttgaaaagcgtgcgcgcggaaaacgagggtgggagttgtgaacccctgctaaagaatgcagcctaagacaagtaaaaacacaatcaattttctgtatctccagatatgcaaaaacatatatacatagttattttgtactactccactacttaggacatatacgatgaccattattagtacgctcttagccttgcaaattatgaatatttgccgacatggaagagataaaaaagagtagatatagaacatcgttgctatgattaacaacggctcaacattgattcttaccctctataaagtgagaacatggcataacggtgaagaaaaggaataaatagtattaaatagtattttttaagttgatggttagagcctttatcgtcttaacagtataaacggtccgtaaataatatttgtattgtctaagagctcatactagactctaccactgaagcatatcccaactttcgcaaaagcttctccaccagggagatggagttgagaacggcaaaagttatggattgtaaggaacatggacgatttctagttacctttaccgatgtagaccgcagcgtgcaacgcggtttttccatctggccccgcgtagcttgctggcgacctcacaccgtcagaagattttccgatcaatatgccaaccatatctggccggttggacacaaccgccaagtacagcggtggccagtccgctatcgctcgacatcagcttctgcaagaccggtgcgtagccgttcctgaccgcctcatgcatcgcggtcgctccacctgaattccatgccctcagcacagaacgttcaggttcttgcatggctgaagcagcacggacaaggtaatcgaccacatcggcatggccagccctcgcggcacagatcagaggtgtgtccagctgattgttcctcgacttgatgagcgagatgtcgtgagtacatatcatcacgacgagcttcaggtgcccacggctggctgcgatatggagcacagagctgccctctgctgtgacaccttttaggcagcagctctgatcaacgtcaccttgctcagctgttgctgttggccatatgcctagagcctgcgctaagaggtctgcatcgccggtggcaacagctttgagcaatttgtgttccattgtgtgtgaagtgtgcctccctgccatggttcttgcttggctcacagaacaagcgaggcacggggaagtcaagtcagctcttgcaggtaagttccagcccatatataatacagggtcccctgctatcctatcaactgtttctctgttcagacaatatctatgtactagtggagaaagaaaagtattagcttagtcacttgcattcgtaccttggaacctttcctatgaacctcctgttttgttagtattataatcatcatcatttttttaaatgtaacaggaagggttgacccctactgattatattatggtcagagaaaaggactatattatggttaaagaaaaggatatttatgtacaaattaatttgctaggcttcagttgcctgattttagttatctgttcaatcaatgcaaagcagccgtccgttctcgatcctatggttggtgcttcatctttgggcaggtctaatgcatgggtcgcacgggacccacgcgaatgcggctaggcacacatgcacgagggtctaagggggaatccaaatcccaaaaaggcactctagaatgaggttcaaaacacaatctacctttatattttttacatctttaaatgtgttttctgaataatctgaagcgtatatctttttaacaaatcatgaagagaacaacccatcctcctacaataatgatcagctccttgagtactgataccatgctttatccaatcaaatcatactttcatgaaaacgtgaatatatttttttaaagaaaaactaaaattgttagtgatagaataacacatgatattgtaattaacatgcaacaactaatgtgatggctcctatgagaaaactcatctaaaagaagggttataaacaatcacgatgatagttattaaagacatatcttcccattgattacataaaaaataatgatggtaaaagagaacgtagtaatatttctactaatcgacagatcagttggcaaactgcagaagcactaaaaaatttgctcactttagatgccattaactggacctgttcagctcctatatggactggatgcaattggactttgtagttccatttagttttatttctgaacatcatcctcagaatagccatcaaccagtaacagtaaccatcaccgtgcaagcttgagcaccgacgttgtgccctagcactggagtactgaccccttcatctataagaaaagtatcttatcaggtcaaatgtgcaatgaaaatgctagattagaggaatgcacaggcaagagcaccttccctataactttgttgcagaagggcgtattgttgttgctggtacaagaccaaattctgcaacagcagatccagcggtggctgcttctcaattggcattcacctctgtcagtgctgccatcatgatcgtcagagagatcgcccctgagcaccagtgggcatttcctgtgaggataatgagagggaagggagtgaccgcggagcgttcaatgcatatatccgtttgcaaactgaagtatcttctgaagaatttcatcccccgtggcttcttctgaagccaatatactctcagtagcttattct

SEQ ID NO: 71618 - DNA, 672 bp, Oryza sativa
tcgcttctcagctcgagctagctcgtttagctcgcgagccaatacatcgaacagatgcaaatacatattatacaaccaaaatgtccacgaaggcaattgtatctccatatcaaaccaagaaatcacatgctagctcaagtgttcaacaaatgaatcagtattcatggtagctctacctttaacaataatcttgttttctggtggcgatatacgagatcgagcacaagtgctcaacctcctggatccattgccccatgcctgcaacctcctcctgcccgaccattacaccacttgaccaagacaagaacgggagagccgtgcaggtggtcgaggcgctcaagggtcggcggagctgccgccgatggagggagcgtgatgcaaggacgtgaggcgcaccaacaaggcggggccgtgtgtggcacaaaaaaggtcgatctggattgggaatttcggatgaggggaaagaggaagatgaaaagctacactgatcaaataggttctggtctttcctttttgactgttttctttggacctaccgtgggatggattatttttctacatatgggccttggcctactaacttctctgcctatgcttctagctcgtttaagctcgtgagcagcttttatgtgtaacgagctaaaacagctgctcggcttgttgaaaaacata

SEQ ID NO: 71619 - DNA, 1818 bp, Oryza sativa
tcatgagccctgtccctatacagataacacaacaaagaaatagggataggaacatttatattgtttctgacatgctaaatgacaaaggcaacaactctaaacctgtcaagttcttgcaaaagttccatttcccttgaactagtctcctccaagtatttttcacgagtatgtcggataagcagcttcttttgtctgcgtgctataatttcctccctgagtttggacctttccctattgaagaagaacacaaactataagtctataaataagactagcactaaatttgaaattcttctagaattcaaattggtgaaaaaaaggacatttcacaaagataataaagaattttacaaggaactagagctaaggcagtattatatagaagcttatcgagcaattccaaaaaaaaaaaattccagaaagcaaacatgtattagtagaactttagttcaccttagcagacaatccgtgcctcctggagaaaatcacaggtgttatttttttttagctttttagtggtctacaacatgtatagttttttttttaaaaaaaaatccaaatgaagtataatataggaaagtaatgtactttctattttcacaaaaatatactctatgggacaaattgagcctatttactcattagtaggctggtttcttctcttatcagcatttttagacgttgaacaattgaaccaatatccaaccacttgagactcatcatacccaaaaggaacgatcaaaagccaggcatgagcgcatgacatgctgactgggcaggaccatatattattgcccataggccataaacccctaaagggcttggcagggctggtctattaccatgacagaaaaatagttcagttgaaacaaatcaggagttcagggcttacaaggaccgtatatcttcctgaatttgctggagctgcttattaacctcattaccatccttatagtctggaaatagaataatatcataacacatcaaaagtatatcgttaatgaaaggatgccttaaaattcgttagtcttacatgatgacatgtccggaatcatggtgtcctggggatgtacaataaagctgtgaagtgctttctcatttttaacaatctccaattcgatctctgcttcttcaagttccttaatgttatgattaaccaagtgtcagtataaggtgttcaaaacaaaggcccaaaaggaaagcccttgttgcatttctaacctgatattcctgatcagatcttgttgagaagaactcaaagtatgattcaacagaactcaaagaggacagcacctataaaagagagaatcatgaatcgagatagaccagcactgacaagatcaggaaatataatttacagcatcttctggtatagagataataaccttttgaacaaagaaactataatacaagcacactgcagtggaccagttgtgcctattgattgcatgacgaataaaaaaatccacaacaataatagttgtcatcaagaattattcatttgggcaaagtaattgcactgatcctgtcattatcaaattctaaaaatagatgctcatttggctcaattaggagaactagttagctaatttgcaagtattgtcatttatgttgtacagtttaactgtgcaagcacagtcagcagtcagcactgacaacctagtttgagtttttgaactataagcagtgatgtttgaaggcagaggatcaagcaagaaagaagaaagatagccaacaatagagtgccctgaagaatatgacctgaagaatcgattcacggatgcccttaaaatcagtttcaactggtttcgcagtaga

SEQ ID NO: 71620 - DNA, 687 bp, Oryza sativa
aatggcagagaaaagaaaaaggaagggagctcgggtttatagggggcggcaatgtcggtttggaaaccgactttggcggtcaaggcgcgagctggcgctccggctagcggccaaaacggcgacaggaggcaggcagtatgacgccggcggcaggaaaagggggaaaagtagggggagaaaggggcttgtccccttgcctcttcgggaaaaggaggagggagcggggcgtcgcggcagagggaggagggaggctctgcctccgtcccttggcggcttgcgcgggagtgacggggccgaggcgatgacgacggcgatgacggcggggcggtttggagcggcgcgacgacacgggcgacaggtgcgtgcatgggctgacggcggaggcgaccgggcggtcggccaccacggcacgcgcgcgcgggtcgcaacgggaggcgcggcggatggagtggcgtggctcgggcacgcgcactggctgcggggccgagcgggctacgcggcagcaagcgcggcagggcagcggggccgggcggcgcagacgcgacgcgggtgaggaccacgcgggcgcgcgcgcgaacgacgcgcggggagcagcagcgagggctcgactcggcgcgggcggggaaccacgtgggcgcgcgcgcgaacaacggcgcgcgggagccggcttcgcgggcggggctgcag

SEQ ID NO: 71621 - DNA, 1467 bp, Oryza sativa
agatttaagggtgtaaaattgtaaagtgccacatcgagtattatataggatgtcgtatgaggtgtttagacactaataaaaaaataaattatagaatccgtcagtcaaccgcgagacgaatttattaagcctaattagtccattattagcaaatgtttactgtagcaccacaatgtcaaattatagagcaattaaacttaaaagatttgtatcccaaattagtcgcaatccataggattagttattttttagcttatatttgatatttatgaatgtcttcaaacgttcgatgtgataggatataaaattttagggtgggatctaaaattacatacggtacggtacctttgcctcccaaactacctttcctcctgtccattaactataatactgctccttgcctccttggtcactcgcggttgctctactttaaaggttttctcaaaatgattattttctctatttgtgcaaaaaaaatgaaatatgcatcataaaatgctctatattcaggtcctgtttagttaaaaaaaattcatgctgtcacatcgaatgtttagacacatgcataaagtattaaatgtagaaaaaacaaccaattacacgggtaaattacgagacgaatcttttaagcctaattgcgccatgatttgacaatgtggtgctacaataaatatttgctaatgacgaattaattagggttaataaattcatctcacggttttctagtggaaactataatttgttttgttattagactacatttaatacttcaaatgtgtgtccatatatccaatgtgataaccaaaaccaaaaaaaaattccccaaataaacatgcctcattcatgcagcaaatcaagattaatttctatttgttcaacccatacaacatttaaagtatgaatgagtttttatttcacatgaaacgacagagcactttagtcgatgagaattaattttaaaataatagatgtcttggtgttttttgtcttgatattttttgtttatgggatgatcaaattacggtagaggggtattaccattctcaatactcatacacaaggtaaaacacaaacacacacagaaaatattgttatgtagtactagtacgacagaccaaaactacgttaatttcagtatcagtataaactagggaaattaaataatcgaggagtatatactactagcactgtatgtcactacactggatcaggtcagcactgacgggctcaaaccatcaactttgacgggttcagctcccggttagagattagtggtcactgatgacttgagtcacctgtaacgggtgaagacccatcagaattaagagccacctcaaacggcccccaactaaaacccatcacaggtgagagttacctctgactggtcccaaccaaaacccgtcacaggtgagagtcacctcaaacggcccaactaattggggccgtcactggtgtgaaaaaaaaggg

SEQ ID NO: 71622 - DNA, 2393 bp, Oryza sativa
ccctagccggcccggcgccgccgcgcctcccctcgccacggcacagagaaagagaggagagatagagagaagaagtggaagagatagaggagaagtggagaagagggagccggccggccttatctcctcatgtgggccccgctgggagaggagacatatatatacagtggcagaagtcatctcaaacgggctgggacttaaaagccgtttgaggtgagtaaacctcgcctctgacgggctgtccggctgcgacccgtcacagataactagtcacctgtgacgggttaggacttaaacccgtttgaggtgaggtaacctcacctgtgacaggtatcccgtcagagatgtgaggatctggtgtagtgtgtataaacccaaaagaaagaatataaaagaggatgaggcagttggcatctggttatggcgtgcataccactagagtctagcagcggaaggtaggttggtggttgttaattgttgctgttggctggctgctcccaagtcccaactctcaacccaacatccttcaaatatttatgtataaatttcacatatacttttatcaatttagcacaaaactatacattttaagatgtgtacaacagatttaacatcataccttttttttttatgaaactacacatgtaacatcagttttatcataacactacaactttttttgaactctaaaatctgtagttataatttcatcatcactaaatctgtaatttatctgtaatttagtgatatgatatcttaaaactagtcatcctagctaagctatctaatcgtcctccctcgtgggggagatagaggtgcatgtgatgagggatccatgagagaagagccatctctgacgtgggctcacctctcagaaatccatcccttgaacttgagaggagcttcttcatgtgcacgcgggcgtggccagcaataacaagcaggtgtgttcggttgcatatgccatgccaatttcattcgttattgttacaagtatttttttgtgtactcctacatgtgggccggttgactagtggagtagtagtacgttggctagtggagcagcaccaccgcagcacttcactagcggagtataaattgttgccatcgccttgcaaatgcaacacgagcttagctatggaaaaagaaaacacttttaccgtggagacttgaaacaaattaagctggactgcttcaggactcaagaggagagcattcaggtctgaaaacacaaccccagcagtccagcacgcactcgccactctcgctcctacggagtggagtatatccatccatcttctgaaatgcgctctctcctgtaaaaagaaaaaaaacaatctttatttctagttacttaaccaacaaatatatagctaaaaataaaaccccattatttaaatacgtatgctagaaaaaaacatatgaacgaaaaaaaacacatgaatcaaattaaagtagatttttttaattaattctatacgaattgaaaacatatgaaataggaatagaagccattagcatatgattgattgattattaactactttaaactttaaaatggaattgatatggttttcaaaacagctttctatatattttcttaagaaaaaacagcctttaacatttgtttcaaaataagttcatttttatctttatacctaccttaagtctacaaatcaagtaatattatctcttaaatactccttacctaccgtactagtttattctcctaaacatccactctcttttttttaaaacaatccacacaaaacagtgcgacgtttctattgatagagtagaaaaaaaaaccccatccgtctctaaattagttcttttcctatcatttgattcactgttaaatatacttttatgtatacatatagttttacatattttacaaaagttttcgaataagacgaacgatcaaacatgtttaaaaaaagtcaatggcgccaaatatttagggacgaagggaatacaagctattgctctaggagattatagtcaagaaaagaaaaaagcaacaaccacaccacgcgtttacatttgatctagatgttgaaagcaaaacaagcatacaacacccctaagaaacgaatcttctgaacgatgctgaaagcatcgccgtcgcccatcctggggagctaggacgcggttttcacctaaaaaagcattgggaagaggagtaaacacgcaacaatgcccccaagggtcgagaatacgacacccgcaggcatcgtcgttgctagccgaaggctaggcttttaaccgtagttttcctaccctcctgcgaatgcctatcaggttcagcagccaaccaccatctaaagcctttcaacgcgcagccaccgcaccaacgtctcgctgttggccggccatcaaagcaggatttc

SEQ ID NO: 71623 - DNA, 1017 bp, Oryza sativa
tcacgcccactacagatgatgtgttagtattgttttgccatgtttggcaggtcaaaagatctaggttttaaaaataagttttagaagagtttatttttaaaattaaaaattgaaagtttcaaaaaaaaaaaaccagttcatagacattatctattcatcaactatcatatcagcggaatcaagcagctctgctcaacagtaaccatcgtttgggctgtgtttttttctcccttttctcaacttctatttttttatattttgcgcgtatgtttcttaaactatattttacacaacttttttaataaaaaagttcatataaaaatcatattaatctatttttaaagtttatttagctaatgatacgctaaactatcgctctgttttcggtacctcaccttacagcacgtcaacaagagcagcaagcgtgttaggatagggatcggagtcggaatcggaatgcgatggtgactcgccgagccgcctatattatctctgcgacctgtgtacgtagctgcttcccaccgtcatccaaactaaaaatctttctgccacgcctaggattaaggcgccccgccgccgggcgcgcctcccgcgccgcctcccggcgctcaggttctccgtcgccgacgtgctctcgccgcgctacttccactccaccgaccgcctccgccgagccagggcgcgcggcgccgccgacgccgaggacgtcgagggcaggctgctgccgtacatcaaacgcctggaccggcgcgccacgcgcgcgttcctcgacggcctcgccggggtcctggacgcgcccggcgctcgccgccggcgcgccaggtcgctctacctcgagttcttccgcacctacgacggcgccggcaccatcgaccggatgatcgacaccgccgtcggggagtggggcgtcgagcacctcgacgtcgtcgtcctcaggtccgcgccgcgcgaccccccgctgccggtgtacgccttcccggcccacctcctcgacgacgagcgccaccgctcgcgcct

SEQ ID NO: 71624 - DNA, 691 bp, Oryza sativa
tttttccagcccaaataattttttcagcccacaaagctcaactgatattttttcagcccatacaattcagcccagatactatatttcagcacatacaaaatcagattcaaatgaattaacattccacaaatgattgcaatgtcacatgcatttcacattccagaagtcttgaaatgcaatatcattacatccatccaccaattcagtacatatccaaactctcaaatttcatattcctgctactgcgagagcaacagcagcacatctgcaatagcatcacagcagcagtagcgcaatggccaaaagcacagcagcaacagcacaacggccagaagcacagcagcacctaaataacatcccacaagcacaatggtcgcaagttcagtgtcaccaaaatatcatctggaacctaattgagtaggagtgcttactattcagcatctgatgatgcaaaattgctgccaaacaattgagtagtttcttattgtacttgaattacatgtaccccagtggcataatgtatctatgaatcctaaatacatgataagcaaaatttagtagactcaagtaaacccccgcggggcattgcatttacgttagaaaacattggccgcagtttcattgatagaaacagacagagttgtccgaagtccagtgcaaaaaagaacaagtaccttacggcatctgactt

SEQ ID NO: 71625 - DNA, 47932 bp, Oryza sativa
ctaaaatcccttatattatgggacggagggagtattctactattttcttagtccacatggtctttttgtagatcgataatcttctgaaggaaaggaatgaaatccatgcgtcctataccaacaattcaccactgaagaggagttcaagcaggagtaaagctaaatcgccttcaaaattttccaaaggtgaggaggaaaacagtcagagaaaggaaaagaaagtgaaagaccaacccacgggtggatgcagaagtgcagatgaagattcaaacgaaaagaaaaccaaagagcggttcccaaagaagaaatggttaaacattcctttcaaaattgacaggagaaagccatgctgagtgatgtaatatattcttcgctgtgctatttttagtattttcttatgaagtatcctcagtatacttatctttcacctttggtttttgcaggtaattccctgcatcatactgtttaaccaaaatacagagcattttggccctgaccattcataacagaacccctccctggtttattctagaaagattgggtgcaggcctgagatggttggagaaatatttttttcgatccccttgaagctccttttggtcagtggccactcatcgaactgtatcaaaataattaagagaccgagctcgtgatgtgatcgtgagatagaagcatccatagcttgtcatatgtgcagccaccattgtccaattatgattcttttcatcgtatattcgtatgtttagttttgtttcgattccctttgtaagcagttgtaaatataggttcttttcaccatatgcttgctgtacataatgtaccttcttccctcgtctggattcctgatgtgtaagaaagacaaaccatttacccagttttggatttgtcattcatgtgtagtttgttgatgcatgctaagctggagcaaagtattcttgcatcgaactaagttgccgtttttgcaaaattctgaagctatggaatgttgccatgagccataggagatgccaactccatggaatctctcttttaacaagcaattcacatctcaagttgtcaacgattttgctagcactgaatagcgtcctttgagatcctcaggcaaaatttattcgttccaaaaggacccaaaatgtaattgatcatgtgatcgccgtcagcccaaagcatgtaataattacaaaatggattaaaacgagggcccaaaatgttattgatcatgtgatcgccgtcagcccaaagcatgcaataattacaaaatggattaaaacgaggtaacatactattatatgattaattaagtatattagattaaaaattgaaaaatacattaatggttttttaaagcaacttttctatattttttttaaaaaaaacatattgttttagtagttcggaaaacgttcgcgcgaaaaacgagggagtagaaattgggaagaggaattatcgaacgcaactaactcttgtttttattgaattactacctccgttccatattacttgtctttttgagtttttgtttgtcaatgtttgatcattcgtcttattcaaaaaattttggaattattatttattttgtttatcatttgctttattatcaaaagtactttacatatgacttatctttttttatatttacactaatttttttaaataaaacgaatggtcaaacgttgcaaataaaaagtcaaaaacgtaagctattatgggacggagggagtataagataatttcaaattattccatatttccattggacaataaaatccccttttcattttcgaagtaaaaaccgctcctcatcaacaacgaagaaccaataaaaatcgacgattttcgatcaatgtcgtacagaacccggttaatatcgatcggtttttacgaaccaagacctaacggtttaacgaaaatcgatcggctttatgaactctgttgacaccaagtcctgagaccattccctaccactctctttccctccatttgctctcctccaagaagctctcccgccatctaatccttcctccatccatggcgagatctcagatacctgaaggtaagctagctagcaaaaggtaggtgtagcatcgcacgctgccaagaaaccgaccatggacactcacctcgtcgtcgtcctggcattgctcgccgccgccgccgcggcggaggccaagatgtcggcggactactacagcaagacgtgcccgcgcgcggaccggatcatcgccgacgtgctggcgcagaagcagatctccaaccctacgacggcggcgggcgtcctccgcctcttcttccacgactgcttcgtcggcggctgcgacgcgtccgtgctggtcgcgtccaccgccgcggcgcgctccgagcgcgacgccgacgtgaacctgtcgctcccgggtgacgccttcgacgccctggcgcgcgccaaggcggcgctggaggtggagtgcccgggcgtcgtctcctgcgccgacctcctcgccgtcgcggcgcgcgacctcgtcaccatgacgggggggccctactacccgctccgcctcggccgcaaggacgggctctcctcctcgccgtcggcgcccgacgccgagatcccgcacgccaacctcaccgtctcccgcctcgtcgccgtgttcgccgccaagggcttcaccgtccaggacctcgtcgcgctctccggcgcacacaccctcggcttctcccattgcaaggagttcgccgcccgcatctacggcggcggcggtggcggcgccgacccgaccatgaacccggcgctcgcgaagcggctgcaggaggcgtgcagggactaccggaggggcccgaccatcgcggcgttcaacgacgtgatgacgccggggaggttcgacaacatgtacttcgtcaacctccggcgaggcctcggcctcctcgccaccgaccaggagctctacggcgacgcgcggacgcggccgcacgtggagcggtacgccgccaacgagacggcgttcttcgccgacttcgcgcgcgccgcccggaggctcagccaccacggcgtcaagaacggcgccaacggcgaggtgcgccgccggtgcgacgcctacaacggcggcccgcgcggctgatcgcggcgcgcacggtggcggcggcggcggcggcggtgcctcgaagcattgatagtctaatcttagattagtgcaggaagataacacggagaaattcaaattagtaggtataaaaagaaaatatcttgctgttcagagaggaaaaaaaaggggaaataatcaactttcacaagtgaaatcatttcgtagtcatatactttaggctgtgttctaacgattatcaaggcacgaacaaataaattaaatactactccctctgtttcacaatgtaaaactttctagcattgtgtctagattcattaatatctatgtgaatatagacaatgctagaaagtcttatattgtgaaacggatgaagtagtatcaaggtaaaagtaactatttaaaaccgttctctaacaaatgttgattgtcgacgaagaaagttccacttcctgctacagtattcgtatgtatagagttggaacaatcggttagtatgaaatgcaaatgaagatgtagctagagacaggaagaaaaacttttatacagttttaatcctcgtaaatggtatgccatggccagattgggggcggcgtgaacttgcctgatctgtgggtgatgtggctaggcttggcagctagagggacaacgcgatggtctggtgacgatgttgtgcaggtgggttgtgtggtgttggatgaaaattgttggtgaaagccttggctagcctttggctagcttgacaacgacgaaacccttaggtgttgtttccctccttggaggcgtcgttttggcgtcatttctcctccactatcaagaaccttgcctgtgcaacaatggtcgttggtagactccagtgtcgaaactccataggcttagctgtttggcaaggcattcaccttctggcttttgtcttggttgtggtgagcatccaactttcttcgtttcggctaggtgaagtcgaagctacttcgttgtggtgcaacaaagctcggcaacgataacacgttgtagtctctaggggtgctggtgttagctgtttgcaagaagtgtttgcaagaagtggtgcttggttggcttgggttgatgtccaaagcaagcagttggtgttgttttgttcgttttggcgatacctttggcaatgatgatgtaacagctgtgaagttggagctgctatgtcgctaggcgacaagctcggcaatgataacacttgtctcgtgaagtcgaagactttgtgcggccttacgataagctcttcttcgatgattgttttgggctccgtttttgtcttttttttcttagtcttggtagcttagatagttagaatgtgcttgtgatatgcatgatgtgattgtggaaagagagatggatagtgttggggcaccctaggtaatatactatccaatatccaacgtgatcaccaaatgtatttttatcctacttatccaaatacatgtgatggtcacgttggacactggacggtatattacctagggtgcccgcagatagaatattttttgagggcagatagaatattcatatagcaataaacgagcatacaacgctgaaaagatatctatcagtactttatggctcagtgcagtctatatgaagtgggatccacctttgtcgatttcaatacaaatagaccctttaggggataaatgctactagtgtaattatactaggtcggggggagtgatttgtgaacacacttggtatacattgagggggaaagaaaactctaactctaacctattatactctctccgtccctaaatataaggaattttggtgggatgtgacacatttctagtacaacgaatctagacaagatttattgtactaggatatgtcacatcccaccaaaatccattatatttagggacagaggttttatccagattcgttgtactagaatgcgtcacatccaccaaaatccattatatttagagacagagggagtattagggtctgtttcgcacagctccagctccagctccacccctcctggagctggagctcagccaaacagtttcagctccaccaaaactgggagtggagctgggtggagctctctcataaaatgaactagagttgtggaactgggtttaggtagctccacatctccactccagaccaaactcctggagctaaatttaggagttggagctataccaaataggcccttagtttaagagaagtgatctcatcatctcatcaggattgttggtggctatcttctaggattcttccaaatgtcaactcatggtttatgttggatgacttttgcttcgagaggaaagagtggttaatacaaagagtgccctccatacgcaaaatttgtaaatctatagattaaattggttcctctcaaataaatatcgttttaacgaatcaaaaatcaagataaaaaaaggttgaattggccagccaggctaaaaactggataaaccaaaatactaaaaaaaaaaccaaaaaaacctgacatgatccacaaccttaccttcccccctctccgactctccccttcctcgtctccatctcgacaccacccctcccgcctcccatggagtcctccctcctcctcaagcccttcgtcctcctcccctccgccccgcgccgccgccaccatcaccacctctccctccccacgccgccgcatcggcgcctcccctcctcctcgtcctcgtcccgccacgcatcgcccgcgtcctactcgttcgccgtgacccgcgccgcgcgcgagctgttcgacggcagcgcggacaggccccccgggggggtcggccgcgggggcgcgcgccggagggagtaccgcgtggagcagggggaggcaccaccggcggcggcggcggcggcggcggtcaggggcgtctcgccgtacgtcgtcccggccgcggcggtcctcgccctgagctttggtacggcctttgccttgtttcctcctcctcctcctccccctcccccgccgcggcgcatccttttgcttcgccaattcgactcccattgatccaacatgcgtggggagctctgttccctgcacattagatggcatcgtttcacaggacttggtagaatatatctgaatatgtgcacaattaccacagttgcaagctcatgcgaatttctcaagggcttgtaacatttatatctcgcggatatactagtacaccgttagatgctatatattttctccatttcatattataagccgctttcacttttttctagtcatttttttaagtttgattaaatttatggaacaaaattatcaacatctagataataaattagtttcattaaaactaacatttaatatgttttgataatatgtttattttgtgttaataatgttgctatatatttttttaaaactttatcaaacttaaaaatgtttgattacaaaagaagtcgaagcaacttataatatgaaataatgaaacagagggattattatgccgaacttttcatatttttatcacgttatgttacagagcatgtaattttttctgcggtgtgtggaatcaatactaactctctgtttcagaggacagtcatatggagggtggttcagaatttgcttcccgggaagacaaaggaccagagttctggagaatctaccccttctgggatcatgtggtcctttgccgctggttccaatttgtcaacatctgcaagctttaatgctgaaaaggaatcaaggaagaatttaaataagttctataaggaaatcaggactctgaaaaatgttaacatggcaggtaactagagtctatgtgtacttaagttaaaatatttgaaagaaaatgctgaaaccaagctctgagccttcagatttgtgttgcatattgtacacttaaaactttacttactcggcaggtcgtcaatttggggatgagggtctgttttttctagcagaaagcttagcctataacaaggtcagatatccgatatatcatatattgttttggttgcaatccatatatgagcatgagtacatgcttactttcttaccgatttttccttactaatatactagctcttttgaatactttttgaaaacgagttgttctctgtattcacagagtgcagaagaggtagacttttctggcaatgggataacagctgtggggatagaagcctttgatggcattcttcagataaatacagccttaaaatctctcaacttatctggaaatgccattggagacgaaggagctaaggtcttctcaatcttattgcctcttcgtatcattttgtttttgtagattgttggtgtgatgtatactatgcagacaatgttctcttcttaatttcattttctgaagtctgaactcatatgattacataaccatgttattacttaccttttaacttgttatcaaaaggttggctgtttcacattagcaccttttacgagttgcattgttattgtttgcctttatgcctaactggagtttgtacactgtgatagtttatcgattattcaaatactcatcttgctgatattatcattcattgggagcaaatatgatagaacctacccagcatgatatgtatagatgtaaacttaactttaactaagtcctcctgactgaatgtaacactcatgaatacttacagtgtctttcagatatattggtagagaatgtaggtatccagaagctcctattgaacagtacaaatattggagacgaggtttgtatctctccctccttccctctctctgtctctcttgcactctttgtgtgttgtttcatgcgcgtgcactgcaatgtaacatgatattttcttttcagggggcaaaagcaatttcggatatgttgaaaaagaacaagacgatacgtactttacaactcagcaacaacacaatagaatacagcgtatgtatatgtatccacttcatcgaagacatgcacttgaatcacaaatagaaaagaaaaactaaccatatgattgtttattgaaggattgctatttactatatctcctttttcttggagcagggttttgcaagtattgcagaagcactccttgagaataatgtgctacggagcttatttgtcaagttagttgctcacaacccagtggctttatatgtgatatatgatgagtgtgcatatgaagttgtgctgagatactgcggtagtgattacattggtagttcattttctggaactaactgacatgtactttgtctatttactctagtggcaactatggtggtcctcttggtgcatccagcctagcaaaaggaattctagggaacaaaactttgagggtacaactccacacatacttgatgaaatacttcagtgtagtttgattgttcgaatgtttggtaaagttgcaaatcttgtgagcaaaccagatgccattctatctttttgtttttattttatattagggacatacaatatttatattggattactgatggggtaagtacttttttgtatgaatgatatcacatgcaaccaaatttctctcctacttctttctgatggtttcgtactatattgactttcttctcaaatttaaagttgaaatgctgagtggatgtttaaaaaacgtgagcacttaaaaatgtgacattctcaatattaaaggatgcatggcacaagatggttagaccttctctttttcttttttacgatgcataagattgttagactagcttttgcacttataatcatagatacctacaagcaaaaaaggaacccatataatagatacatgcatctccaaaggcatgtgaagctacatgtactatcctataccctttcaaagtgcgttgaatttaaagtttgcagcaatcatggggagcagtgcacagttgtgattgtccatgtactgcacccgcatttttgtgctgaactctctatgttgtgtaagaaattggatcaaattgccagcaatacacaacacgtgcatcttaaaggccagttaattaaattttactcaatttaaggaaaattgtactcctattggaatatgaaatttttgtcacatactccctccgtcccataaaaaaccaatatagtattggatgtgacacatcctagtactacgaatccggacatacctctgtccagattcattgtactataatatgtcacatccagtcttagattcactttttttgggacggagggagtattggttagctgatatccttaaactccttcaacaccaataccatgtattactaaaagcaaacaatgtgttaagaatccatgcaagttacaaccttttgttcaatagtaaactaggaaatttttccatgagctattgttttaccatttttctcaattttcttttcgaatgtatggtattttgttcctgtcttacttaattagtcaggtgcacattcattataccataataactagattgttgattgttttaaacctttgttaggaacttcatttgcatggcaatggttttgggaatgagggagtacgtgcattgatgtcagcgttgtctgctcacaaaggtattttctgcactaaacaaatcaactagtagcttcttacgggattagtttacccctattttggccttcttggatgaactacagggaagatcactgttttggatattggtaacaacaacattacctctgaaggttctcttcatgttgctgagttcatcaaaaggacaaagtctttactatggctcagtctatacatgaacgatataagtgatgaggtagtacttctgttatcatttacctgttctgttttatgccagtgactgaaattttctgattgctacatataataggacatgatcaagctagagaaatttgcttatcaaacacccgcaagattttattaagcatttaatgatgcttatgccaaaccaatatataatttctgctattatggaactatgagctaaatagagtactgctttagaacttaggctgttagttacttaggtttaaacttcttgcctaaatcctgtttcttgtaaaattgacatatacatgatgctccagttcttattttatactttataattcgatgctacccccatcactctttaactccatagtacatcaaagagcgggagatttacttgttttcttaattcatatacatggtttttcacatgtgatccaacgtatcaaatgggtacacatttatgtaattatgtttactttgtttggcatttttagagaaggaaggtgattttgtttggttttgtaacataaattaatatgaatgtcaccagggagctgaaaaggttgcagatgctctgaaacagaataaaacaatttctactgtagacttggtaagcacctatttgactattaataacacccaagagtttcatatactaccctctgttttgtaaattattattataatatcaccatataatctcagaacaaagtttcaggtttctcctctttatatctttgttcttttataaagagtagttcagttgattgtgtgttctaccgtctacagttcacccactgacccagtcctacttcaataaatcttttgtggctagatatatgtagacaagtatatggttgtttgcatgattctcttaaagaaactgcattatttgcacatctgtatatttatgtgattgatcgtctccatgtagtaaactataaattttctagatttgatgttaattattgtcttcattgtaatattagatattataatacttattcggatcagttgcaacgtgcgggactgccatgctagtatctcttaatccatggactattgaattccccataaccttcagggttgcttttctaatgttgtaaagtgagtgtagaacctatacaacaaaccttattcagaatagaggaactttggagggaaaaaaggaactgtattctttagatgtcccagcattccaaatattcttgtaaacaggtatacacatgctctaggtcttaagccttttaaatttgcagggtggtaataacattcactctaaaggggtaagtgcaatagctgaaactctgaaggataattcagtggtgacaacagtaagtcatcttattctgacttttttagtctgcacaagaaggtagtgctgtacttgcactaattctgaatgttgtctgtagttggagttgagctataatccgattgggccagagggggtaaaggctctttgtgatgttctcaagttcaatgggaaaatccaaacccttaaacttggttggtgccaggtaatcttcataactgaatggaatcgcggatgcagatttaagttatatcctcttcagcctggttacatattttgcagataggtgtatcaggtgcagaatttgttgctgattgtttgaagtacaacacaacattatctacattggatttgagggcaaatggacttggagatgatgtatgcacaatcttcgttgaattttatttataacttgcgctttgattcatacccatgccttctgatccttctctttttgaagggtgctatctgcttggctcgaagtttcaagatcatcaatgaatctttgacttcacttgacctgggctttaatgagattagagtaagtaaacactaaatgcagtgtctttttctttttgtattttctattggtgggtctatgcagatctccaccatgttcaataccctttatgctcctaacaggatgatggagcatttgcattggcacaagcacttaaagctaatgaagatcttgcagtcacatcattaaatcttgcaaacaacttcttcactaaatttggacaggtcagttgccgtaccagttggctattcatggtgtcatttgagttatgttttattcatgctggttgagtcaatgcaggttgctctgtctgaggcacgggatcatgtatatgagatgagcgaaaaggaaatagacattttcttttaggtgttcttgtttatttttgcaaagtagcttcgaaaaaatggcctaaaccatgacttctgcttggaagggatactttctgcataattagccacacaatcatggttgttttggcactacttgaagaaacgaaagaagaacatggggaagagcaatagagcatgatttatgcttgtcatagaaaattttggtaaactagttaactctgtaggttagtcattgaactgtccatatgcattttttctggaagcattgatctcaaattgatcattcatattggttgaaatagaccatatgatgaacattatatattatattataatggcttcactctttgcatgtctggattttgagcagtaagtgctcttatgctagttttttactttttaagtgtcattggttgtcctttattgtactttgtgcatacgatagcttgtctgttttagaactaggagagagtattgtagtacttgagttcctgtcttcccggtataaccgcgttcatgcccaaggattttgttttgtgctcgtcttgtgttctttaaacctgttgactcatgccatatccatgtgcacatgtgatgatcttcaattatgcagacctcacatctgtcggtgttgggcacactgtccacaacaatagcatgctttgaatgtcacacaaagaatacacgttatgatccaaatttgcaagatcatccatgtagaatgggattgactgagttcatgtttaattgttataattccatggaaatatgctaatcccttgctgggcattccttggatgatttccttaatgcagatgcttctttctcaaatgaggaagcatataagattaggaagcaccatgcttcatgctgcattactatataattttccatcatatatttcttagatatgtcgagtgccaatcatatgtttaattgttgatggcacagacacacttgccttcatcgatgctctctgagtttgacatctttttacattatgtattaaagctatgcaaattattttgggagaacaattttatatgcgccggtcttcttatttgatcagttttctgtatttgatatgcaaaccaaatttactcctatcgatgttgcgtggttgtatgtttaatttcttaaatggcaaagtaccaattgtgacatataatgattcttgcaatctactacaataatttatcgtgttgtcagtgatcttgttcaacatatgtaataaagcactgtttaagactactacttgggatattctagagtgtgtcgttcatcgacagttcgacacaaattaaactaaaaatgggagatgtcgatgccattggttactaggctagtcctcagattgaattggttgtcgtttgtgtcaggcgatatttgttgtagttggacggaatttgttcagctagtaatcctgccgtggtcaaaaccctaattctgaacaaaatctttcattggaactagcattagttgcaaaggaatgttttggtttggttggtgacatcacgaaattggtgtctttcaccgtgcctattctctggaatcttgtcagcaaccaatttccccatatcatttctgtcatttctctaaatcaagtgcaataatttggttaatattggaagtgtttcaaggaactgaagacacaagccaaactctagctaaactttgccggactaatactatatccgtaaaccactatcactagcatacgaattctcaaatctcaagcccttaatacatatgccagtcctcacaggagacaaccaaataacaataatgaaaccaatgaactagcaccaaatacatgctagttgtaattttcagtgtatggaaatttattccaatgtatgatgagtggtggaatgttccacgatcagtcgatcactatatatatatatatatatatatatatatacacacacacacatgtgtgaagaaaaacatttgtatatatattgtggaaatttattccgataaaaccatttttttttctaaaagaccacatcagtgatgggtgaagggtggtaattaaaagatgcacgttacaaataagccccatccgtatcgggtgagaatactacttgacacggcccgtaaaagatgacctagttatttgtgtcggttaatttctttcctgtgacctatcaaagatgaagtcattagggcaagtactataatgttccatatgttgcccttaaaaataccatattggatagagtgatgaggtggaggagagaagtgaggagagagaagatgagccatccctaagtcaagaggcaacatctacacaaatttcaagaagagtgtgagagtattagaaatatttgtatttgtgtaccaaatacgatatattgtatgtgttgcatcttaattcatgagtgaataaaatagataaatttggagatggtagtcacatctaccatagcacttgcccttaggaacaggtgatagaacaaaggcaatgtttttgctaatcaagtaagctgatgtacacacaacgctaatcaagttggcttctgttcgaactccatgagaagctctcagggccaggcaggcaggcagataaaacgtacactccacagctcacaccttcccaaatcaatccgtttcatgcatcatcatcctcctgtcgatcgaaaaatctccatctgatgatcattgctactatatatcaaatctagctcggatcagatcatcatcaagacacatcaacactatataacggactgctagctagctagctagctaggtgagctacgtacacaagaacttctccattgcaataatcaatcgagttaattaattagttagtactagcaaacattggctaaagtatatatatggttttccaagtgcagccgccatggctgctcctcctccacctcatcgccatcgccgtcctcctcctggccgtggatagtgtgccgccggcgccggcgccgccgccggcggtggcgacggtgttcgacgacaactacgtggcaacatatggtggagacggctaccacctggtcaaccagggcacgcagattagcctcaccctggacaagagctctggtatacacacagatagattatatatatgacactgttagattcagcatttagatcagcttgatcatagtttttgcttcttttctctctctattttatgcttaactagcttgatgtgatcatgcaaattaattatcatgcatgcaggtgctggattcaggtccaagttgatgtacggctcagggttcttccacatgaggatcaaggttcctgccggctacactgccggcgttgtgacagcctactatgtgagtgctaaactgctaaatcaacttcacttaattatataagtgttaattcctatcacatgttctttaatattgactaaaaactaagcaccagtaattaactgaatgtaacaattaatttaatttatttctgaaattgcacgggtagctggcgtcagagccagactgggacgtgcaggacgaggtggacttcgagttccttggcgacaaggatggcaaccccatcacccttcaaaccaacgtcttcgtcggcggccacggcgaccgcgagcagcgcctccgcctctggttcgaccccgctgccgacttccatgactactccatcctctggaaccccttccacctcgtgtaagctcagttcaatgtcaccatgacggccgtatacacttttgttttaaaacaaatagtagaaatagttacatcttccgtctctaccaacaaacacttgcacatacaataagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccattcaccgcggccttccagggcttcgccgtcgacgcctgcgccgccgccgccggcggcggcgtcagctcggacgactgcgggtcgccggacacgtggtggtggaacggcggcgagtacaggaggctgacggcggcgcagcaggcggcgtacgatggcgtgagggggaacctgacctatgactactgcaccgacaatagcaagaagcgcccagtgccgccacccgagtgcagcttcacctaagctaactgtgaataaattcactgcacaaaattagcagaattaattgcgaggatgaaaggtgcagcagtatactggtatatgttagcaattaagccccgtgttcatccattggaattcggaaaggttgtgattacagatagccattccgatataaatatggtgtgttcttgacttaaggccctgtttagtttcgaaacgaaaatttttcacctgtcacattaaatatttggatacatgtatttaatgtttggatacatgtatagagtattaaatatagtaaaaaaactaattacacaaattacgtgtaaattgcaagacgaatcttttaaacctaattacgccatgatttgataatgtggtgttatagtaaacatttgctaatgaaggattaattaggcttaatagattcatctcgcagtttccaagcaaaatcgtttcgttattagtctacgtttaatacttcaaatgattgtccatatatctgatgtgacacagcctaaaattttcgttcgcgaactacacaagcccttactagtacaattttgcaaccaaaatttttttctatacctatatgttgtagtcacattttagtaatgctgtgtttagttcacactgaagtttggaagtttggttgaaattggtacgatgtgatagaaaagttatgtgtgtataaaaggtttgatgtgatgaaaagttggaagtttgaaaaaaaactttgaaactaaatagggcctaagtctgagttacaggacacgttaaaaaaaaagaagaagcaggaggttgtagaggtcacaccaatgggttagaaggaggatggaattcaagttgccgattgccactgcagtgcaaggctgctcattgacaccgacagtgccctgtgcgtccgtgtgtccctcaggcagagaggcccagacaccactgccattgttgggccgtttctcgcatccaaaacctatactatttcggccgggccgtcgcccccgcccccattagtccattccacctcccgccacggcacgcagccaaagctctcgttctcctcctcgctgctgtgcccgccgagcgaacgatcccgggacaccacaccacaccatcatttgcacgggatatccgatcgatttgagtcgtactccagtggcgagcacgtacgtacgctttccgcggccgtgtgcccgcccgtgcgtgcacgaagctagctagcgccatgattcgcgaccaggagtccgcccgcaaaagagaggcccccggcccggcagaatgtgcgcggtgcccggctggccgtgtgcgccgcaacgaaaggttttgccagcggaaaagaaccaaccgctttacagccaacagaaaaaaccggccgcactccatcgcatttttcttttgcccgaaagctcgccccgttgtctagtttgatacgagtactcgaatagctcgccagcccagccacctctcgccgtgcgggcgtgcggcaccgcacccatacgacggtagcgatcaggttcacagttttcttcgactccaaactttaactttcttattttccattagtatattttttttaaattgttaaatgatgtgtgtttttttttaaaaaaaattctacatagaagttatttttaaaaaaattaaataaatctattttttaaatttataatagttaatatttgattaatcatttgctagtgagttttcttgtttcgcgtgcaccggaaatctttcttcaaactcatctatcgaaccaagcctgagtgagatccgatttggatttcgtgaaaaccggattaaaaatacaaaccactctttttttttccgttaagttcaaaaatccatagtgaattttaaacttttgataaaatttgccggattttatcggtttgttaataggttccacgaaatctgatgatacagcttgtgagtggattttgatccgatataggggctgatcttttgtgctgctttgcagcaagctatggctgtggctgtgttgtatcggaaaaaatttgtaaatatactttttttttcaataatttaccattatatatatgcatggaaagaaattgtaaaaatatacctatctcgcgacggtcccacaggacggtagtgctgcaccacgacggtcccacggatccaaaatgcgggaccgcgacggtcccgcgcgaccaaaacacggcaccgcggctagagcgattttattatccgatcggcactgtttagtactgttttaaacactgtttagcactgtttattacagtcccgcagacccattgtgcggaaccggcatgcaaacagtgccaaatagtaacattgccagatagtgtgtgaacagtataaaacagtgcgtgaacagtgtcaacgcattgataaaaatcgctgctatggcggtgccgcgttttggtcacgtgtgaccgtgacggtcccgcgttttagatttacgggaccgtcgctcccgtgtttttagagctgcgggaccgttgtaggatgggtatatttttataaatccttacaatacagatatataaacgtaaattattgaaaaaaataagtatattagtaatttttttcgtgttgtatctacagtagtagacattatattaggtttgctgcagctgttgcgatcaactctatagcctcatcttttcgcccatacttatcatttaaaatttaaattttcaactttaaatttaaaagttaattttggattttttttatcatagtttattttttagtcttacttttagatcattaagaacacgtatatatataagtttttttatttatatacgtgacaaacgattggggctgaattgggaaccctggtgggcgacagcgccctacgggctccgccagaaacggacggcgctcgcggcgccgctcggcgtcgggagggatgacatcgacggcgccggacggtggggccacaccctgttgcactttcggcgaatcggccataataagcccaatccgcaatccccgatcaaccgtggtaggctacccctttgcatgacaggtgggcccttcaaccaagaggcggggtctgtcagtggaacttgtagggtaggtacatgcatggtgagtacgaaaaaagcggaggagatatgcaccggcaagagttggctgcgacgggctggatcggatttggagaggggaaagaaggaaaagaaagaaatcgtcgccgggggccacttcggtggggaaagtcggggggtgaaatggtacggtcacggagatgttgcacacacagacacactcttgtttgttatttttgacatgtgggtgcacgatagtgtagggtctgcgtgtcatgctcgtgtttgggtgggctctggataatggaatggtaaaggtgcaaataaatgctcccttagtaggcaatgataatgctgagagtacatgttttatgtaccaaatgtctaataatccattttcttaaacggttaaatgaatattagtagatgctatcttacggtctaactttattgacatgacaggttcctatttaaccttgtgttcgtgtgatgcaacatttacggagccatccagcgaaacagcttatttgcaaatggaaaataattcgtgaataaaacttttatatacgtgttcttatcaatctaaaagcaacagctaaaaaataaatttcgatgaaaaaacctcaaaatcagctccaaatttaagattgaaaatttaaattttaacttataagcataagtataagcgaaaagaagatgccttatttgcatatgtgttcttgtctaacgatcaataattttacgtttgacaaaaaaaatactttcttttacgttgggaaagttgtttttttctattcacgcaagtgatcatactgcttgaaatgtaagagaaataaaagaacaacttgttaaaaaataattataaaacagtctagaagtatagtaacaatgaatgaaaaacactaccaacacatataacgctatggatcattgatgagcacggacaaccgtttatactagcgcgtaccatctataactgataaagcataaaatgcattggacaattcacatgtattcatctatgggttttccattctgttcaaaatcacacagacaatattaggtcaaagtttaaaggctagtagagagaggcgatccttcgcttaacttcatgtgtagttagtgtcactaacatagcacatcatactatgcatgtctctagtagggcagtcgcagtctcgcagataattatggccccgttaatatggggaataggtcgagcttattaaccgcacgtaaaattgatctaaaaaataatttgtaaataaaacttttataaacgtgttcttagcgatttaaaagtaaagattaaaaaataaaattcgagtaaaataaaccttaaaatcaatttaaattaaatttaaggttaaaaatttaaattttactagctgataagtaagcggaaagatgaggctcttattcctttttttctcgtcggagtgcccgtagcatttccccttccctcctttttgagcgcacgccgcacccactcccccgtctcctctgcgctgccgttccccgttattcgccaacgcttccctccacccgccccctccccaagctgagctgtgctgccgctgctttcgccttcactaatcatcatcgcctcctcctcctccttctcctcttccccaccaccttcctccccacacacacacaacctcgcgcgcgcgcggcgagaacgagaagcatccagggcggcgcggaggcggaggcggaggcggaggtggagggggggggggggggaagccgggatggcggcggcggcgtggggcggcacgacgcagaagtgcgactcgtgcgggaggacggtctaccccgtcgaggagctcgccgccgacggccgcgtctaccaccgcccgtgcttccgctgcacccactgcaaggccaccctccaggtcccccgtcccctactctgctcgatccatccattaattaccagattttttttttgtactggctttatgccttgtttttgttaatctgggtcgatgctattattgcgagtactatcggcttcctgaaatcatatccatcttggaatgctttagttgttgttgctgtactgtatggcctgcttttttctttttctttttttcttttctcgagaccagtcgaagatgggagttaggttgcatgctcatttcaataatcaagttgcgactgtgattgactaactggataaccaatcactttgctatccgtttatgtgataacgaacccacgaagcatcagtaaatttgcctaaccacggtttatttgtttaatccatcttcgacgcaatttcttggcgtcttagtaaatatcccaattatttttcttgttattgtggcatgagggatggactggaatggatagggtagcaaataaatgtttgttttttttggtacaactgttgtctgttcatcatattcctgaactgactggttcacctattaaatatagtgctggctgatttgctaggttggtattatgctgttggtgagtgccgtatgattagcctgccttttgaaagtaataacatggaattaatcatgctgtcctcaatgcatcatggatgtaaatgcagctagcatgtttttttcttggttttggtatatttctgttgagaataataatgatcacactaaatctttatgcctcatcatactagctagaactacacctatcttgttctgtttgcaactaagctacatatatgaaaccagctaatatttttttattatcttttacagtttagtaactattcttctgtcgaaggtgtcctatattgcaaacctcactatgaccagatattgaaatcaaccggcagtttggagaaaagttttgaaggtactgaagagaaaactaaatccactgggcttgatgccttaattattgctagtgtctttacctcgaaattgttgctattgtctcatgatttttaggcctgccctaaattttgactatattatgccagggacatcaaaatcagctaaagcagaaaaatcgaatggaaacaaggtatcgtaatatatttctaagatatgctcttttatgtttttgaagcacgtccctagtatctaaattgtttggcagctttgatgtagaggacataacattcatgtccacttcctcttttatgttatccaaactgcaggggcaaccgaacagattctctagcatgtttgttggcacacaagacaagtgcgtagtttgtaacaagactgtgtaccctcttgaaaaggtcagtattatactactgtattatttaatcttcccctgttcaacttcaataaatgttataaaccaacagctgttctcctgttcagggaattaatcatgtaagcgctcttctatttatgatatggttgacaattgagcattgtagttggcctcatcatcttatgtgctccatcacaagactaattcagtggcaactgctaatgcgataaatcttatcgtgcttgttattagaatatatccacaataattagaattactacatctgataaagttttccagttgtaattaagtatcaataattttcttctcacaagcaaaaagagtggcaagctaagccaaatggagacttctataccctttcctaaaatactgaattgctgtcaaattttcacaatgttgtagaatcagttcattgacctattttttgacaatatttaagaacacatttattacatgccaatatgctatatttttagcaatatttgggcgttatatacttttttccctcatactactgcattagtcattttctgtggctaacttatgtaagctatagaagaatgcaatgttaggataaccgataagaaatgattaattcaattaatattttgcaggttaatcttaacgggagctcatatcataaatcatgcttccgttgcacccatggaggctgtactcttagcccatccaacaatgtcacacatgaaggcaaactttattgcaagacccatcactctcaattatttatggttaagggaaacttcagcaattttgaggatagtactccaaatgcaaaagtggatatcgagaagcaaccagaacatgaagatgctaccaagaatccaggaggcccaggtcaaggtgatgggctcactgagaaacctttagaaagtgaactcactcctgagaaaccgtcacaagacgatattgtggctgaaaagcaatcacaaagtagcgttgatgtcccaaaacaatcagaaagcagcacaacagttcagaggtcagaagaaggggaaagggttaccaagggtgagtcaaatagtcatgtagtcagcaagaagccattggaaagcagtgtagaaaagccattccagagcagtgcagttaacttacagccatcaggaagtagtgcagccgtaagaaaaccatggcagcgcaatcttcccacagataagccattgctgagtaacacaaccactgaaaagtcaactccaagcagtgctgccattgaggaatcattgccaagtaatggggttgatgcaaaacagccagaaagcagcactgccagcacagtggtaaaaaggccatggcaacggagggtagctacggagaatctaccgcagagcatttcgccatcagataagccatcatcaaccagtgcagatgatgtgaagccatcagaaaacagcaaattgatcagaaaaccatggcaacgtgctgtggctgctgaggcgcagatacagaacagtggaccaactgagaagtcatcattgacaaatgatacaaagccatcagaaagcaccacatcaattaaaaggccatgggagcacaaagtggtcaatgagaagccactgcagaacaatatagacacggagaagccactgcagaacaatacagacactgagaagtcatctagcagtgctatcgatgtgaagctggcagaaaccagtacaacacccactgtgccacaggaacacagtggaatcacggagaaaccttcacagaccagtgcagatgatgtaaagccatcagagagcactgcagcagtggttaaaaagcaatggcaacgtaacatcggattccagaaacagccccagagcagtgtaactgatgcaaagacacctgaaagcaggggaatgggcaaaagattgtggcagcgcaatgttccaactgaaaagcaatcgcaaagcggtgcgtcggttgtgacaccatcacaagttagtgtggctagcaccaacccgctccaaagcagcgtggttgtgaaaaagccatggcaaagaagcgtgtctagagaaaaagagccagagaaggatatatctagcaacaaaccgttacaaaaccgtgtacttgctgaagaagcagagaaaaccaatgtgactgctgataacaaatcacagatcattcaagataaaaagaacaatggtgctaccacagagaattcatcacaaataagtgaaagtgccaaaaaactaccacttactgcaaataaatcgcaagctgatacttccacagaaaaattgtcagaaagtgacatacttgctgtagcatcatctcagatcactgaaccatctaagaagccatcagaaaacactgctgaaaatgagaagccatcacagactgatattgctactgacgagctacccctgacccaaagtgtagaagccatgtcagaaccatctccaagtgatgcagctcatcaggaaatctccgagagggagatactgacagataaattaccagaaagtaccatggctgttgagaagctatctcaaactgctactctaaccgaaaagccatctaaagaagatgctgcagagaagctaccgcaaaccaatgaaccttctgagcagccacacgagagtgaagagactgctgagaagccacttcaaaatgaagctaatgctgaaagcacaacaaaacaaagtgatctcagtcttgagaagccacctcaggttgatgccaatgttgggaatcctaccgagcctgaaagtgatgccacttctggtgtgaactcatcagatgctcaaatcaggccaactgctgagcagttagtaggacctcaaggcattgtatctgccgagaagacatctgaccagatattagaagctaacaccgatccagctgctgaccagtcatcagagtcccaagatgttgcacctgctaaagttgcaacggagcaaccattagaaaatcaaaaggctgcagcttcagagcagccattggaacctcaacacgaagcatatgaagagaatccacaagagcataatagtgatgcaactgccaaggagtcatcagaacctgaaagagatactgcttctgatcagttggctgagcagccatcagaatctcgaactgcaggtgagaaggcaacactgcgtgaaagtgatgtggttaccgaggatccagcagaacctcaaattgatgcagctgctgaaaggtcagctgaggtgttatcagaatctcaaactggagttgagacaccagtgctgcatcaaagtgatagaactaacgaggttccatcagaacctcaaactgatgaagcttctgacaagtcaactgagcagccattggagcctgaaaatgatgcatctgtcgaggatgagaagccaccggaaatcgaaagtgatgatgtgcatgataaaccatcagaaagcaccccagatactgaaaccctgcctcataacactccaaagagtagcataagcattagcgaagctgcagacggcaacgtttctgaggaggcaccacctcagagcagtgcatccatagaaacgccatcagaaagtgccatagctgtcgaggaaccaaaacacgacgacgaggccagcataaagccatccgaagacagcagtgctcttgaggagccgccgcaggacgatagcgccagcgtggagccatcagagaacactataactcttgagaaggcatcagaggaagatgagggaagtgtaaagccatcagaaggcaatgatgctcttgagaaaacattggaggaggatgaggcgagtgccaagctaccagaagacagtacgacctttgagaagccatcggagaaagatgatgctggcaccaagcagacagaggaccctgtaactcttgagaaggaaccagaggaagacaagggaagtgtggagccaacacaggacaatgctggtcttgagaaaccgttggaggaagacgaggcgagtgcgaagccatcagaggacagtgtggttcttgataagccatcagtggaagatgatgacagcgccaagccatcagaggatagcatggaccttgaaaagccagaggctcacaaaccatcagaggaagaagatggcgcgaccaagtcatcaccggaggatgctgccgttgaggaggcgccattgcaaggtgacacagaaacagccactgacaaaccctcactagaagcagacaccacagaaactgcctgagctggttacagttagttagcaacagtacacagtttttaacccagatgggtggatactactgttgatactttggtttgccattttgcttgttttcttgttttgtacaatgcttgagttgtaaaatttgagggaaaacagaaaaggaactataggtattgatttgatttgctcacaagcaataagcccctcccaatattaggaggagagcagcattgaggatttgagctttacatacttacaatatagattttgcgtgtggcttgattaatttgttgtacatcggatgatgtaaatgatatttatgcaaattactgtgtgcttttgctcatttgtctctgataatctgtggagctgttcttgattgtgccttgtggcttgtggtttgaatttcaattcatccacaaatttcagaaataatttcttggacaacctgtcaggccttctttgaaatgggaaaaatttaaaaggtttttaaaataactgaactagtagattctacgaaaatccagtaaattctaaattttagggttttaaaggaaccctgatgaagaagaaattctaaaacctccccaaaacccctgtggctctgaactctgaagtcagcgaggaagggagaaggcgggagttctccatggctccgaagcggaagccgccggcgagggcggcggcggcgaagttggaccccgacggcatgttccgcggcgtctccgccttcgtcgtcccccacgccgtccagtctcgccgcctcgaggtcgcggctccaccgagcaatccatcccaacccccaccaactctctctcctgtgcttagggtttcctggctttcgtcgtcggtgcaggtgtggaagcagaggctggcgcagatggggggacgcgtccaggagaagctcgccgccaagggcggcggcggcgcggtcacccacgtcctggccgccgacgccaaggcgctgctccgggagctcgacgccgcctggctccaccgctttcgcggggtaatcggcttggctccctagcttgaaaccctaatctcctctcggcaagcttggtgtgccttgctaccatctgcattttcacagcccaaatctactgctagtagtagtactacattgagttatagagatttcataacatggaaagatttctgctaacatcaagtgattgtgtttctttctataaggactggatttttgttgcagagagatctcggctaacatcaagtgattgtatttactactataagaactgattttttttttgattgcagagcgtggtgtcattcgagtggctggaggagtgcctcaaatccggggagaggctaccggagcacaagtttgctatcaactacgaagaggaatttaagccgaagaaggaaggtggtgctgcaggttcaggtgtgttgcagtctgcaaagaggagcaaaatatcatcagacggtcctgagaatcggaaggaaactgctgggggtaatcgagaatctcgagatgcaattgcacatccaaatgaagattcggatgttgtaaaggggcctagcacgtgtacaagtagccaaagtgcctctggagattctaaggaaaccatagcttctcaaaatgcattcaaagctgaggtataagcatggtcttataaattatagtacaaactaactgggctctaaagtctgggttatgttgttttgctgcacttatcctctttggtttgctcaaattcgtacaagctccattctgaacatatgtaaacaaaaaagaggaaacactttttagcttctcctttttgtaattagcttactctaagctctaagttacatctacactgacttcaacatgactagacttgagactgtttttcttctgctataaaaatgtacgcagttgcctttatctgttcaaaaatgaaaacactgctgtagcaactttaagacctttggtggtcagctgtatatctattttgcaccctcaatggtgatatattgctctgtaccatacaacatataactcctgaaccctgaggatttatatttcctagtgttgattcattgcttatataactaggaagcctcttctggagaatcctcaacgtatgctcctccagacttgaacaggaacataactgagatttttggaaagctgatcaatatatatagaggtaaggacattgtacagaaatcttctcattcttcttattcattgtattaacatttcatatactttctctacaaataacatttccttccctttcacttgaagccctgggagatgaccgaagatcatttagctattacaaggctattccagtgattgagaaattgccattcaaaatagaaagcgctgatcaagttaaagacctccctgctattgggaaatcattgaaagaccatgtatgttaatccttttctaccattaattcatattaattggtgatttacaagtcaacatatatatttttggcctttgtacaagttcatgattctatttttttatccactatggtctatgggtgatgtagtaactgtgtcataactctgttttcttaaaaatatgttggtcttctattttgttttgctgttgagggctgaaaatttattcacaccttcattgagcaaacaggttctaaaagtaccacagaagttccaaggaaaatatgaattcatacattcatcgttctacatgtaatatctcaggtgtttgattgtctaactacccttgtatatgcagattaatgagatagtaaatacaggaaagctttccaagctagagcactttgagaatgatgagaaggtaacttggttttcagtgaacaggagtagctcttaagcattatccagccatactccctgatatttactgatttgcatatcaccttaaaggttcgaactgtcagcctatttggcgaagtttggggtgttggtcctgcaactgctctcaagttatatgataaaggacatcgtacactggatgaccttcaaaaagacgattcacttacaagtgctcagaggattggcctgaagttctttgacgatatcaaacaaagaataccccgacatgaggtatgtattctgtaagcccattgaattgttttcttttcctattattactagctattcgaagtacaatctaacattacacgtattttactctcctgttatctaggttagtgagatggagaagcttttgcaagaagttgggactgatatcttgcctggggtaagttccatatagtatttaaaggaaccatttgtctccattacatataactacacaagccattcaaaaactaatactgaagcatcagttccatgttcaatttgtctcaacatatgcggtggttattgtttcctgtagcagctagttgcttacacctattttttgtagttccctattagtctgaacctgactacttattttgtttggagaactagatgggttggttcatcaccattcctccagtcatcctctgaaagtacacatccagtacaaaaatgaggaatggggtcatcctatcgagatcctaggccgatttgattcttgaaaacaaatagctcatatatttaagattttagtagaacaataatttcccttaagtgattattgggttgttatacatgatcttttttatttggaggtgataattgtatgtgggggatcatacagacgtggaaaatcttcttgtggtgacatggatattattatcactcatcctgatggtgaaaggtatacttcaaaactttcaaaaattgttggttattgagtatgccacgtgatttttatttaagtatgatgagaaattacccatctgctgtgcgttcagtgtattctattgaattcaacactgaaccttggcaccacaccaaacagccatttagttattttacagtcatggaaagttattttctggcaacttgtaggtttggtttatcaatttgtcatctatcataagcataattattcattatgaccaagtttctattatgcggtctgcacacaacacatttttatataagaacatcaatgattaatcatctggacattgtaaaagggaccatacatttttctccagtcatgtaggctttttaccaaaatttgttcagcgcttgaagggcatcaattttttgagggaggatcttattttcagcatacacagcattgaggtaagttcttggccactactttcagagattttgagaagagtgattataaacaaatgggaaagatcacatttggtccctccacttctgcttggatttaatttatactctgaacatcaataccgcttagagcacatgtttcaaccataaaaactgttcaaataacatcccgagtatattttttatggtgattttgggtgacaaggtatcctatttacttatgggttgatatgctttaataatttaccaaagaaaatttttgttctggttttttccccaaatgaggtggtgtggataccatgattgaaaaggcagccacgtaatccagaaacactcaagaacttctatgaatgtaatttacactgctttgatagtcaatggatgaaagcaaaacaatattaaagttctggatgtaagctagaatgctagatccgagcaagagttaaaggaccaaaagtggactttttcctaaacaaattgagaaaaaaaaagataagatcatataaaagtgggctaaatgttcatatttcaaagtgctatcacacaatattggttttgtagctattaagaatatattttatgagaaagaatgaatgatcagtttttaatcttgaaggctttttaagatcaaaatatatcttataaaaatcgatggaagtagtacctttttaacatcttgagaaattgtgtaagaagatttgaacgaactggcattgctcatctcaatgcagggaactgattgtggagttgacacatattttggtctttgcacatatcctgggcgtgagctgcgccatcgcatcgacctcaaggtataatattattccagcaggagtaatttggttcatgtcatcttcatttgacaggatttgtttcttattgattaaaactaaacaaatttcaatgttccttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactggcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccgggcagtggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtttgcaccgcagttgtgtctatttttcagtcaaatcaagattatttctaaattcaacaatgcaaggcctcacaaactatcaagcaaccatgcatgataacacaacggcaaaaaaagaagtgatgttaaaccatatcccatcggggcaacaatgaacacaaaacatacaagaattcaggcataatgtggttcatcttgaatgttcttgtgaaatttgacaggtcaaaaggcatttcttaacctgttacactgagataataatcacaatcctaaaactctcctttctcttgacattgcctatccaagttccgcatgcagactaatgataatgctgcatcccggacactagtagtggtgtcaaatttgtaggcataaacactcaaaagtcaagaaaaccctttagtccataagtagtaccctacatggatgtgatcatgtgaagattatttacatctctctgtgcctaaacctacaactggaactaagaagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgttgaatcctgcatttgacacaactcataaacaccagaaagaagttcagaggtgatcccattcagaaaatcaaagccataaccacagacactagatggtactgaaaatcacccaaagcatttatcaagtggcctctaaactccaatgccctccatgatggcattcttgcagaaaatgacaaagaaatccactgcatttcccaacgaattttgcctcatgccatgcaaaattgctacaaattcaaacaaggtatgcaaatccagcgagtacagggtactaactatcactcactggtatccatccaccaatggttgcaaatttttctaccactcttagatccccagcattgctaatctactagtccgttgatacagagcaagtttaatagtatagcccactactagctctaaatcatctatagccaatgtaatagccaattcatacaatagttgcttattacactattaatatctggtcccacctgtcatacacacattacgttttggagttcgtgctgtagctggttacagatctatagcccgctgttcttctctatcttcatttatctctttaaaatatatttatagctggcatatagtatgctattgtacctgctctaacaagtagccaacatgttcttggaaagatcacaacattgccccgatttccgaatcatcagagatgcaatgctaacctgtggatccctcgtagtaggcctcaggcccctcgatgaagaggactcgccgcagcacgtcctccctgtccatcccgaccagtctcaggtacggctccgcggccttggactgcacgcagcagaacctgatcttggcgtgcttgtccgccttgatcacccacttcacccctgcaatgcaaagccccaaaccgcatttcgatcacaaccaaatgcccccaattcgtcgccgattcgaggtagaaatgagtccccccacaattgggggcctgtacatgtgctcaccgcggtggcagaggtggcagacgccgtcgtagatgagcacgcgcggctgcaggacggtgggcgcagtggccgcgatggagacggtggcggcggcggaggcggaggacgcggtgcgcggcgggggctcctcgtcgccgacgacgacgaggtcggcggccgcgcggggcgcgtagccgcggaggcccgcggcagcgaggagggggcggacgcggccggcgagggttcgggtgagcattctctctctctctccgccggcggcggcggcgcggcgaggcggtggttctacacacaacacgcgggtgttggtttccttttgcttgaccgctcactctctccaatttattttggacattaaaagggccttctggcttggagggtaagtaaaaaaaaagttttatttttccatttgtgcttgtgtagttgccaaagattatgtgtgcttatttttaaagaattatgctcatctgcaaaaaaaatggtgcattttaattaaaccctaataaaattgatttgctattacaacaactataaaaaaggggttcaatttactccatcacggtattttctctccatatgtaagttgtatttcacactgaaatttgattggatgatagatgggtaacaatttacaacttatgtcttattatccttttagaatattttttataggtgtttacataggttggaaatacctaagattaattttgaactttgagattttaaagttcaagtaaacgatcatgaaaaaagttgcaaatattatttgaactttgatagtggtgtctctatggtttaaaaaatttcaggtataaagagaaagaaaaagaagaaaaaaatgctattagtgagtacagtgaatcattttcaatagtttagagacaaaatgaaccaaaaagtacttaggggtaaattagaaaaatattttagtggttaagtgatccaaatgaaatacttcgagcgagtaagattgattttttctcctttttgttttccaaaatagatatcataaccaatttagtgggattttccttggtcttaccactcggccctgcacctttagaattctaaaaggcacatttttttttgtcaaaatttgaataataaaacttaattttagagttaatttaaagatttttcatcgtattttttaaacattaacgtttaagttgttattagttttaaccgtaaattatttttaatcgataatatgttgtttggcgcattatccgtaattggccaaccgatgaaagcctgagaatgaaagtatatactaacatttatattaaaattatttttcattgctttcatcactaatgcttcgttcgttttttattaacttttgcaactccattcaccgtgagcatgctttctaaacatcaattgaatggtgcttttttttacagaattattttatatataagtttttttaaataattcaaataaaaccatttttttaattttgtaatagttaaaacttaattaatcactactccctctgtttcatattataagtcgcttttgatttattttctcatttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaaagttaaaaggcagttcagattgtaatcaaattaaaccttatcaaattttgtcattggcaacttagtaatattgccaagttttaacatgatttcttatgtatttattaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccaaaatctaggcaaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctttaacgacatttcttaaaaaaaattggtatagtttaaaatgacatcaatctgaacaatccatagaaacatcactagcctaatgctgtatagagaccatgatccatggagtagttttttctgaaaaaaaaatgtttttttcatttttttatcacatctccttccagattttgttcctttccaaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgggagcgacgacgaggatggggatggggcagaggccgaggccgagcggcaggaggccaccgggcggaggagcagcttctcctcgttcccttccccctcgctgttctccaggctcggcgccgcgcggcggcaagagcagcgagaagaagaggagcttcgaggaggtattggttcatctgctgcatgcgctagacaaatcaaattttcttttttcatttttcagtttcttgatcagctgaattgaaatgcttcatgttctacacttaattctgtcgaatttttctgtctagaaatcgagcttctcttgacgcctgaagaaatggctatcctggatcagaacgagaccccggatatcaccaaaatatcatcagtaagtgtcactctgtaaatgtctgacagatattatattttggtgtgtcataaatttgttacattgctacagaatcttgattaaggaaatgtgcacaccattgatattttaactgttcccaattcctgaaattggactgttttgtgcagccgaaatggcatccacttcatagttacgcattggcgctgcagatacctctcatggacagcctgctcgatagtggtgtcgatatcaatttacttgacaaagtatgttctttctacataacatgttgaggaagcatgtttcatgctcatgattttctattttggtgcctgtgaaaaaccccatcttggattatgcctgtgaaaagcttttgcgcattcacgaaaaagaaaaccgtgttaattttgggagtgctgatgatacaggatggtttcaccccacttcacaaggctgtcataggcaaaaaggaggccgtcattagccatctcctgcgaagaggggcaaatcctcatgtcagagatagggtaaccttgcaaggctgcaatctctttctatgaattatgtgttccataataacattagtatgtggaatatagtaaactttgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgacttctatggcattgtcatctcaaatgctcgtatttccatggacatcagctttgtattacagtctataggccaatactgctttctgatctcagatttggttacaggatggaaggactgccttggatataagcttgtgttttggaagagatttcaagtcttatgatttggcaaagcttgtcaaacttgttccggcaaatagaaaaatgtgactcagctctgtcacaagaatcagagaaaaaaaaaagatttagatgttagcaactgttgatttgggtcattcctcctattgtttttaatgggatgattcctccaatttgctatagttgcttgttcaatccatttttagaacctgtttattttagagaagttgtctaatcctgattcatgatcaacttatgtaaaggggttcgaaaaagctaatgccacaatggaagaaatagccaaatttagatgatctttttcttatttgcaaaccgaggttcctcagaggcgttattttaaacgtttgatgtgttaccgttcggctatgtgaatacaaagctggctaagcaaacaggacacctccataaaatgatctcactgagattgcataacagtcgttttgtaattggattaataaaagaagtaaggatcaccacatacataagcgagcgttaattataaatatatttttttcatatcgaagccaagttttaaacctcagatgatttcatttggcgtttagaaagagttgagaaatgcacctgtctaggcaatgaaacagaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacagagcatgtaaggtagacaaacatttcacacatcattactatggtatgagtaactagtacaccttaaacagcaaaattcatgcaacataaatttgtagagatgacacaaaatccatacaataggtgcaatggcactgcaggctagtaaattcaagagttgcctactcttgcaaggagatgcgtctaaagatggcctggaaagtctgacctccatttcttgcaaccttctgaccttcttcagtggcggtagacagtagcttgacaactgggtctgcttttgtctcttcctctgggatagcttcgaacagcgggtgtttctccaggcatgaccgcatccattctccgagctcctccacatctgtgattgtatatatgattcctcccacttccatcacataagcatactcatctagcagctgcatgctgatcaccctccgccggtggttcttctccttgaagtgaggatcagggaacaggaagaacattttcgaaagctgagccttcctgaaatagtttggaatgtatttcatcgaattggtgcgcacgacagatatgttgtcgtactttcccggattcgatgctcttaaagccaaaatccgctctttgacatactcagtcacctgaaaaatatagacaacgaagaaaaaaatgaatcaaaagtaaatacgtactagctttgaaaagaaaaaacttccagttcttttgttaagtagaaatacatgtctattgcataatataataccatcacaaactaaactatgcaacttttgtctagtagaaatccatatttactatagaatctaaattggaaggcaacccaaattcccaatatttggtacactaaacattcatgaagtaaaagccatgcgcgatctaatcattctacaaaggaaagctcaaatggtctctatgagtaatgtaacactgaattcttcagtgtcaccttgtgctgttatccattcacacatgaatgtatctctactgcccaatcaaagtttagggggaaattctaacaaaccttgtccctgagctccatgccgatcatgagggtgtccgggaagagcgtagagaggccgacgagcagcccgccgaacccacacccaacgtccgcgaagcggatccgtggcaccgccgcgtcgccctggcgggcctcgccctcgccggaggggaagtaccgcgggtagtgctgcgagaggtctacctcgtcgggcgatatcgggatcgggaagtgcgagtcgctgagcgggttgctgtgcgcgcgcgcccggtagaaccgcttccgcgggagcttcccctgcccgccaccgccaccgccgttcgcgccgtcgccgctcgccatcgcgccgccgtccccgcctgcagctgcttcttggtctgggagaggcattacgccgaacacccggtgagcatgtcactcgacgcgagcggtgttgtgggagagggaagcgggagaggggtggggagggagtacgaaccggagagagagagagccctcgcgagtcgggagagcgggggattcgccggaccggtcggcggcggcggcgtcgtgggcggaagctggcttggcagcgagtctcgagccgcgcgggttagggcttggatgttggagagggaaatggaacgaggcgggggaaatggattgggccgcgcgagttggtttaggccctaagctgcagcccagcagcgacgagatgggccaagtgccgcgaaggccccgagcacaccgggtgttcggcgtaaggaaaaagttcagctgaggtcccttatgccttatcttgttatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattagagtcgacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactccctccgtttctaaatatttggcaccattaactttttagtacatatttaaccattcgtcttatctatatgtatacatatacgtacatttaaaaatgaatcaaatgataggaaaagaattaataattactaattttttttaataagatgaatagtcaaacatattttaaaaagtcaatagcgttaaatatttagaaacaacggagggagtattattcacaggagcatatctctggccacatatatttctttacaggctttagcagtgaagattaatgcatggctagctagctagctactccctccatccataaatataaaggattttggttggatgtgatatatcataatacaacgaatctagacaggagcggttggatgtgacatattctaatacagctcctgtccaaattcattgtatcaggatatgccacattcaagcaaaattgcttatatttagagagagacatagggagtagttcgttggctctgcagactgcagcagtgtcagctcgtgatatactcctccccagtgtgttgaatattggggctgtcagtaaaaacttgagcacagaaaagggaccttactaaaaatggagcatacaacggtaaagttcacccgttgtggaaagttcccaaacgttgtttccataggagtcgggccgtgtttcaacaccgctgataattcaagtttagccagtcaatttcgtccttttaataaaaccagtaatcatgcacgtgcaatacatgttctttccatcataacatgtttcgactaaattttacaatttatcagcatgagcccttaaaaatattggcggttcatcttgagaaataaagcaacacttcaatgtgtaaaaatacccactattatacactggaatccatgtagctaagaaataaatctatttaaacagaagtgaaacaagcatcatttctattttcatgcaaacataaatgaacaaacaaccaattcgtgcacataggaatccatgtagaatattaattgagaaaacacactcattcttacaatctaatttgaagaggaggtatatattataaatccacactcacattattatcctttcatcacaacaataccatatagatacacccccaagtgttgcacataattttgttaaaacttgagtgccccgggccatacctggaggaccacctcaacaaatccacaatggatttagccatgcagaatcgatcatccaaaaacaaattcctaatacatgaataaagataggtcacaagttttagctgagaaaaatatcacacatatacaattgtacaaataaaaagttatatctgcaatcgtaccagcagacctgtaaaggcacctcaactctaatgctaacatatttgtttccatttggcagtggaactgatcatctgcacagtcagaagaaaaagaacataacagtagatttgtcaggatcaatggacgtgcaaaaattcaccgtataaatgttcaatgggtgaattaacaatgaaaactttgatgtcaggtcacaactctaggatcccacttacagaacaaccaagatttttcaagaaatttatttctgcttcaatctgcagtttccgtttaaccaatcatgaggcaagtatgccaaaattttagtggtttttcctaacaatattgcctataaactataattacttcactaatcctgaacctatttcgataaaagaaaacctagaaaatccactttgcagtttgcaccacgtcgagcattctcattctcattgaaacaaaataatagatatttttgtgtcattccaccaatcatatagatcatctcctccaaaactaatttgtgaactatgggaatttgtccatacatattttagatcattaaagcatctgatagtacatcacattgtattcctaattctgtaagcaagatatttgcacgcaggatgtttttttagagaaaaggtcgaagaacgaccctgcttatatagaaagcaaatttgtcttgctggggattccagcttacatcaatgtgcatacatcgaccaaaagaggcccctccggcctagagaaacaaccaatttttagacagcagggacaacacaagacccataagtgaagatacagcaggcgcatcgattcaaaaagctttccaaaacacctccacaaagtaacagacagcaaaaaaaactctaactaacccaccccagttctgatattttgcagtccagcacagcattccttcagtcttcttgtcagcaactccagttcatcagtctccacacctttgaaaagtggtttccactgcttgtctttgcactcaggatgttgataaaatacaaattaattagcctcattttgttggtaaagggatgatgcgagtactattgcaactgcctcctagcatcctttccattttgttttcctggccctttagctcattttcacttctagaaaattataattggtaccctttatatttagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccagcggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttggcctctggtagtcaggcctcggcccaccaccaccgccaccgcctttcgtaacgcatgccgcccgtgcccgatcaccggcgccgcctccctcaatctcatacgctcgcggcggtagtggcggctagggacgacctcggctccggcggggacagcgatggagggcagtggcggctggggacaacctcggctacgtcagggggcagcggtggagtgcggtggcgggtggcggtggctacggccgggggcgaccacggctcggtcttcggtgggggtagctgtggagtgcggcaacagcggcgacagccgggggagacctcggttccggcggggcagcgatggagtgcggcggcggcaacacggctggggacgacctaggcttcgacaggagtagtggaggaatgcggcagcaacggggacaagcaaggaggagcgaggagcgcggaggcggagtcttcgcgcgagctaaaatcatgatggatggatagggtgaaatcacggtcgctgtgggaagggtgaaatcgccggtgaacggtgcggattagggattaggcgatgcggatgcggatgaacggtagggattgattcgggtgatttggcctgtaggattggagggggacaactcctcctttttatattagtatagatatgatgttgtaagtttaaccaccagccaaacaacgttcttttgctgagttgggatcctctcctgtaatgcatgtgcagtaagtgccaatgacatgtgggcccggtataggtgggacccacatgcatgtcagtgacacgtactgcaggtgcagtacagcagtggatttgcgtcctcttttgctaggttctcaacttctgcactccatcgtttttagcttcccgagctgttaaacatattttgcaaaaattttctatagaaaaattactgtaaaaatttataataatctattttaaaaacttttatttactagtacttaattaatcatgtactaattcattactctatttacgtgtcggtgtgaaatgttcccaacacagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccttttgtttccaggcggaccatatgtggaaccgcacaggaaaatggggggaccggcgctaggccatcgctcacacagaaaaatcaattttcatgtgcgggtccacatatggtccgcctggaaacaaaggggttcggcgtccagaaaaatctttcatgtagtagtgtgcatagcatgatgataaaagcagtgccattgtacaaccatgacaaaaaacccgcggccggtgccggtaagtcttcatttgtagtgaatctgcgagaggcgcagctagcgctacctagagatgaggatgatgtgtcgttcgtcaggctgt

SEQ ID NO: 71626 - DNA, 1459 bp, Oryza sativa
gcgtttgttcttatcttacccagaggccgcggcggtggcggcggatgcggttgggcgacgggggatgaaggagattagggcggggtcattgagggcggcgacctggaagttgagggcggcgtcgggtggtggtggcggtggtgcgcaggggcagatcctcgcgacgactctgacgccgccgccgccgccgccgggttcctgcttctgctgctgctccattcccagaattttgttttttcttttgtttttggggttgtggagatcgatctgggggatgggaggagatttgagaggagcgggggggtggggggaggagaggaggagcgtttctttcctctttttgaattgggggaggctgcggaagcggcggaacggtcgaatcgagtagagtcgtgtaggggaaggaggggggaggaggagcatagtgtgcgccggtgcgtctagcgttagtgggccaggcccatgttaaagcccatgccatctctcccccagtcctcgcaatggaaaagtacaccgaaggtccctcaacttgtcatcgagatacaaaatcgtcccccaaccgtaaaactagatatgacgcatcatccaacttacaaaaccagtgcaaactaggtccctcggtgattttgaccccggttttgtccgaacgtggcgggtgaatcagcgtgggccccatgtgtcatgatgccaggtcagcaggccggcctctcccttcctctcctttcctcgtctctttctcacaaacacacacaccctcctctgtggactgggcaggccagccagcggtggggagaaggtcgtcagagcgaggaggtccgacaggcggccgacgatgcggtggcggagacacgagagaagaggagggtggcggcagggcgaggcggtgtcggcgggcgagcgcggtggcggagaggcgacggcgcctaggcacctccacgaccaccccttcaccgcctgcgtgttgtaccgcctcgcccgcgcgcgcctcttcccactcgtgcccccgctcctcgccgcattgcactcccacggcggcccactccggcccaccgtgtttgcccctgtcatcaaccacctcggcgccgcttctcgccccgacgctgcagtcgtcgtcttccgcgccgtcccagccttctactcccactctgccgccacattccatttgttcctcaacgccctcgtttccaatggtcgcgcggatgccaccaaggacatgctcccgctcgccccgaagcgaggcgtccacctcaacgccgtgtcgtacaacatcatcctcaacctccttcccactgccggccagcctgcccagtccagagagaagagtgagagagtgaggaggaaggagaggaacgaaggggctgcccaactccactccgccggccgccgctcctctcccctggccaccattcctctgccttgtgggcgcggccgacgggggagcccgcgcgctgcccgtccc

SEQ ID NO: 71627 - DNA, 6145 bp, Oryza sativa
tgctgttcttggcttcgccatgggggatgattgcaacgtgtccattggtgctcttggtgtgcaagtagatcaaggacctgcggtgggccaatcgtcctcagatctctaggcggagagcgatctcgctagccgttaggtcctacccaccactacctagcgagtcgacatgagggttggcgaggagaggggtgttggccgacacatgctgggggctcatggcattgtcaaggctacctaccccgctatcgtcccctgcgctgaaacgttggccctcatgagacgaggctccgtcgccagccctaggagggttcacttgtgacatcaccccccccccccaacaatgatctccagtccaatgcctagaaggttgacctccttgcacccttctcctctctccacgacatgctctgctaccgtgaagattgtcgtcctcttcggctcccataccgccgacaacacccactactccttcttccctgagctctcgcgtcctcctgcaccaccacaacctcccaagctctcgtcccgacctcgtcgagcgcctcgccggactgccttcctcaccggctgctactaccgccttatcgctgccttgctaccatcgggagagatggaaaatagagtagtccctgacacgtgggtcttacactcttatcttacttgcttactcaccgagtcaatcatgaccaacctgtcacattagaaaaaaaaacgtttcctaaaccatcgaagaagtcgatttgcaccagtttttgtcttggagaggcgttatacccggttttgcgcttgagccttgagagatgcgattcaatcataagcaagataagaagggagttaaaatagacttagtcaaccagcaaatgtatgtccctttgtcagacttggatattcccagcccattaatctctagtctggtctcctcggtccgcgcgctgagaatcgccaaaacctatgtggcccatcatccgccggtccgtgtggccttccaaggagagcgacgcggcgaaagcctcacgcgtttcgttccccccttggccccctccccgctcactcacccagccgctccctcggctcggcagcgagcggcagaggaaaccggcaaaccgcggtgcgcggcacggcgcgcgtcctgcactccagctccgcgccataactgcgatcccctcctcctcggcctccccctcctcaccggcaattaatgccgccaactaccagatccacccctccggaaacctaaaacaaaatacccctcttcccgttttgcccctcctcggctcttctcccaccccagccgcgcccccccgcacgccatgccattccgccccacggtctcgccgccgccaccgccgccgccgtcatggcgtcgttcctcgactcgttctcctcgctcggcgtcgggtacgcggtcgccatcgcgctcggcttcctcgtcctcctcgcgtcgctgctcctcgccttctacttctgctcccgccgcggcggggccggggtcgtccgccgcggcggcggccagggggtccactccgcgcgccacgccgtgtcctccgcgtccagctccgggcacatctccatcaccgtcccgcgggtcatcttcgtcgcggacgactccgactccccgggctcctcgtcccgcggcggcgccgggggcggcgcggcgtcgtcgcccgtcgggctcgaccccgcggtgatcgcctcgtaccccaaggtgcccttctctagggcggcgacgggggcggacgccgaggccgcgtgctcgatctgcctctgcgagtacaaggaaggggagatgcagcgcatgatgcccgagtgcaggcacaggttccacctcatgtgcctggacgcgtggctgcggcggagcgcgtcgtgcccggtctgccggtcctcgcccatccccactccagtctccactccgctcgccaccccgctgtcggagctcgtcccgctatcacagtacgccgccgaccgccggcgccacaggtgacggaattgggtgcatcatgtcttctcttctatattcgttttttggcaccattttctactggttatcaacgatgggatggtgtatccattgttttattgttcagatgaggtttggctgatccatggcaatattagtatatttagccatttaggtgagattgtggactaggacagccttgactttgaggaagttttgcttagtagcagtagatcgttgcactgaagcagacatgcagtgtatatacattgttttttccattcggatatagtagcttttaccaagtaaggttacttgccctacagttgtatgtgcaagatcaatatctgaattgcttcattccagttatatatatatatgattattgcacttacattacttgtatgttggttaccattctttggcggcaaggacatgaaaggaaaaaaaaagttatttatcacaggatatagcattttatcatcataatgattttcatgctgtaacggaaggggaatatcctaactaacggtctttgtcgggactcgacatatttcttggttttaaatacagttggctactggattatcgataattttgcgcattgatgtatgtagcgtggacttttttgaattaatgtttggttcctgagtcataaattaagtagcagagaacatttattcgcttttgtagatcacttgccttgttaggcaattgtgttttcctcaacaggatcagttattttgaacttttcagggaggtataagtaataacatttgagataactgttatgccggttgcttctccagatcagttcatcctgttttttaagttagcttgaattctgaactgttatccttattgggtgaaatggtcatacttccccactttggtcatttgatttgtgtttactagtttagttcatgttcggtgttaatgttctttgtttctatggaggtatatataccgctgttttccatgaattaagctagtaacagctgtaatgaacttgtatgtccctaaatgtgagaatgtgtgctatgtcattcaggattctttaattgcagagtaagaaggttttttcatgttaactggaaagttgtgactacccactagtttcatatttagacaactacctattgaataataacccttatactgttatgaatagtcgatgtcagagttattttgttttagtctgaatttcccatctagcactgtgctgttctcatggtgacattctgtttgggtgcactattttaacttgtcatttccttgttattctatttgcactgtgaggttagacagcttgcagattttgacgccatctgaagatggttatgtgagttggaacttggagggactctattatgaccccactttcattcatggaatcttgagggggtgtgtatgtgttcataacttcatatggggttgaacaacaagagctaatgtggaacatgttatcatgctctgcacatgccttggtatctgttggctagttatgcctgaactttgagcagcaaaaacttggaaatttttttttcattttacttgatgtagttacgaatacctcactgattagaatgttttgtgtgctaaactcaatgcacttgtatgagtacctgccagctacacctctaaattccaattcactgactgtgatagtctaggttgatctttttctttcatgtttgatacatgcagtttgtgtgctgtgctgttattattttctaattactgtatggttgtacctaacaattttctttggcacgggaccttacccaagtcaatagctaaaatcgttagggacaatcggtagttcaagttctgaattatttttttagccacattaccttttgttttgcttttcccccctaatgtaatgtatgtgattcttgaaacttttgtgataatttttgttttatgtaaattgataagttttatgtattgtccagtttcattagttacattcccttggtcgttcatttctaggcttctagcacagtagcacggccatctgtgctggtaagaagctagttttttttttctatagctggtatctacagaggaaacctggaatgctatcagaatgctatctactgtatatcacctttaattggttattttcctgtctgttttatacatactctgaggctgttgtggttgacaatgcactcctatcttgctggcagaggtatatggtgtttcattttcatgcagtctattcaaatcaccattttactggcgttgcaaaggtttctttacatccttttagctaattaatccttatgcatcgtcagtaaacatggtagtgcgtctgcatctataaagttcatgtaactcagggctgtgagactgctacccaaatcgggtctacccaatccatcaaacacaggcatataataatgctattgggtattatttcctagagagaattcgatctgtgaacacacgaaagtagcataatatatatccagaaaaacatacatacgagagtagcagaatatacatccagaaaaatacatattcatatgtaatgaggtgctgtaatgacaatgcagtactcacacaagaaaaccgctgatcagctcacgattgcaacgcaatccacgctcctagtctgcacgcccgacttggccccgtccccgggcagcagcacgccggcgatgccggcgacgtccaagatgaccgagcagttcatccgaacgtcgaggctcttcttgatgatccccagcacgctgaccctcgccctcatcgccgtgtaggtggtcaggtcgtactcctgcccgagtatcagccccgtgccgttgagcaccgacgcgaggcggtcggcgagcaggtcgagcgtgatgttcatccgcaccgtccggtcggcgccgacgctgccggcggggacgtacgccacgctcaccgtcttccccttgtagtacacgtccgtctcgctccgggagaaccggagcgacgcggcgttggggttcttgaccgagacgtcggcggtgagcgtcgcgttggtcgccacggtgctcccgatgccggcgccggtgccggggccggtgctgatggccgtcacccacacgccgttcatggtgatgcgggggtccttcaccctgaacacggtgagcgcgaggacgaggatgacgaggccgacgacgaccagggtggtcacgcagcagccgcagcagcagagcgcgcgccgccgcttccggaggtactgcatggaccgccaccccgtcgccgcctgcgcctcctcctcctcccccacgccggtcgccgccgggtggaccgacggggatggcaccgcgaatggccgcgccggctcgttcttgttctccgccgccgtcgccatgggagctggagctagctagctatagcaaatgtcacgaacggacacgaccgtttttgttagttacttgtctgaatggatcacaccacctagctcgaacctgctccgctgttcctggtcttggtcttcgatttatacatgtggccgagcaagtccactgtcgtggctgcgacactgtcatgcgccggatttgacacgtacgcttgactcgtggaagcttgagatgatgactacgtttgctgctgagtccatagccgtgtaattttcacggactgtgattggtccgggggtctttgtgagttctgacttctgaataattatttcttccttctagatgggaaagattgtatgtatcatctttccaaactgcgtgaaaagaaaaaccgggtcgtcctgactgaatgattcttgatatcgtttaacgcatgattcttctagatatactgatatttcttttctcaatggaatccgattatctggtgcatataatcagagcaccgattgatgatggttcacttcgagactaaacaaatgacatgagaaacacgtggagacggcaaaaaaacatggggttgacaataagctggcgattactcgtttccgaggagtaatcagagttgatattgagcgcatgaattggaatgtggccacttggcacatgacactaattcactggcattcttcccacttttttttggggggggggggggggggggcaaggataacttgaattcttcctgaatgaaatggagaaaaaaaagtattattcgtattgtaaaatattgtttcattggaaaaagataatgcttcctctcaggcgttcaatgagggagaaatatcat

SEQ ID NO: 71628 - DNA, 693 bp, Oryza sativa
  unsure (1)..(693): unsure at all n locations
ggcgccccttgaggtgcattgcnnnnnnnnnnnnnnnnnnnnnnatgccattcaccgtcaggcgggtttggttcggtctgaggaggcccagccgctctcctcttggcaggctgggcgctgggctgtaggcaatcacgggcctcctggctactagctgttccctgccgcgcggggcgtcgtcgcccttcggcctttcttttcgggtgcccgtcgtcggtccaaacgccgccaccgacgccggagataccgcgcaacgctaaacgctgagcgtcagcgatctaaaataccaccgccgcgacatgcaacaagacgtacgagaaaacctccgcacacactgagccgaaccgaacagccagcgagcgaccccgtttatccggccaaccaccatccgatcgtgctgcgtacgtgatgggtgcagttgcgatgtggaaaaaaagccgccctataatgggatgcagctggggcaagagggaataataacgaacagcctccaaatctatcgtctgaaaatttcttcgtggagaaagctcaaacccagccgctaaaactggtcaagatttcccgcacatgctgctagctgcggccgtttgacatcgctgccgatccatcgtcaggtattccgtcgagaccgcgacaaaaacgaaaggccgaaagggtgtggaatatcttcaaatcgaaggcatgcaagagcaa

SEQ ID NO: 71629 - DNA, 727 bp, Oryza sativa
acgcgggtgatattctactctgttatggcgcatcataccactcaccacgttgataaacgtacagtcgacctgcaggcatgcaagctagacaatttgctttggaaagtctttccattcaccaccttgacgaagcagaagtcgcttaggtaaagcactagtcatgaaattctgatcactctgtataatctgcattttgaaatggcacttgatctttgccttgtgaccttcatcaacataaaacctaacaacagagttatcggcgggatgcttatgcaatttagaggtgttgccggcatcagcgcaacgtgcagctgggttgtcccgctttctcttgaggctacttatgtttcttccacatttatccaataccttttcgttcatcgcagccatggttgctagctgaaatgaaccagagactaataatttctaacaaactaaactccaacaagcctactatttacactaagctaataggcaagcttctgagtgtactcaagttcattatcgacgaggcaaaaaccaaaaagagtcgggtcagaaagaggcataagcgaaatgatcctgaaaatgaaagccagatattagagaacacttccaaaacacaatattttaaatcatcaatacgacagactgcatgccaaagttgcttcaaacaatagccactggtactagcattaaccgttgttgtgtggtaccttaggccgcccgagattgattattggataaa

SEQ ID NO: 71630 - DNA, 1120 bp, Oryza sativa
aaatatattgtgattgtgaaaaacatattattttgtaattgttggtttgcattaacaaatattgtcatagcgttagcacgggcaaattactagtatttctagctatcattcataatattagatctgttttgtctttccttgtagtgtcaaaagccaagatgtaaaaggctaattagtagtattatgttttattcatggattcatctaagtttagaagtccatgttgcaagtcgacaatgaactgttcaaaagtagggttgtagtgttaaaaggagggttgatgaccaaagtaatcaatagaggtgtagcaaaaaaaaaaagagaaagataagataatatgccacttggagttgtccatttcaatccatatattcaactcaccagtcagcttcaatgccgagtcaaacctttccaatataagagtgtcatgacccgagagggaaatacccgacaatccttgatgatgaagaattatggtgttgaagttcctccacatgctccacttgaacgcttagcacttgcagcacaagtatggtcttgtagtttgcggtatcgatgactcctaaaatctccccatcatcaatttccatctcaggaacattggtttcacatagaaggttagcagcaagagaatattcttgctcaacatcactagaacttgcatatccaccatcatccgtagcgatgtatgcatgctgacttgtacaatccttcatgacatgtcacatacccttgcattggtgtcgtatgatccgattgtttgccccgtagaagctactgacgaggtacttttcgtgggtacctacactttagtagacttgtaaaatcaaagatgtttttgattattattctgtgatgaacaattgggcattggatattattggttttattatttggaatttattcacgaagtggttttggagatgattggatttcataggtgaatatacaggtagtgctggatttgggtccggtcagaccgggcacgggttgccggtcggaccggcgtgtattgcgcggtcagaccggcgcagcccactgtctgaccggccgacgctgtgtcggtttcagtttcgggttgtttatttggatatccatgattatttcataattatgactt

SEQ ID NO: 71631 - DNA, 633 bp, Oryza sativa
ccaaatcagtggttagtcttcaaagtagggtaaaaaacgcaatcgccctatcatataaagtcacccgattatctccaactagggcttttctaaaagagacatcaagtagtacgcttgtgaacatattggccaacacgacatttttcttgctagcaagattatacaacgaggtaaataacttatcaaaagaaatgtctcccaaaacctcaaaattgagttccattatgaatcacaaaagatccatgtgagagaaagagacgatcgacatggatgatccctccaagcagaggcgttggcatagtacagagaacaaatcggagggaaggacgagacaacatggtgaggggttgagaactatacatgcttatgattgtggcaatggtgagtaaataaattgatttcagctctacaatgtggtattttttcttcacaaaagccagattctacttctcatcggtcttcacaaaccaatgtagtgacacgtgccaaaagcgagatgaaaagatagcttgtgtcttttgctgggggaaggcagaactgaaccatgctatacaccatacattgacctatcaatcactttcggacattgtttggataataggattggaaaatgatttcccacccatcaaaagg

SEQ ID NO: 71632 - DNA, 771 bp, Oryza sativa
  unsure (1)..(771): unsure at all n locations
tgaggtagaacgactactactgcaagtacttcatcagataaagtgaggctgggagccgaggggcgaggagctccaacggaatcggcgcggaggcctatcccctctatccgcgatggctggtagcgcggtggccgtgtgcgtttgtggtcgtcgcgtttcgccccccaggtgatcgaggcccgagctaagtcgagctactagaggcgagcacggctttgtcctgtaccgccacgtactacggcaacgcagcaagctagcgggggtgtagttgttgttgagcagaggcgccgacgccgacgccgacgtggatggtgcgagattatgaccaagtacgtcgtgttaagctgtgcgcccgatgtgacggcgaaacggttaaccggagagggggtctcgcaaatgggctccaagcctccaactctccaaggtagaagttgtttgcctttaatggcctagcatttacgcgtggaatatggcaccgggttcgacttcgagtgagagctacagggcgggagggggactcgcaggcgactggacgctttaccttcacgctaggctgctcgagcttccggtcagctcggggaagagctgctttaccatggcagtgtttagttttcccctatttctgactttccatcacatcataatacaccaaaaactttactatacataaaccttttaactttttttccaaattcccaattttcttcaaacatccaacttttgttagaaataaaacacaccccatttgacttatcctactnggatcgtctc

SEQ ID NO: 71633 - DNA, 2513 bp, Oryza sativa
cagctgtggaatacagtggaaattcagattctgaatctgaaatatttcgagtcaagcgcaggtctggcgtatcagtaaagcctgcatctgatgccaagacatcaaacttgtctgatcaacaggtacgttaaattttcatcttttacacccctttggcttatcatcaacttttaggtactccctccggttctaaattaattgacgttttggacaaggttgagatcaattttttataactttgaccatcaataactttaaaaatatttagtttaaagaaactaaaacaacatatatagatttgtcttttaaagcactataataaaagtaaacatgtatttatttattatatatattatagtagaaaaataaggtcaaagatatatcttgtagaccgtgtcattgtccaaaatgtcaattaaaatggaaccggagggagtaattgcactgtttaagggaaaatacttcatgtaagaataaatgacatgctatataaatggccaggcatctccagttgtcgaggtcatttgatagataataatgggcaatcatgtcataaataaataagttgcagctctagttatgtattaattaagttcctgtaccattttacaccaaggtccaagggtctttatatgaaggatgacatacgggcccatagcatttagttgtcctattttagatagtgcttactcttggttctgatgtaaaatactggaatcaggttctcagccggttgaaaaaggtgcgccctgaaatacaacagcacaataagcgaccagaagactatggtcactgttcagttccctcaggtcgtatgagtatgaagaatttgaattcatcctcttcatgtggtgaagaacactgtagtatgaagcggcgtcagttggagactcagcaggatgagagcagttattctgcaaagcagaagtcgtactcgtatccatccaccagctattctttccgaggagagtttgtggaaatgagtagagatgctgctgcagaagtccgaccaaagcgactgaaaatccggctaccttcttctagcacgaacagagtggttgagcagggcagttcagggcaaagatttacaagggatgacaagtcgcttggttgttggcctgcaatttagaatttagaaaaaaatgctgacgcaggtgctaacctctgatggagataaagatttccttgtttaggtggggctgttgactacacgaaatgatagggctgggatggatcgatgaggttgaatataaatgattagcacagaagctgactgactttagaaggctggttaatcgattctttgtgcagcagtgcctccaatttgaggcacatctaggcacggttagaagagacagacacatgacgattcttgttgctggaggttctgggtcactgctttgctgctgtttgatgcctgcactgcaagtgacgtacacacactataggacctcgctctaccctttgattatatctctctatttttcttcttctttgtcagcaaccttagctgctgctactctatagctaactgtattctttcatacgcttgttccatcaagttaatctgctgcttaatgccattgattcaatagtgaatcatcgttctttctggatggaatgcaaatatgcaatggtatggaatgatgtttggtggtgactgagatgttgcaattgaattttcccaaactgtgatgatgcagcaaggtaggctagggtaggcatcatctcatgtgagggaatttaggccttgtttagttcctttttttttttcaaaaaacgttacattgaatcttttaagcttaattagtctaatgatggattaattaagcttaataaattcgtctcgtggtttccagacgagttatgaaattagtttttttattcgtgtctgaaaaccctttccgacatctggtcaaatagtcaaatgtccgatatgacacataaaaattaattttcttttcgcgaagtaaacacaccctcgctacaatgtaaggttggctcgtagtgtctgtcgcacggtgttgcatgttactgcaacgtactgtacaaggccaggccaggcccggcccagcccaagaaagagagggaagtgagagagagatggagggagtcatcttcttcctcctgcggtggcggtgctgcagctgagcctgctgcactcctcaccggctgctgattgtgactgtgagtcatgttggcctccacttgcttctccgccccgccgccctcctcctcctccccgtcaatcccgacccacctcgccactctctgctgctgcttcaggcctcccgctcgcccaccttggcctcgctctcttcttcttcttggtgccttcccaccgccgacccgccccctcccccgcgcctccgtctcgtcatcgaccgccccagcgaaagactacgaggcaagcaaagcaacctgctcttctctccacatactagtatttcatcttcttgcttgcttgctcttctgctgtttagtttatctatctacgcgggtcacagtctctg

SEQ ID NO: 71634 - DNA, 659 bp, Oryza sativa
tttttttttgggaaaatcccagacataacctgtgtccatcgtgattctcatttaacttagcttctctggtgcctatataaacctctccatggtgtccatctgcagtgcacacacagaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcga

SEQ ID NO: 71635 - DNA, 673 bp, Oryza sativa
tttatgcttcgtttgctattattaatatgtatctaatttctcattattttgacgttgtgtgagtctgtcttatttaatcgctctatgcaaaatgatctatgcataaaatttcgctcttatttgattcccttatttgagtcctttattgctttatttaaatttggatttgagcatgcattgatcctactcctttgtcttctctagatggccggtcacccacccaaccaccgcggagaaggcatgatcgactttgttgcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacgacacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctca

SEQ ID NO: 71636 - DNA, 2795 bp, Oryza sativa
cctgcagccccgcccgccaccgccgctcccgtcgctgccgcgctgtgccgccgccacctatagcatcacagcacccgaccgcaccccggcatccactccatctccctcctccaccgccggaaccaccttcccatcgcgaggccgagccactaccgccacacaccgccttcagccggccgctgccgccacgttagtcgtcgccgcacctcgccgcttgcgccgtcggcaacgccgtgccaagctctaccccggcccctactccatctcccctctccgcctccggaaaatcgccgcctcgcgcaccacctctctcgcgctgccgccatctcgcctccctccgtcggccgcctcttgccgccatccccatctacctcacgccgcgccaccgcctccaccgcattcgctgcatcccaccgtccctcggccgtggctccgccgtggtcgggcgtcatcggaacgccgttctcgtcgcctcccgtgccgaccgccgccatcctttccgccgccggtcgcctctccgtggtcgtctcgccgtcgccgccctcggtgagcactcctctcccctccctctttctccccttggccggccgcctcccgtgcttgcgcgcgccgtgtgccgccgccggtggccgcccagcccgtgtgccgccgtcgcttcggtcccggccgccgccgccgcccgctttgtgtgagcgctggccgggccgcgccacccggctgtccccaagccgtccgatcggccttggccgatctgggccgtccacgtggtggacgcgcgcccgaggtcgcggtggacgcggtccaccgtgtgccctccccctttgactcgctgacgtgtggggcccgcgtgtcggcgccggccgccccttgctgacgtcagcaaggaccatttcctttgtaaaaataaataataattgcgcaataaatcgagtttaattctagaaattcatttaaatggctcaaaacttctaaaattcatatctaattcattcgaactccgaattgagccattcaaattgcaaaattcatctaaaattgagctctacatgtttgtttactttttatgtactgtttctttggtttttattagagtttttcctcgttttgcgtgccagcgtgtagtttccgtcgtttcggaagtccgcggtcgcgaggaaaagagttcgggagatcaaagtggagaagcaaggcaagtcacacattccccttgagcattttgatcctaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacattctagtatcttgatgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaactgttttactgtttcgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaatttgggctaaatttctgggcgtgacatcgcaccaccatacgcctctttgtcagccaccccctcccccccccccgggccaccttcaacacttcacctctgcacaacgacatctcacgacctagcatagctcgaccatcacactagtcagaactcaaaagggctagatccccctccgacccctctcgcacatgggaccactactccactcgtcatggagttccccacgactggatctggaagcataccaacc

SEQ ID NO: 71637 - DNA, 4859 bp, Oryza sativa
aaaatttacatatgtattattagttttgttgcgacttaaaaccataatcttcacttatttttatatatttatactaaatttccaataaaaagaatattttaaatgttatgtgaaaagttaaactatattagactatcgatgatcactaacgagtaacgactccattgtgattagtttagcgccgtcaacacatccatcctctgtaaggctgtaacacagattgccactgacgagtgagacttttctgaacttccactggtcacttctttgtaggcccgtcatgtcagtgaccttgtaactatagcttggaagagacaaaaagagatcacatgggcagggagttgactttcatggcagctggtcaactcatctgctgggtgcacgacatggaggcccgtagagtactcttgacttgttcttgagaacagcataaaaaaagatacgttcgtgcagatagaatcatttgccctctcaaataaaaaaagataggtccgttagaccatgaaagattattacgcacttgcgttacaatgtagaagaatctgttccccagtgaggcagtgattcaacaaaatacttccaaatttacaaattcccctagttagcaagattccggcgcagactgtagcacaagaagtatatagcctcatattttttatgtatatacttatgcttataagctatttggagttgattttgggttttttttatcgtagtttatttttcagcatttgcttttacatcattaagagtacgcacataaaaattttattcacaaattattttttattgtaaatatgccgcattatttgctttgtactagtagtttttggtatatacatgactggagggagtccattttaacaagaaagttctcgttgtattattgatcatcatttatctattttttttaactttagttattggcaggaaatgtttacatttttcttcaagcgcgtgcgctgcagttgcgaaattgacacgattccatctacttgatggatgatttttttttttcaaatggatctttctcgcgcgattcctcttagtagagcatgtaacgtgcagagtcgtccctcaaaatctaaggacccaacactaaatataaaacgatgccttatatttataaaatatactcatagaaaattacataacagatcagggttatatgcattttgacttgatgcggatagtttacaatgcaatgggatgggtttctactaccactactttttactcaattgcaccacagccaatgactctaaccacgccagaaaagtcagtatcaatctaatgcttatatgtttataaaggtatagtcagacgagtaggaatcattcacgatcaacggcaactagagctatgccgaagaaactctttttttctacttagccagatcgccactacatatgtggtgagtaagacgatctggctaattaagtagaaaaaaaaccattgcactaatttagtttttcttattaagtgaaaaatggaattattattgcttggaacatacgttcacctcgtcgtcatgaactacacatttttgagatagccatgattattaccaaacacttactggattcaagaataaaaatctcattctagccagatcagtgaagcagaaagagagaaaatcaaaaggaaaaaaaggagtgaagagatcttacacatattagaacgtctcgacatagattgaactcacaaattttgggggcccaaatttctggtgccctgtgtagtcgctcatctcgcacatggccaaagaaagcctggtaatgtgtaagacacttttccatctctgaatttccattgcatgctagcctactaagcttaatttgcagattccatatctttttgtactgaacttatgggtttatttccaacattgaagcaaagtagcatttagaaaaaaaaatagagaaaacatgcatgggttctgattaaaccccgttgtaaaaacattatgaatgaagttcattgattctgagttccaaactgaaaaaagttctactaaaaaatcttgaatatttgaaatttctacatttgcatttgctttggtgtaacatcatgtgaaagttccatagagatctctaccatgaaatggcattcaatcgaaatgagcaaaataatttatcgtgcagcaggaccgccagtgattgatggtatccttccaaaattttgctccatctctaatgtagagttgttctgacgcaaaccagtggattgttaagtggtgtagaagttagagtttagatcgccactattgccattataaaagccattgtttatatcactgacctggtgcttatcctctagctcgaggcactcttgcaactgtgccaccacgtcggtcatagtggggcggtgtgctgacgaaagcgccgtacacttgagtgcaatgtctgcaaccttccataggccattcacatcgtagtcaccatgcatgcttgcattcaccacaccctcaatgttaccccgtgctaagcgttgttgtgcccaatggatgatgctgatgggctctggatcacgcaagatagctggcttccctgttaccaactccaacaggacaacaccaaagctatagacatcactcttagtcgttggttgcattgttgattggtacctacgcatttggtcagtcccaataagtcttacaattagtatttctctaacaaaagaactttaaaaaaagggcttcaagaaagacaacatactctggatccacatatccaggtgtgccaacaagtttgttcgtagatacatgggtgccgttctcaggattgaaaaccttggacaaaccaaaatcagcaatcttggcctctagcctcgtgttcaacaaaatgttggttcccttcacatcacggtgaataagaggagggttgcaccctttgtgtaggtactctagccctgatcattaattcaccatgtaattgaaatactgatcaagcttctagagagagaaaaaatgtaaaatcaaactaaaaatagcattagaaattctaagtagttaccttgagcagattccagcgcaattcgaagcctctctttccaggttaagtatctcccatcatttccttttcctgcaaatataagaattggagatcatgaaaggactaaaaaaataagctggtagatgaagttagttcggacctgcaatgtgttcttgaagggttccttctgacatgtactcatacacaagtgccatatatttctcatccttacaatagccgatcatagagacaaggttcttgtgatgaatccgggttaaaatttgagcctaaagtggtgaaacttgtctatttaatgatgcccccatggagacttttcttgatagaaatttttacatagcaagaaaaagtgcagcttaaaaaattctacctctacaagaaactccttatcaccttggttggaagattcagtcctcactttgactgccacttcagtgccatcctccaagaagccatcatagacttttccaaagcctccttgtccaagaactcgctggaatttgttcgttatcttctccagttcattatatgtaaaccagcggttctcaagccgcagtgatgaattatgcccggagccattatttgttggcccatatctcattgtctcgttttgtcgctttacagaattgttcattgatcctttgtacgtgaagaatggaactagcatcagtagtattcaagaagatgaagtagagcagacaaatgatagcaagacccaccttgtttttttcttctcagtaggcaatagagtagtgtcgtcactgatactatcgcgaggaccagaactataggaacaacaatgtagatagctagcttgctcttgttttttggtggttgacatgagttgccattggtgcaaagatttgggttatttccatatctatatattaatgacataaatatgtttatgtccattttctgaaaaattgatctgcaccttttgctgaagaagactgctataagaagaatgtggtgtcattaccttagatttaaaaagccatcctgaattctcttgagaagtccaggcggaattgttccatttagttggtttcctgtcaaatctctaaaagaagacatacagtaggatattagttcaaaaggattctaaagagtacgtaggtaaaagagtaaagtacatggtcggtccttaaagttggagcgaggtgttacttaggtccatgatcttgaaaaatagacattagggtccgcgatcttgtttaagtgactcattgaggtccaaaggacctctgaccaggttgactggcttacgtgaccgtccagagtggcagtatatttgcatttcgcccccctcccccgcatccgatccaacccttcttccccatatcttctttcagtatgatttctatggtttgcggttgcaggggctggcggcggcagtgacgacgaggagggagacgggtacggcgacgagttggcgagcatgcgcaaagagggagaagggcgagtagggcggtggcggcggctggccagtggagcgagacggcgggcagcttttagggttttggagggttcgacttggggcggtgagggcgaggtggtgtcggagagggtgaggggacgatgaaggggttcgacgccaccaatgggttcggcttcatcactcccgacaacggcggtgaggacctcttcgtccaccggtcctccctcaagttcgacagctatcggagcctcaatgacggtgatgtcatcgagttatccatcggatccggcgacgacggccgcactaaggccgtggacatcaccgcgctaggcggcggcgcgcacaccggtggatcccgtcccagctgcggccagatccctacggctgcaagccgccgtctctcgacg

SEQ ID NO: 71638 - DNA, 15672 bp, Oryza sativa
catgttaatacatcttcttaatttttttataaccatttgagtgacatgtaaacaacgagtagatatcccctcgagggtgaaaatagtttccgttgtacacacgagtctactgaagtgtggaagtctccagcctactgagacagagcttttgcaccatgtggtattctctacacgctcagcttaattgccagatattaacaaaccgaaagtagaagaggaacattgatcttgcatattgtgatagagcataatactattccatcatgtaagcacggctccagagtgtaatctacaagtgctgactgctgaagcagctaatcagcctgaagaaactctcacaccttctgctcacatcagaaatacagaaaaatagcacagttcacagcgggtaaataatgcagatatgtgattttgtcacattccagcagcaatataaatcattccaactcaatgttcatcttttgtgcttgatcgtttgcactgctcaatgttcgtcttctacgctttttcctttgtagtgtttccaaagttcaaatccttcagaaattcggtgaacgccaacgacgacgacccgccgtctgccagcgccttcgcggccatttccttcgccattgtcagtctatccctgagttttttcccttcctcgaactccatgaccaacctcaccttcttctccacctcctcggccttgaccagctcctcatcgtagccgtccatcaccactccgagctgcatgccatccaccaagagcaccttgttcatcctctgctcggcgtactgcggccagcacagcatcggcactccggccgacgccgcctccaggacggagttccacccgcagtgcgtcacgaacgcggcggtcgcggcgtgccggagcacctccacctgcggcgcccacgacgtcaccaccattcccctgtcccgcgtcctctccgtgaacccctccgggagcagcattcccaggtcaggctccggacgcggcaggaagaacttggccggatcctgcggcgggctacgcaccacccagaggaaacggtggccggaattctcgagcccacgagcgatctccttcagctgcttcaccgagacggcgcccaagctgccgaagcagaggaacacgacgctcctctccggctgcgcgtccagccacgagaggcatgcgtggcgttccccgttcgccgcctcctcgcctttcgccatcaacggcccgatgcagtacaccggcggcgtggggcggtcggggatgcaggcgccttccctgagcgccctcacggacctcgcctccagccattcgtaggagttaatcagaataccccgcgcctccgggatccgcccgtagtgccccagccgcgtagcgcaggtccggtccgcgcggtcgagcacggtgtgcggcatgtcggaggccgggatcggagggacgccgggaaagcggaggggcgtcttacccatgtccttcaagctgccttccgtggtggcgaagtggtgcgggaggtggaggaacgcggcgaggtcgccggcggaggaggtgtagtagaagtacgccgggacgccggccgccgtggcggcgtcgagtgcgtcgacgcagaacaggtcgagcacgagagccgcgaccgaggggagggagcggaggaaggcgaggaggggtggcacggtgagacgcatcgtgtcgagcatctgcaggaaggcgtcgggatccgggtcggggtactcgggcggcgggaggtggtggaaggagatggaagggttggcggccgccatgcggtcgaccgcgggggcggacgaggagaagaagtcggcggtggaggccggcggggtcggcacggcgatgacgacggcgaggccgcggcggagaaggagcttcgcgagttcaaccatggggatgaggtggcccacgccgaggcaggcgtgcagcaccaccatcggattggggtctgcctccatcggcgccggagattcggcggccggcggcggagagagtgacagactgacagtgcgagtggaggggaatccgtgggcgagagaatttcggcgtcctgtgtttcgtctctccaccactagtagtggcgactgacgacgtagcgtactccatttgggttgcggcggaattgcctactgctccgtggtagcggatgtatggcccatcagcccatatagtgaaacatgacccgggctagatgcctagattgcgtcctgttgctcacgttccacccaatggcccatgtgtgaccttccttagcttctagcaacttttgctgaaagcctgaaaggaatgaaactgcagaggtgaagaatatgattagaggtttggaataagttcatttatggtctcttaacttgacaacgagttcgatttcgtccctgaaccgaaataccagatacaacgggttcctcaactatcaaaatcagtgcaaataaggcctcacgacggtttgaatagcgttttcacttttcagctgccgtgatgcctacgtggatggtttgaattgtcctcgtcttacgtggcagtgagccggtgatatggcactggaagcaaaatataaaaattaagaattaaaacaaaaatataggccccacatgttagtaaaaaaaaaaagtgggacccacatgttagtaggtcccaccctcttctcatctgcagtggatgacggcacgtcaacaccttttctcgtctccctcccagccatctctcttccctccttctccttgagctccctcacttgccgacaaccgctgccggcgacatgcgtccaactcctccccgactttctccctatcttttggcccctaaacgagtccaactcctcgccctcgcgccacaggtgcgcccctctaacttgccatcgccatccccgtccctcggtcaactccacctagggctgtcaaaaaagctcgaggctcgtgagctgctcgaactcggctcgctcaaggctcgactcgagctcgactcgtcgacgcgagcttcacgagccgagctcgaattgtttgacgagcctgtctttactttctttttcttttggcagtgagtaatagcataccgagtagtactaccagtagtattcatttatcatgtcaacatcacctagctgcttgcagagtggagtagtactcctactagttagtagtgctaggagtagtactactgcatgtctgtcattacgagcgccatcgtcaccaaaatccaacagtccatccaagcaaccaatgcgactaagctcgatagcaggctcgagctcgagcgagctcgagccgaacccatctatgagctcgaggcataaactaggctcggctcgagctcgactcgaatatgtaccaagctcgagcttagatgggtaagctcgctcgagctcggctcgttgacagccctaactccacccccgccccggcgcttcggccgcaggcaaggaaaggcaagggatcacgagccacaagttgcatttcttccaccacttgttcagtgaccctgcaatcgaggtttcaaggtagaagagaagggaggcaaacaaccagtggtagagaaatgcgaagatccggtggaatgcggggatgtggagaagacatatgatatttctccctcattgaacgcctgagaggaagcattatctttttccaatgaaacaatattttacaatacgaataatacttttttttctccatttcattcaggaagaattcaagttatccttgcccccccccccccccccccaaaaaaaagtgggaagaatgccagtgaattagtgtcatgtgccaagtggccacattccaattcatgcgctcaatatcaactctgattactcctcggaaacgagtaatcgccagcttattgtcaaccccatgtttttttgccgtctccacgtgtttctcatgtcatttgtttagtctcgaagtgaaccatcatcaatcggtgctctgattatatgcaccagataatcggattccattgagaaaagaaatatcagtatatctagaagaatcatgcgttaaacgatatcaagaatcattcagtcaggacgacccggtttttcttttcacgcagtttggaaagatgatacatacaatctttcccatctagaaggaagaaataattattcagaagtcagaactcacaaagacccccggaccaatcacagtccgtgaaaattacacggctatggactcagcagcaaacgtagtcatcatctcaagcttccacgagtcaagcgtacgtgtcaaatccggcgcatgacagtgtcgcagccacgacagtggacttgctcggccacatgtataaatcgaagaccaagaccaggaacagcggagcaggttcgagctaggtggtgtgatccattcagacaagtaactaacaaaaacggtcgtgtccgttcgtgacatttgctatagctagctagctccagctcccatggcgacggcggcggagaacaagaacgagccggcgcggccattcgcggtgccatccccgtcggtccacccggcggcgaccggcgtgggggaggaggaggaggcgcaggcggcgacggggtggcggtccatgcagtacctccggaagcggcggcgcgcgctctgctgctgcggctgctgcgtgaccaccctggtcgtcgtcggcctcgtcatcctcgtcctcgcgctcaccgtgttcagggtgaaggacccccgcatcaccatgaacggcgtgtgggtgacggccatcagcaccggccccggcaccggcgccggcatcgggagcaccgtggcgaccaacgcgacgctcaccgccgacgtctcggtcaagaaccccaacgccgcgtcgctccggttctcccggagcgagacggacgtgtactacaaggggaagacggtgagcgtggcgtacgtccccgccggcagcgtcggcgccgaccggacggtgcggatgaacatcacgctcgacctgctcgccgaccgcctcgcgtcggtgctcaacggcacggggctgatactcgggcaggagtacgacctgaccacctacacggcgatgagggcgagggtcagcgtgctggggatcatcaagaagagcctcgacgttcggatgaactgctcggtcatcttggacgtcgccggcatcgccggcgtgctgctgcccggggacggggccaagtcgggcgtgcagactaggagcgtggattgcgttgcaatcgtgagctgatcagcggttttcttgtgtgagtactgcattgtcattacagcacctcattacatatgaatatgtatttttctggatgtatattctgctactctcgtatgtatgtttttctggatatatattatgctactttcgtgtgttcacagatcgaattctctctaggaaataatacccaatagcattattatatgcctgtgtttgatggattgggtagacccgatttgggtagcagtctcacagccctgagttacatgaactttatagatgcagacgcactaccatgtttactgacgatgcataaggattaattagctaaaaggatgtaaagaaacctttgcaacgccagtaaaatggtgatttgaatagactgcatgaaaatgaaacaccatatacctctgccagcaagataggagtgcattgtcaaccacaacagcctcagagtatgtataaaacagacaggaaaataaccaattaaaggtgatatacagtagatagcattctgatagcattccaggtttcctctgtagataccagctatagaaaaaaaaaactagcttcttaccagcacagatggccgtgctactgtgctagaagcctagaaatgaacgaccaagggaatgtaactaatgaaactggacaatacataaaacttatcaatttacataaaacaaaaattatcacaaaagtttcaagaatcacatacattacattaggggggaaaagcaaaacaaaaggtaatgtggctaaaaaaataattcagaacttgaactaccgattgtccctaacgattttagctattgacttgggtaaggtcccgtgccaaagaaaattgttaggtacaaccatacagtaattagaaaataataacagcacagcacacaaactgcatgtatcaaacatgaaagaaaaagatcaacctagactatcacagtcagtgaattggaatttagaggtgtagctggcaggtactcatacaagtgcattgagtttagcacacaaaacattctaatcagtgaggtattcgtaactacatcaagtaaaatgaaaaaaaaatttccaagtttttgctgctcaaagttcaggcataactagccaacagataccaaggcatgtgcagagcatgataacatgttccacattagctcttgttgttcaaccccatatgaagttatgaacacatacacaccccctcaagattccatgaatgaaagtggggtcataatagagtccctccaagttccaactcacataaccatcttcagatggcgtcaaaatctgcaagctgtctaacctcacagtgcaaatagaataacaaggaaatgacaagttaaaatagtgcacccaaacagaatgtcaccatgagaacagcacagtgctagatgggaaattcagactaaaacaaaataactctgacatcgactattcataacagtataagggttattattcaataggtagttgtctaaatatgaaactagtgggtagtcacaactttccagttaacatgaaaaaaccttcttactctgcaattaaagaatcctgaatgacatagcacacattctcacatttagggacatacaagttcattacagctgttactagcttaattcatggaaaacagcggtatatatacctccatagaaacaaagaacattaacaccgaacatgaactaaactagtaaacacaaatcaaatgaccaaagtggggaagtatgaccatttcacccaataaggataacagttcagaattcaagctaacttaaaaaacaggatgaactgatctggagaagcaaccggcataacagttatctcaaatgttattacttatacctccctgaaaagttcaaaataactgatcctgttgaggaaaacacaattgcctaacaaggcaagtgatctacaaaagcgaataaatgttctctgctacttaatttatgactcaggaaccaaacattaattcaaaaaagtccacgctacatacatcaatgcgcaaaattatcgataatccagtagccaactgtatttaaaaccaagaaatatgtcgagtcccgacaaagaccgttagttaggatattccccttccgttacagcatgaaaatcattatgatgataaaatgctatatcctgtgataaataactttttttttcctttcatgtccttgccgccaaagaatggtaaccaacatacaagtaatgtaagtgcaataatcatatatatatatatatatatatatatatatatatatatatatatatatatatatatatatatatatatatatataactggaatgaagcaattcagatattgatcttgcacatacaactgtagggcaagtaaccttacttggtaaaagctactatatccgaatggaaaaaacaatgtatatacactgcatgtctgcttcagtgcaacgatctactgctactaagcaaaacttcctcaaagtcaaggctgtcctagtccacaatctcacctaaatggctaaatatactaatattgccatggatcagccaaacctcatctgaacaataaaacaatggatacaccatcccatcgttgataaccagtagaaaatggtgccaaaaaacgaatatagaagagaagacatgatgcacccaattccgtcacctgtggcgccggcggtcggcggcgtactgtgatagcgggacgagctccgacagcggggtggcgagcggagtggagactggagtggggatgggcgaggaccggcagaccgggcacgacgcgctccgccgcagccacgcgtccaggcacatgaggtggaacctgtgcctgcactcgggcatcatgcgctgcatctccccttccttgtactcgcagaggcagatcgagcacgcggcctcggcgtccgcccccgtcgccgccctagagaagggcaccttggggtacgaggcgatcaccgcggggtcgagcccgacgggcgacgacgccgcgccgcccccggcgccgccgcgggacgaggagcccggggagtcggagtcgtccgcgacgaagatgacccgcgggacggtgatggagatgtgcccggagctggacgcggaggacacggcgtggcgcgcggagtggaccccctggccgccgccgcggcggacgaccccggccccgccgcggcgggagcagaagtagaaggcgaggagcagcgacgcgaggaggacgaggaagccgagcgcgatggcgaccgcgtacccgacgccgagcgaggagaacgagtcgaggaacgacgccatgacggcggcggcggtggcggcggcgagaccgtggggcggaatggcatggcgtgcgggggggcgcggctggggtgggagaagagccgaggaggggcaaaacgggaagaggggtattttgttttaggtttccggaggggtggatctggtagttggcggcattaattgccggtgaggagggggaggccgaggaggaggggatcgcagttatggcgcggagctggagtgcaggacgcgcgccgtgccgcgcaccgcggtttgccggtttcctctgccgctcgctgccgagccgagggagcggctgggtgagtgagcggggagggggccaaggggggaacgaaacgcgtgaggctttcgccgcgtcgctctccttggaaggccacacggaccggcggatgatgggccacataggttttggcgattctcagcgcgcggaccgaggagaccagactagagattaatgggctgggaatatccaagtctgacaaagggacatacatttgctggttgactaagtctattttaactcccttcttatcttgcttatgattgaatcgcatctctcaaggctcaagcgcaaaaccgggtataacgcctctccaagacaaaaactggtgcaaatcgacttcttcgatggtttaggaaacgtttttttttctaatgtgacaggttggtcatgattgactcggtgagtaagcaagtaagataagagtgtaagacccacgtgtcagggactactctattttccatctctcccgatggtagcaaggcagcgataaggcggtagtagcagccggtgaggaaggcagtccggcgaggcgctcgacgaggtcgggacgagagcttgggaggttgtggtggtgcaggaggacgcgagagctcagggaagaaggagtagtgggtgttgtcggcggtatgggagccgaagaggacgacaatcttcacggtagcagagcatgtcgtggagagaggagaagggtgcaaggaggtcaaccttctaggcattggactggagatcattgttggggggggggggtgatgtcacaagtgaaccctcctagggctggcgacggagcctcgtctcatgagggccaacgtttcagcgcaggggacgatagcggggtaggtagccttgacaatgccatgagcccccagcatgtgtcggccaacacccctctcctcgccaaccctcatgtcgactcgctaggtagtggtgggtaggacctaacggctagcgagatcgctctccgcctagagatctgaggacgattggcccaccgcaggtccttgatctacttgcacaccaagagcagcaatggacacgttgcaatcatccaccatggcgaagccaagaacagcagcacaaccttgttgaagaacccgtgctttgcgtgggcggtcaccatggccacgtaggaaacgatgtcctagtcgactgggaacttgtcgaggagtgcccatggaggcgagctcatcgcgcgtgaggtagagctcgatgagcccgttgcaagcagcgcgacagtggtcaagatcgagcttggcgcattgacatggatggctggcgcaccctcaccatgctcccctcttcccttgcacgcgccgagagcctcccatctactgactcagcgagtcaacctgccacgtcagcgaaaaacgtttcctaacatcaaagaagtcgatttgcaccggtttttgaaaatgtgggaggtagggttcgacttaccgtcggtaaccgcgcggttaccactgttaccggccttatcgcgggggtacggtaatagaaaaaccgcggtaaccttcttaaattcaaataaatttaaaaaataatttgaatttttgataaattttgcacggtttcgtacggttaccgcgcggtaaccgtgcttaccgccggggcgcggtaaccctagccccggcagtttgggaaaccctagtaggaggcgttatacctagttttacggttgagggatgcgattcaatcgggagaagagatgagggagggaaacagactttgttagctgggtcgggatcgagtagttagttcctagtaggctatgtacgaaggtcacatgatcgattgggcctttttagagcttagaaacctggaaatgtcgtaatatcgtgcaaaacgtccgtttgatctcccccactccaactttcatcgtttatccatacaatcgaatgcggaggtttattcatttaacaaccggttcgttttccctctcttggggtagtttggacaggggacaacgatttcatttgatgtggcatctagatgatactcgtagtataggatgtgctagattttctttttgaaacggagggagtacatagtatttctattagaaaaaaaaaacagtggaacctacatggccgggactctatttcttcctccccttcctcaatatctctcctgccactagtggatcatgtggggccatattttttgtttttatttgatttttttttcaatcggactgccattgacatgtgtgtcacattagtgttttttttttctttatagtgtcacataaacaccacgtagccgtataggataaagataaggtcaatgtatcatataactgacacgtaggatgaaacggctttcaaattaacgatagtggtaaattggtctagtcttaagaaatggaaatcaggcgacacatgggatgaaaccgcttttcaaattgacgagagttaaatacttaaattggtccagtcttaacagttgtgggagatttcatatttgatttgcggttaagaaatggaaaccagatttgggctattgtaaagggaagcaaaataagatttttcctaatatatatctcggcctcctccactagttgactgcatgaggatataccatggcttttagagagggatcgcattccaatccacgcgttgatgagaagatcaatatagcatagcacatgataattggggaaaaaaaaaattccccgttgccggggatcgaacccgggtcacccgcgtgacaggcgggaatactcaccactacactacaacgacttcgatattcagttgtcgataggcacatatttatttatcggtatctttgcctcgtttgtaaatatgacatgatagactagtgatcggccatgccagcctggagtaatagcatatgctattacgtatttgcatgtaacacaaaagggttttaagtgtttatcgtcgcaattagatgacacaaaagagtataataagatctaggccggctatatacaccattatacttaaaaaaaagctaaatcgtactttatttgttttacattataagatattttggataaatgttagagcaaggtcaatagtgcagcccactgctagctccaaatcttctatagccaattcatacaatagttacttactatactattaatacttggtcccacctgtcatacacacattacgtcatggagtccgtgctgcagctagttacagatctgtagcccgctgcttttctctctcttcctttatctctttaaaatatgtttatagctggcttatagcctgctattgtacctgctcttagtgagtttagatgaaacatagagagactaaaacatcttccgtataatgtataaaacggagggactacgtaacagtgtcgcccacacaactgatggtacactttgtccctttgcctttgcgatgccttccgaagagacactgggctacgagcctacgagagcacttgagcctaacctggacttggcccgcaagaatcagccagccaggcccacaccacaaaatcctcctccttttcaaactccgcaccttcgtctagaagcttctaactcgcccactagctcccttccccttggactctttggagttgttggaaggaacacgcgcggacgcgcccacgacccctccccacggacggatgccggcgaaagcgcaggcacgccacgcgtcgtcactcgtcacggtgccagtaacctcctcgtgatctccacccccttcattacttccccgtgctaaaccccaacagaggtcccacacgatcgctgacaggtgggccctccctgcgcgtgcaagccgattagcgctaattacccgtcgtctcgaggagttattaccacgcttaaccgcgccaattacttcgccgggttaacgcaggacttaatcacgcggttgatcgtgcccgatccaacggccaggatcgcctcactccgcgcataaaacccaacgccacgactacggagaaaaggaggaaaaagaaaagcaaaaaggcaaaaagagttcgtgcgaaaaaaaaaagaaagaagagttcgactgttcgagcgaggagggagaagaagagggggagagagagagccagcagctagccatggcggagcacaaggaggaggagtcgttggtggagtcggtgatggacaagatctccgacaagctccacggccgcgggggctcgtcgtcgtcgtcgtcggactccgacggggagaggacggccgacttgaaggccaagatctaccgcctcttcggccgcgagaagcccgtccactccgtcctcggcggcggcaagcgtaagacccaaagcttaaagctctttttcgcttgtaggcgtctgtgttcttgcgagcgtgtagatccgaccgcatcggggttttcgctccgctttttctgagtggggctcgtttgttgtactttctcccggaactacgagcgtgtggagaacgtcgcgatccgtgatttctgaagtcaaatttatgctgcgttttcgccacaatgtgagtaggttgtgatcagattagtatttgttcgtgtagatttcgcatctaggttgggatttaaatgcaatagaatagtaactgagcggtgatgttgatgcgctatattcctttatgcttaaaccctgagattctttgtttggtagtgtagctgggtatcttattgtttatatggggatttgctctcctctgatgtgcttatgtttgtggttgcagctgctgatctctttctatggaggaacaagaaaatctccgttggggtactcgctggcgccacggccatctggctgctgtttgaagtcatggattatcatctcctcaccctgttgtgccactgtatcatcctcaccctggccatgctcttcctctggtccaatgcctcaactttcatcaacaagtgagcttcctgtaacttcaactgttattcacaacatatcaaacttaaattgtcagtggcatgttaacttgatctagctttttattggcctatagattaatgttgtgtaattgtgataccttatcatgttaacttcatgtagttttttattggcctgtagatgaatgttgtgtaattgtgataacgcttcttaggacatccttttatcggcatgttaacttataatgtattagtagttttttattggcctgtagatggatgttgtgtaattgtgataatgctccttgggacttacttttatcgccctgttactttgtggatctgtagtcgatggtcacaatgcctggaatgttacacgttctaagcttgtggctgtaatatgttgagtttgtggaatgcataaatggtgaatatgtttagtttgtggctgtaatttctgtcttgcaatttttttaggtcccctcctaacattcctgaagtgaagatcccagaggacctggctgttaatgttgctcgctcactgagatttgagatcaataggggctttgctaccttgagggagattggtcaagggcatgacctgaagaaatttctgattgtatgtcagattggcaacatgattaccttttttaagccttcattgtttaatggtatctcttcgacatgctcaatttgcttatgctggtcctctttattaaggttgtcgtgggtctctgggttctctctgttcttgggagctgctgcaatttcctgaccttgttctacataggtaattattttggtacaacaactgtacaagttaccacatttagcactgttaccaactacagttttctttcttgcagtctttatggtactgtacaccgtgcctgttctgtatgagaagtatgaggaccaaatcgatgcttttggagagaaggccatgatcgaactgaagaagtactatgctattttcgatgagaaatgcctctctaagatccccaagggtccgttgaaaaacaagaagcattagaaattgtaggatgagccgtagaaggtactatgctaatttatcatccagcctgatcactaattgtcggttttaaaggatggctacgattccatgcctttactgatagtaaatacctacattttggtgtggctagtagttgcgatgtgctgaacttcaatgaattcgaattatgccagcatgctctatctatatcctgttttcaaactcatgtttaactcaacttccgcccctggaagctgttggtactaagtgctatcaatatgtgacttatctttatggtattccatttgaaaggcttgggacctatggtaaagtggttgtttgatgtaggctaatccagaggtttgaccgttgagtaggagttgttttgctttggcctccataatgtccaaatgcacgattcttatggatgggttatgctacctgagtttttttaagtactatagtgagcatccattcttcaaaaacaatagtcttaaggctctatagggtgcgtggtgcgtcatacagttatttggcttccattttgtacggtgggtataccttataatgatagagcttttctattagcttatacttctaagttttaactcggtgtgccgtttcattcagtcgctaccaacgatgcacataccacactcagaaaactaccagaaattaaagagttataacaagttcacaatccacatctcaagtcgatgtatacattgttttccttttactatgacaacgaccaaaagcgtgcctggggataattttcagaatcgctatctgtatcatcactttctgtcgatgaagctgctagatcagcgatgtccaatatgtagtcagcaaccttgttcaggaaagtataaaacaatgctgtcagcacattgtagtgaagaagggaaaaaacattaaattttaacatttaaaaattgttgctgcaatgaaatgagcagtgaattttagacttcattatctatctgttgggttcaaaactatcataaaacactactattaacaataaataaaagtacttactgtatgaggtaatagaggtcctagttttactccatcttttccattattaaggcaatagtgtggagtagcacacgtcaagtcgcac

SEQ ID NO: 71639 - DNA, 19899 bp, Oryza sativa
aaatagtctggaaatttgggctaaatggctgggcgtgacatcgcaccaccatacgcctctttgtcagcccccccctcccccccccccgggccaccttcaacacttcacctctgcacaacgacatctcacgacctagcatagctcgaccatcacactagtcagaactcaaaagggctagatccccctccgacccctctcgcacatgggaccactactccactcgtcatggagttccccacgactggatctggaagcataccaaccctagtaagggatgggctccttaaagaagtcaaaggctggctagaaagttcttgttcaataattgagcattcatccttttataactctattgaaggaaaatattagcattttcacttcaagtacatgcacatagagttctgtcaaatggatcttacttttgtgttctcccttaggccttattcggttaatcccaccaacaaggggattgagggggggcacacctcaatacatgtggaattattcctcatcaatctcttttaatccatatctcatggggattaccgaacaaggtcttaggaaggtatacaatgtgtgactccatccacctgaaatccacccaaaggaattttttttaataacagctaaatgtaccgcaaatagacaggtggtagactaccaatagaagatgagtaaagtcactagattatagtccatcttggcgaataaagttagcttcagttccatcgaaactaaacccttcaggaaaaaaaatgcatgcaaattgtggtatgctagcctactaagctatgcagattccataaattttggcatcccaacactaggcttatgagtttatttccaacatcaaagcaaagagcatttagaaaaaatagaaaatgtggattctggttactacaaaacatcatgaatgaacagataaattggtgtttctcttcctaaagaatagtacaggacaataatgccactcaaagaagagacaagtatatgaattctgagttcataaccgaaagggtttatactgaggatcttgagtttttgaaattaatttgtacatttgcatttactttggtaaaacaacattgttaaaacttccatgaagatctttcccagaaaatgacagcattcagatcagatgggcaaaatgatttatcgtgcagctggaccggtggccgttgatggcatccttccaaaattacgctccgtctcaaatgcagcgctgttctgacttacatcaatagagtggtcagtggcatacatgtcataacttgagttagagttgctgttattgtcggtatagaaattgttgttcgcattgctgatggcacaacgcccctcctcgagctcgaggcactcttgcagttgtgccaccacatcggtcatagtgggccgttgtgccgatacttgtgtggtacacttgagtgcgatgtccgtagccttccatacaccatttacatcatggtcaccatgcatacgtgcatccaccactccctcaatattaccctgtgctaggcgctgttgcgcccaatgaatgatacttatgggctctggatcacgtaggacagccggcttccctgtgaccagctccaataggacaacaccaaagctatagacgtcactcttggtcgttggttgcattgttgcctggtacctgcacattcaattagttccacaagccttaaactttgtgtttctcacataaaacactaaataacaacatcaagaaatacatatggattaacatactctggatccacgtatccaggtgtgccaacaagcgtgttcgtagatacatgtgtgccattctcaagattgaacgtcttggataagccaaaatcagcaatcttagcctctagcttcgcattcaatagaatgttggtagccttcacatctctgtgaataagaggcggattgcaccacttgtgtaggtactctagccctgaccattaaccaggaaatttaattactgatcaaccttctagagaaaatgtaaaatcaaacctcacgaaacagtattacaattttaaagtagttaccttgagcggattccagcgcgattcgaagcctctctctccaggttaagtatctcccgttgtttcttttacctgcaaataggaagagaacacagaagggggagatatcatgaggactatcaaatgagccactagatgaagttttacaatgtaccctgcgaattgatcgggaacaacaacttaagtacatacctgaaatatgttctcgaagggttccttctgacatgtactcatagacaagtgccatgtatttcccatccttgcaataaccgatcatagatacaaggctcttgtggtgaatccgagttaaaatctgagcctagacaagcaaaacttgactaattaatcatacttttcttagtagaatctttatgtagcaagatcaaattcaaccgaagaaattctacctctgcgagaaattccttatccccttggttggaagattcagaccttaatttgactgccacttgagtgccatcttccaagaagccatcgtagaccttcccaaaccctccttcgccgagcactcgctgaaagttgtttgttatcttctctaaatcattgtaagtaaaccgtcggttctcaagctgcattgatgagccatgcccatggctgccatttgtcggcacatagctcgctgtctcattctgcggctttacggaagtgttcattgatccttcataagcgaagaatggaactactagcatcagaaatgttcaaggacagagaaatagagttgataattgctatgtttgtaacaagcctcaccttgcttcttttttcgtcccagaaggcaaaagagcagtattgtgactgatactatcaccaaaaccagaactacaggaacagctacatagatggcaagcttgctcttgtgttttgctggctgacatgaattgtcgttggtgcagaggtttgggttatttccgtatctgttgatggaatgaagatgtttagccaaatcagtctattttgtcaaattgactgaatttggacattcaaagattactaagagaagagtgggggtgtacttaattactttatatttagggtaccatcttgaattcttttgagaagtccagatggaattgaaccattgagttgatttcctgtcaaatctctaaagaagccatatgcccataaattatatacatatgtcagttacaaatgatgctaggcaataaagtaaaatttgacaggagttgccaaacttacaatactgccaacgaaggcaactgtgaaagtgcatctggaatcgaacctgtcaaattgttgtttgacagatccctgcaagatatgaagcaagtcttttaacgcaaaattccacaaacggtcaacaaattaacattctgaacctcataacatacaagttttgaagagccttgagattcgcaaaagcggacgatatctcaccacttaaaccaccggatgacagatttctgcaaaaggaatatgatcagatgaccgcgagttccatacttccataattccattatgcaagtccaatattcagtactccctccgtcctaaaaaaaaacccacttaaacacggatgtgacacaacatagtacaacgaatctggacatgctcatgtccagattcgttgtactatgtagtgtcatatccgtgtctagttggttttttttggacggagggagtacatgtggactgaattacttacatgtctgtgattcttgcaggtttggagctgtcatagctgcatgtcaacttatcccacgcaagcgtctttggaacgcacggatcacccatccagttcttcttcacctgatacttttccttgatcaccatcatggcggaagctgtcaagtgcacccatgttttcgatcagtaacacgcacaaaccatcacaccgtacgttttactcttatgtattctaccgtctgtctatctacataccatcctgaccatctgtgccaacggtggcggtggagaagacggagaacacctcgatggcgttgatgatcggtggcagcgtcgagttggcggtggcgttgatggagatgttgtactgcgggtatcgtaggaacgggttgctgttgaagatggcgtcggcgtagaggtacgccggcgtgtagccctggctaaacaccatgttgccgttgaggttgatgtagaactggcgcgtggcgttgctggagcggagctgcagctcggagaagtgcatgacggtgatgtaccccggcgccgggtccttgggctgcgtgtagggtacccaggcgaactcgatgttgctcgaggcgttgagcggcgcaatcgccgtctgcatcaccttcgtcggcgcgtcgaatacgtcctcgtccgtgtgctgcaccggcctcgtcgtcgatacctcgacccaatatgatggcgagacccaaggcatccatattctgtcgtgtggatcgtcggggtacctggccattaatcggttgtgttccgtttgatcaattcattgtaccctcttggattgactatttatcatctttctttttcaactgtgtgtgcccaatggtaaagatcaaagatgtaaaccatttctattatctagaaaaaaacttggatgaatcttttaattactcacctgatgaactcggtagtactaattgggccaaagttccatctgccgaacaaggacaggccccgcttgtcgttcgcctgcgggtagagcttcttctcgagaggcctgaggtccagcccggagatgaacggtgtcccggtgccggtgttcacgaggcaaacctgcacgaagtcgtccggcacgacgacgatggcctccaggagcgtcgcgccggaggggtccgagatgttgaccatcatccagaagttgacgccgatgtagacgtcgaagattggcagcttgctgaggccgtcgtagttgccgtacatgaaggtggcgcggatgaggtacttgaggccggccacgagcgaccggagcgtgtagcagttgcgcgcgccgtcggggaagctgcgcacgttgtggtagcgcgccgagagcgccggcgtgatgtactccgccgagatgttgtggaacgagccgccgtcggtgaagccgtcgtccgccgcgtaggatatcttggtcttgtcgtccacgtagctcgtcttccccgggaggccgcagtctacgctaatgaaacctggagttcactttacatttaattagcaactgcgaaagtatgatagcttgtgcatattgatttcactgtgaagcgctacttaatgcccgatgaaaatttgtgtttgtacctttgctatcaggctgggcacgagcttggagcacgccggcggtggcggcggcgacgaggcatagtagaattaaccacgaccatgccgccattgttcccggcgttgaacgccccattgcacatgcaggcggtgagctactagaactgtaatctctatgtgaccgtgctctagctatttatagctagccttttttttttcgggctatgttcgttggtgggtattgggaacccatctcccacgtactaaaaacgaaacggtctaacgtaggattaattaagtattgtttttttaaaaaaaatggatcaatatgattttttaaataactttcgtacataattttttttttgaaaaaacataccgtttagcagtttgaaaagcgtatgtgtgtgcagaaaatgagatggagggagttgggaacctaattgaaacgaacgcaaccttaggctgtgtttgagggagaggtgattgagaagattgggaagatacgtaaagcgatgtgagccattaacgcatgattaattgagtattaactattttaaatttcaaaaatagactaatataattttttaaagcaactttcatatagaatttttttgcaaaacatataccgtttagtagtttgggaagcgtgcgcgcggaaaacgagttacaatctctccaatctcatttgaaataacgcagccttattccagtgaataaccaagtaatcaagctaataatcttattactatcacttactccagctagtactactattatagcctaatgatcatcacaaagactccatcgtgattagtttaaccacgtcagcacatctgtctagtaacatagcttgccaagcgccgtcttcacacatatatgtggactgtcactgacgagtgggccttttctgacattttactggccacctctttgtaggaccggcatgtcaatgaccctgcaagtcagcaaggctgcaagcccgggaagagagcaaagacgagcagatcacatgggcacgtagttgacttggatggcagctggtcaactgcttggctggggcacgactcgaggcccgagatcggtggccactggccacggcccataggcgcttgacttgttctctgaactgggtacccctgatgggctatggatcgccgtggagatagggtagcgatcagattcgctctccacctcccccctccctccctcaacctggttttcttttttggcaccgcgttactttcctattttagtaaatttatacacctaaagtttacacatctaacgtttagagaccaaaagtttataagtcaaaagtttatatatccgattcaaatttgaatttgaattcaaatatttttttatatatagtatttctatacatctaaagtttatacacctaaagtttatatagatctaaagtttatagacctaaagtttataagtcaaaagtttatatacccattttaaatttgaatttgaattcaaatatccgattcaaatttgaatttgaattgaaatatttttcatatatagtatttctatgcatctaaagtttatacacctaaaagtttatagatctaaagtttatatacccgattcaaatttgaatttgaattatatcttattcaaatttgaatttgaattcaaatattttctatatatagtatttctatacatctaaaatttatagacccaaagtttataagtcaaaagtttacatacccgattcaaatttgaatttgaattcaaattttttatatataatatttctatacataaatttttctaacttttcgctgggcgggtgggggagcgatcacccgcccattagcctttccgctctgaactggaaaacatgcagatagaatcatttgccatgaaagatttagttcctcttgcttgtctgccttttaaaacttatttacgttgtacctataataacatgatagtcttatgtacattctcatgaggttagaggtcaggtttaatataatcattatctaaaagaaagaaagattattatgcaattgcgagaatgcgaggtaggtagaagagtttgttctccactgattcaacaaaagcagtactacgaaattgaaagtcccctagctagcaagatttcggtgcagaaaagtataaactagtactctcttcgtagacatacatatagttttatttagcaattttacagttcttgagaagttttatatcatgagataaaaaaattagtgtaaagtttggtacctcttgatacctacctaggtaccaaatttataattgaaaaagtggtaactcatggtactttctaaagaactataaaattactctattttttaaaaaaatgaaaagaagtgttagagtactaagaaggaatttagcatccatcattgatagagaatatgtagtctagtacttgcagttatctgagtagcaccccaagatcctgagttcaaatcttcgtaggagcgaattccgttcccaatttaaaaaagctgcatacatcggttggatgtagatgccagctaaaaaatactctttacaaaactagcatggtggcccacgcagattgtgcgactagtatcattatattttctctcatgtaataacatatatattttctcaatgtattattaaaatatattaaaaggacaacataattttaaattctgtactagctttacgaaactactaatgcgtgtaatatttatattgtattttatatacgtgttagttattaattatttttaatatcaaattttagatatctgtaaattatattcctatatggactctagactcgtctttcaatttttttttaattccaaatttttgttatccgtaaattgtatttttatatagactataggctcttcttctaatattatttatttttaattctgattttttattttttttctaattgtatttctatgtgtactctaaactcatctttcatattctttaatttttaatttcgaatctcagttacttctaaattgtattcctatattgactttagattcttcttcccatatttttttaattttgaattttagttatttgtaaattgtatttttatacagtctctaaactctacttttaattttattatgtttattctgaattttagttagttttaaattcctatacggactctgtgctctacttctaatattccttatttttaattccgaatttttattatttcttagttatatttctatatcgactctatactctacttctaatattccttatttttaattctgaatttctattatttttttaattgtatttctgtatggactctatactcttcttctaatattctttattttttaattccgaatttcagttatttataaattgtatttctatatggactctagtctcctcttccaatattcctttttgttaattccgaatttcaactatttctaaattatatttctatatggactctgttttttcttttctccgattaatatgagaatttctaggctgtgagagtgaacgtggaggctcttttttctattcctttaataagttaatagataaaaaaaatattgatagagaagaaaatggtgagaaaacctagttaccttcagttgcatcaaagctaaaccgaaaaaaggcatgcacacaaattgtggtaagctatgcagattccaaaagttttggatcccagctctaagcaaagcagcatttagaaatatggattctggttaccataaaaacatgaatgaacaggtacattggtgtttctcttcctgaagaatagtaggcgacaataattccactcaaagaggagacaagtacatgaattctgagttccaaaccaaaatcttgagtttttgaaattaatttgtacatttgtattttaatttggtaaaacaacattgtttaaaccttccatagagatatctccctggaaatggcagcattcagatcagatgggcaaaagaatttatcgtgtggcgggaccgggggctgttgatggcatccttccaaaatttttctccatctcaaatgcaacactgttctgactcacatcgatagagtggtcagcggcgtatgtgtcataacttgagttaggtttgctgttattgctggtgtagaagttgttgtttgcatcattgacggcacaatgctcctcctcaagctcaaggcactcttgtaactgcgcaaccacgtcagtcatagtgggccgtcgcgctgatacctgcgcggtacacttgaatgcgatgtccgcaaccttccatacaccaattacatcatggtcgccacacatacatgcatccaccacttcttcgatattaccctgtgctaggcgttgttgcgcccaatggataatgcttatgggctctggatcacgtaggacagccgactttcctgttaccagttctagcaggacgacaccaaagctatagacatcactcttggtcgatggttgcattgttgcttggtacctgcacattcaatcagtaccacaaaccttaaactttgtgttcctcatagaaaatactaaagaacaacatcaagaaatacatataaattagcatactctggatccacgtatccgggagtaccaacaagcgtgttcgtagatacatgggtgccattctcaagattgaatgacttggacaagccaaaatcagcaatcttagcctctagcctcgcattcaatagaatgttggtagccttcacatctctatgaataagaggcggattgcaccacttgtgtaggtactctagccctgaccattaaccaaagaatttaactactagccaaccttttagagaaaatgtaaaatcaaacctcaagtagcactactacaaatttaaagtagttaccttgagcggattctaacgctattcgaagcctctccctccaggttaaatgtctcccgttgtttcttttacctacaaataggtagagaacaaagaggggtgagaccatgaggactataaaatgatccactacatgatgttttacagtgtactccctctgtttcatattataagtcgtttgacttttactttttgatcaagtttatagaaaaatttagcaatctaaaatatcaaattagattctttaaatctaacattgaatatattttgataataagtttgtattgtattgaaaatactactatatttttctataaacttgatcaaatttaaagaagtttgtctaagaaaaaaaagtcaaacaacttaaaatataaaatggaaggagtactctgcaacttgatcgggaacaaaaacataaatacgtacccgcaatgtgttcttgaagggttccttctgacatatactcatagacaagtgccatgtatttcccattcttgcaataaccgatcatggagacaaggttcttatggtgaatccgagttaaaatttgagcctaaacaagcaaatgttaactaattacttggacttttcttagtagaaatctctatgtagcaagatcaaattcaactgacgaaattctacctctacgagaaattccttatcaccttgattggaagattcagacctcaatttgactgccacttgagtaccttcttccaagaagccatcgtagaccttcccaaaccctcctcggccgagcactcgttgaaagttgttcgttatcttttccagatctttatatgtaaatcgtcggttctcaagctgcattgatgaaccatgcccatcgctgtcatttgtcggcacatagttcgcctcattttgcggctttatagaagtgttcattgatccttcataagcgaagaatggagcaactagcatcagtaatgttcaagaacagagaaatagagcagatagttgctatggttgtaaccctcaccttgcttctttttttgtcctagaaggcaaaagagtagtattgtgactgatactatcaccagaaccagaactacaggagcgactatgtagatggcaagcttgctcttgtgttttgctgcctgacatgaattgtcgttggtgcagaggtttggattatttccatatctgttgatggaatgaagacgcctagtcaaatcaatctattttctcaaaatggttgagtttagacattcaaagattgctgtgagaagaacgtggtgtacttaattactttatatttagggtaccatcttgaattcttttgagaagtccagatggaattgaaccattgagttgatttcctgtcagatctctaaagaagccatatgcccataaggtatatgtagatgtttgttaatacaaatgatgctaggcaataaagtaaaatttgacagaagttgcgaaacttacaatactgtcaatgaaggtaactgtgaaagtgcatccggaatcgaacctgtcaaattgttgtttgacaaatccctagaagatatgaagcaagactttgcaaattttaatgcaaaattcttacaaacaaggttaacaaattaacattattcaactcagaacgtacaagtattgaagagccttgagatccccaaaagaagatgatatctcaccactcaaaccactggaggacaggtttctgcaaagagaatgtgatcagatgaccctgtttcatacttccgttatgcaactccaatattcagtacgtgtggactcaattacttacatttttattacgtgtttggagttttcatagctgcatgtcaaactttcccatgtaaattctgtcggaatgcacggatcacccatccaattcttcttcacctgatacttttccttgatcaccatcatggcagaagctgtcaagtgcaaagatgatttcgatcagtaacacgcgccaaaacaattaggccatttcacttgtgtgtgtgtgtgtgtgtgtgttctctatcgtctatgtacataccgtcctgaccatatgtgccaatggtggtggtggagaaaacggagtacacctccatggcgttgatgaacggtcgcatcgtcgagttataggtggcgttgatggagatattgtactgcgggtatcgtaggaaggggttggtgttgtagatggcgtgggcgtagagatacactggcttgtagcccttgctgtacatcatgttgccgttgaggttgatgtagaattctcgcacatcacggctgggggggctgagctccagctcggagaagtgcatgatggcgatgtaccccggcgacgggtccttgggctgtgtgtaggctacccatgcgagctcgatgttgtctgtggcaaacattgggacaatagccgtctgcatcaccgccgttggcacctcgaacaggtcgtcgtatgtctgctgcaccggcctcgtcgttgatatctcggtccaatttgatggcgagtcccaaggtgtccatactctgtcgcgtggatcgtcggggtacctggacatgaatctcttgaaaatatagcaccttgaattgactattcatcgattattttcaccagtgtataccggccaacaggcaaaagctgaaaatgtaaaccattttctgtcatccgaaactcaaactgaggtcatttatactataccatactaccgtatattagggtggtcatactaattactacctccgtcctagtaatcgctttgactttttttcttttaacgtttgaccattcgtcttatttaaaaaattagtgcaaatataaaaacggagaagtcatacttaaaaagtacttttgataataaagcaaatcataaaaaaaattccataattttttaataaaacgaaagatcaaaagttataaataaaaactcaaagcgacaagtattctgggacagaggtagtatccaatgattccattctattctattaaaattgacacttgttttatcggtattatagtacaccatcggtataaatattatatggatattatggggaaaatatgcatatttataatttgttgcgcgcgcgtgtgtttggagggacgacaacctccaccaccactatcgttgctatttgataatttaacatttattaaaatgggcttccattatttgacatcttgacctaatttcatttactcagatagtcttacatgtcatcctcacaagtatcaattagagcaattggacaacgaaaaaaagtattaaattatcaaatttctcaccgacggtgccatgcccatgggagggcttggcattcgtcatgaatgtaatcgacaagcgaacgaggctggctgcttgattactccgctcgccactggccgatccagtgaatacccctcgccgtcggcctcaacatccaggcaccgctgaggacgtagagaggcgacgcgatcagattgaggagaccaggcgcaagagggcttccatctccctccgccgtcaccgcctctcgcctcccccttatacggctcatgtttaggcgaagcagcccgcgtatatcaacccgctatcaccccctcctcatcgtcgcttgaagcaggtacagtggcgtggattcttttttagttggattccttttcatttctcgggtactttttcctctgctcacgactgtcgaaagtcctaacgggcgatcgatcgctgggcacgatcggtccccctccccacatcgatcaccctctcctccacgtggtttcttttttttactacattactttcctattttagtaaatttatggacctaaagtttgtacacctcaagtttacacatctaaagtttatacacctaaagtttagagacccaaagttcataagtcaaaagtttatatatccgattcaaatttgaatttcaattcaaatatttttatatatagtatttctatacatctaaagttcatacacctaaagtttatagatccaaagtttataagttaaaaatttatatacccgatttaaatttgaattcaaatattttttatatatagtatttctatacataaccttttctaacttttatttttttatttttttaaaatttatggtgtagtaggaagagaagaaggggaggaggaagggggagcatataaggggggatgggggcgatcacccgcccattatcaccctcccacgactgttctagatgagattacgtattttgtaaaaaaaaaaaacctctcaaaactatcgatttacatttaggtctgttatcgttttttcaccgttaatatatcatcggacggctgcggataggtgcgaacacgtggcatgcttctccagccgagaatccggccgggactctatctgtggtgcaacatggcccaatgaatagacgggtttcgaaccctgaaatcgatctataagatacctaaagacactagcatgtccagcgcttcactcttgtcatagtgatgagcaaattcagaacatggaggaataataactaaagaaaacaggaattagttgcaatttgtgtcgttccattcttcttcaattccatctcaggatgcattaccggtccaacaccaatatactattcgtactaatagcttgataaactgatgccttaattgtattagcgtgtagagaggctttgatttgtcttgtgaaacgggtacacccaggattaaaatgctgggtctgccactgttgggttacttgatctggaaagatgtgatcggctgttcttttgacggcagaagagagagaagtaacggaagtaaaaacggcatactttaggtgctacagaatcaaaaacgtaaacttttgataatctaaaatcaattttcactcgtgcgcaccagggaatcaaaaacgtaaactttcgatgatctaaaatcaattttcactcgtgcgcacctgggaaaaattttccagtcggtcacccatcctgaaattactccagattaacctcagagttcttttgagatcggcttccgaaaaaaactataacttgttggtatgagtattctattaattctattaagccctgggtcgggatgtcacattaaatttcacctaaatggttaaatcaacatgcacgtaaaggactcaaactcggatggatcgttactcacctgatgatttcggtattactggtcggcccgaatttccatctaccgaacaaggacaggccttgcgtctcggttgcctgcgggtagagcttcttcttgagaggcctgaggtccaacccggagatgaacggtgtcccggtgccggtgttcacgaggcaaacctgcacgaagtcgtccggcacgacgacgatggcctccaggagcgtcgagccggcggggtccgtgatgttgaccatcatccagaagttgacgccgatgtagacgtcgaagattggcagcttgctgaggccgtcgtagttgccgtacatgaaggtggcgcggatgaggtacttgtgcccggccacgagcgaccggagcgtgtagcagttgcgcgcgccgtcggggaagctgcgcacgttgtagtagcgcgccgagagcgccggtgcgaagtactccgccgagatgttgtggaacgagccgccgtcggtgaagccgtcgtccgccgcgtaggaaatcttggtcttgtcgtccacgtagctcgtcttccccgggaggccacagtctacgctgatgaaacctacggcgagtcggcgacagcgacacacattagctagcgataactgcgaaattatggacaatctatgctagatcttagttcattgattggcatgggttgtacttgtagctttgctgtcaagctgggcacgagcttggagtatgccggcggtggcggcgagggcgaggcactagaacataataaaggctgaactctctttgtgatcgtgctctacctatttatagccagtcttaatccagtgagcgtaaccatgcaggtaatcaagttggaagaaaattgcgtaggactgaagtcctacccttatctgaaggacttgattcctctgcacgacacctgtcccacatgaatctcagaatagcctttctccctcatctctccagttcccatttatctatcttcctatcgtcggcgaggcgtcaaggtcaagcactcaagcccgagcaccaagcgcaacgcgctcgtgccctgtggcatcaagctcatgaggacagccgaaaattagagtcaaatttgcctgccgacctgccgcgagaaaaatctttggtttggaataagctgggttatcgattagatcgaatccatctccatgaaccgcaaaaagtttgcctcagtgaaattgttcagtcagtagatttttctttcctttgcttttagtctgtatggtgcactgcactgctctggtggttgaagttgattgagctttcaaggatttctgtttgccggtgaatcttctagcttccatgattacaaaattgactattcacaattcttggtgagtgcctcatgtgcaagcttggatgctacttagttcctctgacacattgtggatgccactcgattccggtgacaacggcagccagccgcgagctccaaggctgctggtcggacgtgagcgagaagaggaaatatggggaattgaagagaaaagagagttagcctattcaaagatttgcgcaagaggtgccggcggcgaggtgaccggcaggcggcggggcgtaggaggcggcggcgagccgtagagatcccgacggcgaggcggggctcgcctgcacacgggccgccggatctggctcctttctcgccggatccggcgcccccctccctccctcccactagatctggcctctccggcgaggaaggccagctcccgacgacgagacaggtacagcagaggaggcagtggcggcggggttgagggcgcggtggcacgtggtgaaggggcaggcggcagatgtggccctcggtgacggcatcaggcatggggagtccagcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggcatgacgacaacgacaccattaggcgtcgttccccttcttgaaggcgtcgttctggcgttgacctctcctggcaccaagaaccttcccccgtgcaacggtagtcattggtggactcctgcattgcctctgaagctctacaagcctaaggtgtttgacaaggtcttctctgtcttggttctgtttcttgctctacggcaagtgttcatcattcttatttggttactgctgggtagagtcagagctgcttcgctgtaggggtgcgacgaagttcggcaacgatgacacactgcaatctctttataagattgttgatgccagctgtatgtaggaagtggttccttggttgtttgggctaatgtccttcatgggtatcgtttatgcttgttcttttggcgttagggtagcattgcagtgaagtcgaagctgttgtgtcgtttgggcggcaagctcagtaacgaaaacatgtgtgggctgttgtgtcgccactatgacaagcttggtcgatgccttgtgtcgggctccgtcgttgtaatttaggttatgttagctgttagtgtggtgttgtagttgtggttttcgttcaattttccctaattaactggacactgtaaagtttggtcctgtttactccttaaattggggcaccttattcttaatataaaacgtcggcaatggcctgatcgttgaaaataaaattgtgtaagacatgtgtcaagtagagagacaagtcctttgaacgaggtgtaggacttcggtcctgctctgtaattttcttccgatcaaggagagatggattctaatatgtgatgtgaatgtacactcttttttttttcatgtaaactaaatggttataaaataattttttaaaaaaataacaagatagattatgtaatatattacttcacaaattaacatacaagtttaaatttgacttctctaagtaggaaaaaaataactagtcgattttgaagttgcatattcgtagagtgatacattacatattattaatacctatcctgtcaactttttttaaaaaaattcataaccatttagttgacatgtaaaaaagggtgaacgtccaaccaagtgcttaaaatagttttctataatcaagataattatatcactatcactagcaaatagttaccgtctccatgttttaatatcgggaatgctaggggacgggataccgtcccccaacgggatagctcctctccacaacacgattcgcgtccctcgccgctgccgcgcccgtcccccgtcgcctccgcgcccgtccgccgccgccgcgcccgtcccctgtcgacgccaccgccgccgccgctcccatcccccaccgccgtcgtcgctattctccgccgccgccatcgccgccgcggcgtccgtcccctgtcgtcgacgccgccgccgccgccgcgcccgtcccccgctaccaccaccgtcgccgcgcccgtcctctaccgccaccatcgccgtcctcgtctacaagggacggctgcagggggcgaccgcgtgtgtcggggtgctcctccccaacggtatgcccagctatatctagtaggaatcacctgatacctggtaagtatcatccgatacctcgcaagtatcacgtgagacatggtagaaatcgtctgatacctcatgagtatgacgtgatacgtggtagaaatcgtatgatagatgacatgtatcgtatgatacctcgtgagtatcacgtgatatgcggttgaaatcatctgatacctgacaggtttcacatgatacctcgcgagtatcacgcgatacgtggtagaaaatcgcatgatacctgataagtatcatatgatactttgcaggtatcacctgaaacgtgtgtagaatcgtctgatacctgataggtatcacacctgatacctactcaggatcatcatgttatgtagaatcgtctgatacctaataggtatcacacctgatacctactcgggatcatcctgttcgaaaacgggattccgttatatagcagccccctttaatatataacgttgttggcttttagcttagcgtttaaccatttatcttgttaaaaatttacatatgtattattagttttgttgcgacttaaaaccataatcttcacttatttttatatatttatactaaatttccaataaaaagaatattttaaatgttatgtgaaaagttaaactatattagactatcgatgatcactaacgagtaacgactccattgtgattagtttagcgccgtcaacacatccatcctctgtaaggctgtaacacagattgccactgacgagtgagacttttctgaacttccactggtcacttctttgtaggcccgtcatgtcagtgaccttgtaactatagcttggaagagacaaaaagagatcacatgggcagggagttgactttcatggcagctggtcaactcatctgctgggtgcacgacatga

SEQ ID NO: 71640 - DNA, 1451 bp, Oryza sativa
tcgagtgtgctgaccctgcatcttgagcataacagatcccaggtagaaacgtgagcgatgcgaaaacatcgaaaaagtccggataatatttttgcaaatccgaagttgacacgtgctagcgttgacatgggcctcctaggtatcaaccaatgttatctgctgatgtggaaaaaatcatgtgtggcatgctctatgataaaaacacgctacctgaccagtctttttcacctggaggctcattttcaaattcttgcaccagattctacccatctgccaagttattagagcatacataatttactcatctgtatcttaccatacttctataggattgacacttttgtaccaataactaataaataaagaaatcaattcttcaatttatttattttttattttgggttgactcttgaaggcatttaaatatactatgtgtgaaggtggtatgacaatattggtcatgttttctcactacaaaaggagtatttttccatgactatgcgcctttcctttttgccatcctaagttaatattgatgatttgctttgttacttcaagtcatgatttacccaaatttatgtgggatcaaatggttttgtttcttttaatgtttttcagggagttggtcaatctcttactcgttctcgtgcagcactgaagtatattgcattggccatatctggccatatggatgatgttctcacagaatataaagtacattcatttttcctcctgaaagtgagcttttccttggtgatttgttttacagactccttaacttgtattatgtaaatttacctactcaggacgtcaaacataagttacttttcattctggagatgctagatccttttattgatccttctgtaagtgttatgacagatgcaatggcatttggtgatgtgtctgttgtgcatttggagaagcaagcaagcgcttgcaatatttcgttaaatattattcgtacagcagtgaagaggcctgctgttctcccttctttagaacttgaatggcgtcgtggtgctgttgccacaaggttggtgaactctatatgtttacatgcttatcataaatttgccattaagattgatctgaacttgtcatggttgatgagaaccagaatagtactgtcattatttaattgtgacttcctctggtcacaaaattctccattggaagcatgcaattgaacttcatcattgcagaaaaaaagaatatcttggaggaactagttttgcctttagctaataagaaagatatgcacccaagtttgaaccaaagaggacttgggatgtatcatagaacctggtaaaccgtgtgactttagcatgcacatatgattgacggcttaaacattaaagcatttctctagctcagacctactttgtatgctggtaaaaacatgctaaatctagatttgatttgcagtgttattctctctaccttggatc

SEQ ID NO: 71641 - DNA, 2895 bp, Oryza sativa
gagattgaaattaaaggagacagagatgtagacacacagctcgtgtacatacatgcatggaggcgtttcatcaaacaccttgcgcctgcgggagaggaggagaggatccaatcatccaaaacgaaggcaactgaagaagttgtaaggtgtggtctgccgtctgcggcggggcgaaatgtgtggtgtgggctaaaatatgtagtgtaggaagtaaggcccaaggcccatccgatatcgactcgactcttatctgtgtgggccgtcgtcgtcttcaaccctcctcctcctcggactaggactaggactcggactctccccttcctcctcctctctacctctacctctaggcagccgcaggaggaggccggctgcgctgcgctgcgcgatggaaccggagagggaggcatcgtcggagtggggagatggtgtcggggcgctgggtttccgggtgaaggcgtcttcgcgcgagccggcggcgcagaaggcggccaatgtgctggagccggacctgcgttcccactggtccaccgccaccaacaccaaggagtggatcctgctcgagctcagcgtgcgtactagcgacttgttctttcttccccctctctaactaggagtctccttctctagcggtagcggaggagaggccctgaatgaattgctgaatttgctgctgcaggagccgtgcctcctctcccacatccgcatctacaacaagtccgtcctcgagtgggagatcactgccggcctgcgctacaacaagccagataccttcgtcaaggttcgcccgcgctgcgaggctcccaagcgcgacatactctatcctgccaaccacaccccttgccgctacgtccgcatctcttgtatgcgcggcaaccctatcgccatcttcttcatccaggtacaactactagtataacttttactcttcctccggatatattccgagtaataagtcactcttcttcttcagctcattggaatccctatacctggactggaacctgacctccagcctctagtcaactacctattgccacatatcactgcacacaaacaatcctctcaaaatatccacctccaggtttgtttcttcttcttcttcttcttcttacttctgtctgtgtcttggcaacatataagtttcttctaatcatgcaatttttttgatattagttactcaaagacattgcaagcaggctaccaccatttctgccccagattgaggtaagctttccgactagcatgcatctccccatgtccatgtatggtatgttgtgcctttgttgtttccctttaatcgccgctgtctatctgagtgcaggctgacctcgctagtgtcacagacactccagagagcagtgtacactttttggctctgcttgctgggccattttatccaatcctccaacttacaaatgaaaggtgccagttccttgttcaacattcaactgcatatcaattattttttttatactaagctctgtgctgtcctagattatttttcggacagcttatgtgtttgtgcaggttgctgcacaaacatgtgtgcgcacacctacatgcaagcactgctatctgaaacaccttcttattttacagggattttactaaatcattaattagctctgctgattcagatgctctgaaaagtagtttggcttctactccaacggtttcttcaaactttgaggcatgtagtttttttatttccaatgtacttctaccgcctttctagtttctgcattgcactatgataatgtgaaatgttatagctgatatatgctgaaagagtgaaagctttgattaaatggtgctgttgcacttgctgctttagtaacacacaattttcatttgtgtgaagtgtctgtaagacctaaccttaatcttcagcacattgttttctcgagagactacgggaattcatagtgctaactaagggtatagacacctggctcctttagaccttaccttgaactataggaacagaagctaatggcaggatgcatccccacagtgacataataaaattagataggttttatggttggatccaatagacaaaaagtccttcataactattactctgtgggctgcaatatctatgtaagatttgacttaatgaaaactaagaaacacaacttgtttcttttttgaaaccaaaagtagtatcatgtaaatcatccacattttcttatattttactggagctttctgtattccataaaaaccatcatgtaaaccaataagacaatttgggatggttggtcaatattataaattattccctccattccaaaatataaggctcaaccacccttaacccaaaaaccaagatattatcacatcatagtttggatcatcctaatcctatatacttatagttcatccccactaagtgtagttaatgctatttctcttttctctcatgaagccacatcatctcaattatttctagcctttggatgatagatctatggtacacatagtctcttctttcttctctcataaaaccatgcaatctcaatttttaggctcaaaattcataagtatcaattacataaaatatgttcaccttgcactatattggaaccatgtgtaaatcgtatagaacataggaggtcattttgttttggttataaaatatattgtggcttatttgtacatattatacaacttaatttcccacagaaagacggcggggtatttatctagtaaatataatgcatgcacccaacagaattaaagatcttgagtatggaggatttaaaaaataataatttagtggaaaagaagtgctagttaatagcatgcattcattccttatattatgaaacatctcgaaaaagtagttgcgccttatattatggaatggagggagtagtaaattattactac

SEQ ID NO: 71642 - DNA, 875 bp, Oryza sativa
cccactgagtaataaaactttaagtttgccagcccagaagtgccggttgatgattacaacacagatccaaaacttccatcaagaaatcttttgaaattttaactgaaaaaggcctacctttctttgccctgggacgcgattcgtagctcgattcgatccgaagcttgggattttagagtagcttaatggttaagggaagggaaggagtcgtcgttgcctcgtccgagagcagctagctgtgcgcttggtagcagcgagcagcagagggcagcgataaaaaagactgaagagaaggttgagcagcagaggacgactaaggccattcctaacccaataattagaatagtatctatagcattaaataggccgccccacccactgtcgacaccggatctgacacaagaacgaccgcctcgcctgccgccaacatgaccgatactacccccgcccattgccgatgccgccaacactgggttcgctgcaagaacggccgccttcagtttctcgcccaccactgatgctggatccgccgcggaaacggccggattaatcacaggaacagttgtcccgcccgtggccgatgccgcgacgccacggacaccgtcccacgcggagaggggaggagagaggtggagccaatgcggataatttactggttatttaatttccaaataattaattactataaataaaaattggctggaaataagataaatcttatctaactgtttattggtcacgtacagtagttattaggtggtaatagtaaaaatgatgatagatttaccatcaccactacctgcaaacagaaattaatagtgtatatgcaccaatttcctggaatttacgttcaagatattatataaagcaagttg

SEQ ID NO: 71643 - DNA, 3107 bp, Oryza sativa
  unsure (1)..(3107): unsure at all n locations
attagtctcacacctctcacataattatgaatgtaanacctgataataatttgctagcctcctggttgaagattagatctgtacagccgggtatggttgtccagaatggttgggcctgtcaagcatgggtgtgctgttcagtgttattanaatttctgattaattactccactgttttacttctcttaaatgttttgctgaatgctgcttttgcaaatgagcctatattaggccatcctttggtattcttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccaaaaacatgttttgttaaaattttcctttcttccttctccagaattctttgcaaatcattttatcatcctctcccctcctgctttcaacttgagtagctctaagacattggaacttgaagacgccaatgaggtctacttatggaggtcagtcaagtggatcaaggaaggactgaagtgcccagatgtcaagatggaatgaagtttggatcctaccttagaacctatgccgccaaagtgtctttgaagaatagttagtagggtagaacgcttgttgtttgctttgtgtgtaggtatggttgcattcccatcattggagtagttcaatgatgagtgtgtaactatactaggttgcttgcttaatcaacttgaacaatataatggtctacacacaccagatcagtggtaacatggttaaggtcttaactttagcgtaacccctctccttctatcttctctaatctgcaacggatggtgaacactcgcgccaataaaagtggaaataataacaatgaagggaacccaactcttgctcaagttctggctcaacagactcagttaatgaatatgatgatacagcagatgcagaaccagctcaaccaagggaacaacaatgctccaccgccgcagaacaagttagctgattttcttcgtgtgaggccacctacattttctagcactaccaacccagtggaagcaggtgattggctgcacgctattgagaagaagttggaactgctccagtgcacggatcaggagaaagtcgttttcgcttcacatcagttgcaaggacctgcatcagaatggtgggatcatttccggatgaacagagcagaaggacaaccaatcacttgggcggagttcactgaagcattcaagaagacacacatacctgcaggtgttgttgctttgaagaagcgtgagttccgggcacttaagcaaaaggatcgtaccgtgacggaatatcttcatgagttcaatcgtctggcacgctatgctccagaagatgtgtgtactgacgaggaaaggcaagagaagttcttggaaggtctgaaggatgaactgtcagttacgttgatctctcatgactatgttgattttcagcagctggttgacaaagcaattcgacttgaagacaagaagaacaggatggataaccgtaaaaggaaaatgactgtattccaggaggcacaaggtagtagccagaggcagtgtatcaagccactccaaattggtgaatcttcttccgctggtcaaggacagtcgcagcagttgaacatcggtggtgagatcaaatcagagactaatgaaagcaaagaagttaacatcgagcaagctaatcagccggtgccagttcagcagggtcagtttcaagagaataacagtagtggaagggagcagcaggtatgtttcaactgttacaagccaggccactttgcaagagagtgtccgaagccgaagcatcagcagccgcaaggtcaggtcaacaacattgttgtcacaggagccaatgcagtgccagttgcgtcttcaagagtcgtgtcttcaagtgttacagctcagccaccagtttcaaagcggcagtagtttctttaaagccttagaataattatcggagttatggaataagatagactgcagtttacctattccctttttctttctagccgttccgaatctcgggacgagattctttgtaaggggggtagtttgtcacatcctgatttttatttcagggtttataaattatttaataaattaataatagaatttatattaagtgttctttaatttacaagtgaagtaaaatgtggaaaataaaattttctaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaatgtttttaaaagtcttcttttggctttgggccgaaagtcggcccaaaacctctctctttccttttctccctccccggccagttggcccaagtcggcccagtccgcgccgccgtcttctttttttttaaccggtgacaggtgggtcccggctgtcaagcttgtttttctcctccggccggcgccgcccgaaaccctaacgcaagc

SEQ ID NO: 71644 - DNA, 12360 bp, Oryza sativa
taccatggctgtgcgaccatatctcaatcgggcgaaacttcggcccgattgagattacttccttgtgacggcccgcaaattctagtcttgttatgggccgtcacagatggaaggatctatactagtgtttgtgtttgactaggcatgattagcgtgtgcggttgtgaagatagagatatattttctgtttctttttagtttgtttccttttgggtttaactttcctatttttgtgtgggatcggttcatgtgtacgacggcatgtatatatatgctggtcacggatgattagatggacccccgaacaaattatcaatctactgtttttcccgttatttacttttccgctattttttattttactttcatggctgagatatggcaacgctagaattcggttaatctttgccgttttgcgctgaaaaacggtcgtgcttctccataaaagcgaggaggttatcctttgctagtttgttcaaaaactagttgttcgtcatcacgtaagtacgatatctattttctttgctaatttgtgtgtaaaatagtcgcttgattccgcgaaagtgaattattcttgagaaatcggtttcactagccgactatcgattttggcgactctactgtttacaccgcaaatcattatgtgaactagtgttggccacgaaaaagcgtcaacagtatctggtgaatattctcaatctgaatttcattctcttattaagtgcactctggccagactgttctacttgtatgtactgtaaaactccgcagaaaggatgatatactgctatcatgttatccggactgcaagggaacgagaggtcatggtgaacttgtaccaaattatcaaatgaagtgatatgggccagagacgttttcgtgtgtgttgtttggagtttttgacatcaaatttgtaaataggatatgttatattgctgcacaccaaattgaaaatgtaagacacaaatcctaaaccttcactccgtttgagtttgtaaatatggctgcaagctagggctgccaattttatccatacccatttcaaaattagcttacccataaaataggtattattcagtggctatgggcaatactcatgtggatcccacatgtaaaatttgctcaaaagtttttggtattccaaccattcatcctccggttggtttagttttaaacttatgggtgcaagatgatcaaagataacttgccttgctcgagatcttaaccttcctccaaatccatgcactgcgagtcttcaggctttgaagctacacgtgaaacaagacgactcaacaaaaggccaaaagaaagccctattcatgatcaaaatggctttccctcaacagagcgttgatctcgttaagatgttgtgtagaagtacgaacaagatccatagccccctgcaaagtcgagtctagtgggttgagattgcttggagcacctccgtcgataacgttcacattgcgtggagtattggatgccgaagattcttgatcctccacactgtgtagaactgagggttcattggcggcaatgccaatgaatcccacgaatcgatttggagacccttccgtgctctgttcctctgcaatgtgtcgagcttgaactcgtcgttgttggatctgagggctcgaagatttagttgcgtcaagaaagactttgcagcgactttgcaacctgaaagctcatgtttttcttgacttctcgatcggacaccaggtagtccttgttggtgaagtacgctaaatgtttcacgccttgcaggcctcgagttcagccttcatgtgttgtaaaaccttgcagttcgttagggagtgattggttgtcttgtgaatgacacatcaagctgtagatctctaaggagttgtcctcgtgggtacttgattcctagtggataggtgggttttggccgcctgaggtcttctcccatatgttgtcatagtcggcagtctctcttctatcgggataggaagaacagccggagtgttgtcatttcttatagtcgtcgctgcgctgttctcgttcccgacagaaacggcggtcgcgtgcaccagcgctgcctccactcctcaacttctacggcatgggcaccacgacagttgatatcaactttgacacttctgatgaatttgttccgagatgggcggagttaagcagctcattgaaaccagataggccagcatctttaaggatccacacatagacaagaaactcgagatatctgaggtttgacatgacagccttttcttcactaaacatgataccatgcagatcaaaccggacatagcaaaagggtgtgttgaaaactctcaacttttgaaagtagccaccgttaggagtcttcgtgctgcttactatacctttgtattttgtatacatattcgaaggtaacgtagctctggtaaccccccccccccccccaaagggcttcaatgtcctgcccgtccaaaacatttattttcaattcgagatatgagaggtttggaagaagcgacaacttaatcaccacaggcattatatgaaacgtcaaggacgtcaaacacaaatatcggatgagttgacaggaagcgaatcctgcttcccacatgacgccttaagaccctgtttagatgggactaaaactttccctatcatatcggatgtttggacactaattataaatattaaacgtagactattaataaaacctatccataatcttggactaattcacgagacgaatctattgagcctaattaatccatgattagcctatgtgatgctacagtaaacattttctaattatggattaattaggcttaaaaattttgtctcgcgaattagctttcatttatataattagttttgtaagtagtatatatttaatactctaaattagtgtctactccctggatccaaacaccaccttactttcatcacgatcgtccaaaatcttcacggtctggatcttgtgaagattgcatagggaatccaaaaatgcagatgtctcatcctgtccatgaagacaaagatggttaattcgaaggatccttagttccctcagcttgccaagcaacttcacaaacagcaatgtatcaccaccgtaagaatacaccgacaactcctatagagatgtcactgggactgttatgaaaatagatacacaacggagacaaaaatttaacgtggaaaacccttacgggaaaaaaccacggatgtcgaccagcaatgatcgtgataggggagttggatacaaacgtaggagatacattgggctgtcgcaccctccctatgcggcttacaagggatatataactaggagccctaatagacaaagactcgaagtcctaatagaaaactaatcctataatgagcatcttttccatccttgaggaggtaccatgaggtacgaggtaccaatctaatctaaccgttgatttaacagaggtatgattgggctaacaaaaattaggtctctcttccacactgtcgtcgcccatcgagcccaccgccaccgtcgtcgcccatccatgccgctgtcgggcaccccaacaccgtcggccatcgaccgccgccgccgtcgcgcatcgagcccgtcgctgccgtcgagcatccagccgccgccgtcacgcatcgagcccttcgccgtcgtcgcccatcgaggttgccgccatcgtcacgcgtcacgcatccagccgccgttgtcgcccatcaaggttgccgccgccgtcacatgtcacgcatccagccgccaccgtcgcgcatccagccctccgccgccgccgccgccgtcacgcatcgtggccgccgccgtcagccatcgagcccgccacgcattgagcccaccgagttgctgtcacgcctctcgccggtctcgccgcaaatcctcaatctcactgctctccccgatttttccccgtcaaacagtaaaggacagaaatacctttccaccaatgatactgcttgaaagaggaggtgcagtaccatgaggtacggacgatttctgaccgttggatgatgctagatcaacgatcaggatttggtactgcacaacctcaaggacagtaaaaaacctctcctataatacaaagtactattagaaaactaatccgaatatactgtgggcctaaaattcggatcacatatttaactggaactataggcctggggatgtcgttgaccgtgtacctgctacgccttgcagccacctccaccaagagcctcctgttcatcttctggatgtcaccggcgatcttgcggcgagcgttgctctgctcgaacagtttcctaaccttcttcctaagccgtcggagcatgtgcgggacagccactggttccatggcgtcgacgcgcacaaggaaggtccatgtcgtacgacgcctccctgaggtcgtgcgcccacagctcgacagtcccgtcgagctgctccggtggcacctcgccgaccatgcggaggacggcgtgcacatcctcgagctcacgtgagagagactggatcttcttccttatgcccgtgtgcaggtcgtactcgtccttgagcatctggccgagcttggggagcagcctacccatcgccttcatcagatccatgattgcaattgcaagcagagctagcaggttaagctgatgttaattagaaacaacatatgatgagctgccaagcgtaaattgttctttatttgtgtgaaaactgtcatttatatatccgaacgaccaactataaatgaaaagctgaaattttttatctcaagtctctgacaactcccaactagctagattaatacagcagttcaccttcctgcccagtgacaaaactttcagttggaacttggaagcccacaagccccaactcccatgtactgataaccagggtttaatgtttcggtttgctgatttgtatcaggggtggccgaaaatttaaaaatttcggtccgaagatttagaaatttcggtctgaaaatttatgaatttttaaataaaatttgactgaatttaaacaaaatattaccaaattcacgagaaatgaaaaaaataaaaatttcggctgaaattatatcgtatcgggcggtccgatagaaccgaaatttccatccgaaattgtgaaccctgctgataacaatattcagaaattccaggccttacagctacatatccgaacacattcatatcaagaaatcattccaaattttaaccaaaagacctacttttttttgccaaggtgatttaatggttgccaaggcgcagagcggcgggggtggagctactgcaactacaaggacagattgggatggaggggatcgatcattgaggacataatcaggagatggaaccacggaaagtgaaagagggtggtatgcctgcttggttactccggggtccgggctttcccttcactttttttttttttacagattgattcctttgcagaacaaaaagaaatcatgcagaccgtttatcaacacgttttccacggatgagtgactttttgtcacaaggagtgacgtcttctcggtgtgcaaccaacatgtttaaactttgataatcaaaactttttgaataattattccaaaataaactttttgaataatttcggttcaacattttaaaatggtattgttaaatttgtcttaaaaaaatagtataactttggctatgtatcttgacatttctttatccatgtatataaaggtaaaagttgttatattttagaatgatggagcagtaataaataatataacatatctagcttactgtgtcaatatttaaaacatgactgatttggggtccattgagagtactgtactgtttcaatcatttgtaaggctatgtttagatctaggtgtgaaaagttttgacgtatcacatcggatatatggatagatatttgaagtattaaatatagactaataacaaaactaattacagaatccgcctgtaaactgtgggacgaatttattaagcctaattaatccattattagcaaatgtttactatagcaacacattgtcagatcatggagcaattaagcttaaacgattcgtctcgtaatttacacgcaatctgtgtaattagttgtttttgtctatatttaatactccatacatgtgtttaaatattcaatgtgatagggtaaaaaattttgccagtagatctaaacatgccctaacaccctatcatgctgtcggtgactcggttcagtcattgcagaaaaagcttgtcatgccctcaataattgcctggaatttacccaccggcaggaagagctgttcacacttcacatcacacttgacccatgcaacaagttgataaaaaaattaaattcatccgcaaggatcctcagaaggagggattggaaggtcctctctcgcgtcgccctccctaggcggcacgagcggcgacgcctcgtcgccaccttcctccccgcctccctcctcgtcttgcctcgccgccgcctgagcgggcgtcggcaaagccacgcggccatgaaggatggcggaggcggagcctcgtctcgcccatcccacgctcggcggccgggggaggctgtctagggcagcggcgatggtggctagatccgggccgagtctggctggatctggctggggagtggcttgcggcgggggctgtagtagcagtggcgacacctggtggcgaatatggcggcgacggcagcggagccccgtccaaatccacaccaccccggccggatctgggcgggtggtgactgacggcggggatgagtggtggtggcggtggtaggcgaccgtggtggccgtggctgtgaagtttcggtggcaggccgtcgcggaggcagcaagtggcggcggggtaggaggcatgggcatcggagcggtggagggcaacggtgttgctgaaaaacacgaggcctgggagatctgcttaactccagtgcaggtccaaactcgccttcgggtatgctagcgtgccagttgatttgatcctgcaatcaacaagaaataacgacaaaggaaccgtggttaaatccataaacaatagccgatcggctaaggggctgatgacatatcatttatctttgagccgatgacatatgtaggtcgatcggcggtcataaacaagtaaaaagggactaaatctactcaatcggctgtagatattaacaatatgtattccttatatcgatatatacttaaatcaagtgattgggatagatcggtcgccatgccgagacagtataaatcacttagattgaaatatatattaataataggaatagatatgttcatagcatagccgattagatagatctagcgtgtatcggctaatactccgatacaactctatattaagatattaaagcaagtagaatatatcaaacaaaagtctaatatacttaaatgctacaagatcttaatataaagggcagatttaacatgtcagtaaagcatataaagcaaatatagttaaatcaggtaagatcggctgaaaccccgatactaccctaatcggcatccaagaagcagactagagattgagattctaatcacgactcataagatcaaacaactgatgcagctaaaagtatgaaaagaaggacaatatctaaacaatcaagccattggaagtttcatagagtggtggataacatatataatctaagccaacatcgatatttaaccttatcggctggcctctatcaatagatgctagccgattgtaggttagatagcgatattgtcagagattatataagatatatgataactcgacgaattacataaacaagattagagtatcataaagatggaagcactaatcccgagaatgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtgttaattgattacatggggttcggggtctatttatacccaaaaattacaaactacgtccatatcggacacgactcttatctctaacaaactctaagataccataagtctttgcggcagacttttgcccaaacatatctctaaggaaattatataaaatatcctaattaatagatacaattgccttttcaggactctatccatgcgtggcaatcatcttgaagcatatcaactcaacccgatgtcgtacaccaagtcgtgatgtcggaatcggctgtatcacttaacccagtctgactcggacttagccgattccaatcgtagccgatccggactccagccgattcctactctgtttccgtaaagatcttcatctttgatttcgcttcaatctaatcttcatctccgatgctgatattaccaaattttgtcattgacaaacggctcgcagcaagggcgagcgtccaggtggcggcggaggccgacgtgggcatgtaggcggcaatggaggccgatgaggggcgaccgacgcgtgcaggggcggcggaggacggcaaggcacagccggcacatgcaggcaacggtggaggacgacaaggcagcgcgtgcaggtggcagcggaggctgccggctgtgccacagtggtcgtgaaagttggcacggcacgaggaggtgtggtcggtgacggcggaagccagtacggcgcaaggaggcacgacaggtggtggcagtggcttgccagctatccggtggcggcgagtgggaggcctacatggaggcagtggaggctggccaactaggggcgttggtgcagcgatgttcacgtactgacggtgaagggttggtagttggagcaatggagaacagcttttgatcagcaggcggtggacgacgggtgaaaaccaagcccggccttggccgggccggcaatggtggcgttcgagcctcctgagggcgttgccgtgccgtctcaccccctctagtgtggctgccgggtgaaagccagtcttggttctctttaagaccttgatagacggcggcggcggttctttcgtcgctactttccttggagacgtcttctaggcacccccttgccaaaacctcccaagcaatgggtgcaatctcgcactagagtcttatcctcttgtgtcggcgtcctagcttccgcaagttggccacgtcgaagggcctaggggggagagcggttccattattctctctcatgctctctccctcattcccaagtatttggatagagcatagttatgtgttagtggtaagggttgggttttgagcgatctcggatgttttccgttgttggcttagcgccggtcggtcccgcttggcggcgaccggtctggggctagccttctcctgggtctgtgtgttggcgttgtcagtgtgtagatggtggtatactttttttttttctgattacgacctcctagggttgtaatcttgtatttttctcctgctatacaatagaatttcgcactgtctagtgcgagtctaaaaaaaagggactggaaaccccttcctacagcatgcaaaacaaagcatggattaacgaataactaattatgtaaatattcgctttaaaattataaaatagattaatgtgattatttaaaacaaatttatattaaaaatatatcgtttaacggttcgaaaagcgtatgtgtagaaaacaagagagtcgagattggaaagatagagtaaagagcacactctaactggggagtagaggtatatatataaatagacatgttgcaaattgtacagtaaccgtgctaactagtctggtaccatttcattctgttcaaaaaatagtctggtaccatttctagggacacattttaatcaagactgcgcagcaatcgtgccaactagccatcaatcggaaataagattgagcttacaagtacattttattacaggttgcagagtaaaatttgcggtgttctcaaataaaatggaagtcaaaatggtgttctgatcaggattacatcaaatgttcttcggctcgatctgcagtgcagcggctccctgttctgctcaagacagtactgagactcctgtgctaccactttgacaatcttgactcaaaacaacatggtagaatttcttcagacctagagatggtattgcagaagaggcgttgaaccaaattaatgggattcacagtaaccaactagggattagaatcagataggcaacctggggtgcatacctgttggtgttggccagacaacaccatcttatcttcaccatattttaccagttcaagtgtcgggcggtttgcgtggaagtcgactgcatatctcgcagccgcctctgctttctccacctcctcaagacatgcattttcacagttgatggagacactgaatttctttacgcatggattacgctggagcatctgtccgaggacaaaacgaagatcgtcgtcctttctctcatgcgcattgagattttcgacaacaactttaggaaagaagctgctaggctgggaaggagaagcaagtggccatcaagaaagaagaagaaaactaattaatatagagaagaatagatgatacacagctcaatcaccaaaaatgggagccagcggtcactgaaagttccaagaagtgttttataaatataatgttcttttactaacggtataaacgaatttaaaccggtatttatttatactgccacaccaagtactagtcgaatactctttttctaccagtactagaagtcataaaccaacagttgagacgtcttgtactgttgataataatagtagtgcgtagtataacagtaccaatagagaccatcggaaaaagtccgattgattaatcagcccatcatttcgcttattcgtggaataagtcaaacgctatatttgcaaaggaaaaataatatgtgcataaaacgtttatataagtgttcttagcgatctaaaaacagaggctaattaaaataaatttcaatgaaaaaacctcgaaataagctctaattttaaacttaaaaatttaaattttagctgataagtataaacataaacgaaaagatgaggcccatttgtgtgagcgtacctcctcgtgagggggaagcatttctccctccgaaaacttatggatttgaagggttggacggttgggatggatggcggctgcgtgtgccaacgccgcctccgcttcctcgacttccatggcacgagcaccacgacattggatgttaacttggacttgttggagcgaacttcttccaagatgagcgaagctaaacagcttgtcaaatccaagtatgtcggtatcttttaggatccgcacataaacacaaaaactgagagttttgacgtttggcatgacagctttttcgtctttgctgcacatgatgccatgctgatcaaaccggacatacaagtagggtgtgttcaaaaatctcaactcttggaagcaggcatcaccagcaccggcaatcttcccgatgcttactatcctgtcgcagtgtataaacagatggaggtatcgtagttttggtaacctcccaagggtttcaaggtctagctcttccaaaaaattcactctcaattcaagataagagaggtttggaagaagcgaccaattaatccactctggcattctatgaaacctcaaagacaccaagcagaggtatcggaggcattgaggggaagtgaatcctgcatcccacgtgacaccctcatttggattaagatttaggtcatgtccaaagtttggatcttgtgcagattgcatagggactccagcagtgctgatgtctcgccctgtccatcaagcttaaggtttttagcatgcagcaccctcagttccctcagcttgcctaggaccttcacgaactggaacgtatcatcactataaggccacaaatacagctcctgtaaggacgtcagcttctcgatcacaccaggcgacacccttacatcaatatcaacacgtagggacagcaattttgttagcaggcccactgactctggcagctcgtgtatgttagattccttcagatgaagtacttgtagaaacctcaaatttctgaattgctctatgagaggaatagaatcaatacaatctagatggaggaacctaaggtgaagtaaatttctaacatgctgcaggttaattttaccatcaatgttccaccaacggccttgcttttgtatttctagtacacgtaaaacttggaagctcggtaattgcatgttcttatcaaagcactcagtcataataagggaccttgtttgcttcacacccatattagccaactgattcctgttctcttcaaaactccaatgttgtagagctaatctacgggcatttttccatgaaagttcatgttccttactgccatctactacagtgacaaagttttcttcacctgacaataagaggatcagatcaagtaccatgtcatg

SEQ ID NO: 71645 - DNA, 6580 bp, Oryza sativa
cgctcgcaccctggaggccacaggtgattactcgtctctactctactcgcatggattgattcagtcgcgcttgcctctctctctgctcctttgcctctcatcaaatgcaagtgctggtctgttactgcagcggaaacgacggcgtccatcgcccgcagcggcggcgtccaccgccggttaaagcaggagccgaggctggcccgcggccgaaggatggggatggcgctgcggcggcggcgctgacggctaaggctaaggctgtatgtgacgtcagcgcagcgcagctagccgttggattcgttgttggaatcgaaggtgccaaaaagtcagagaagccgacgagggaggagtctctcatctttctcttttcctcctctcttttcttccttgggatctctccaactccaaccatagcaccacaagattacgttcctgcagttcgactctcagtgctactatatgtattatatcttgtgatcttcttcttatcttggccatgagaattggattagccatatgttcatacttcgattcgattccatccacttttggtttggttcatgctattggagtactcctatttgctgatgtactatttcttgtgccctgtgagtgactgaccgactgacactgttgatcagagccagatggacagctccagctgatcgcctctagtttgatggagtaattaattaggcagagtctccattatccactgtacaacctttgattaattgattgatgttgctattggctgttgtagacccttctcactttttcttttttggcgaggaagctgatttcgaccgttctggttagagcttttagatcatagacgtagagtcctccgtctatcgtcagatttgcagtagaacgaacgggtgaaccgataaagaaagacagaaagaaagcgtgcccagtgttgtggagaatggcgcctggtacatcacacaacagaagcaagggggtcatcactcataactctgttgttggttggttccagctgctacctgggtggctcatggtcatggctgggtgggcacagtttgtttacattgctgctcatcacaaagaaattttttgtcccctgtactgcctgcctttgtcttcaacactgtatactactctctccgtctcataatataaaaaatttcctccatctcataatataaaaaattttagagttagacacagccattaaaaaagtagataaaaataaatagtggaaaaagtgaatggtggaggattgtgattagttgtgaagagaatgtcggtggagaagttgtattttgagaacgaatggtcaaagatgtcaacggtgccatacattaaaatacggagggagtatattatgggatggagggagtaacaaacactgggcacaagacaacacagcatggatgtgtaattcatacaggacacccctcttctgtcatgtgtaattaccatcacagaaatgtgtaattaacaaaaaatcaaccctggttttaccatcagggaagacagcaggccggggtccacggatcatgcagcctcctgctcgacacgagtacatgacataactaacagtttcctcttaaaaatgaaacaaaaaatttactaaatggtgtcggcgagcacgggcaccataatgctgtataactgtagggcaatagccaggccttctttcacggtcgattcctccatgctatccaccgacaaggagcttaaacacacacacacagagtcacacacaactggagtatataactcgagtaaacagaaacttccagtccagggggtaaaaaaaaaaaaggatgatcgatgcaatacaagatccattcgcctctcgcgtctctgtattaaacatgttcattatccccacattcaaccttggctttttgaaaacgagggaacaaaaaaaaagaggaataaaacattgaagagaaactctttaccagattaaacagcacagcagaccaggatacatgatgtacatttcatatacgtgacacttataacacgaggcatgagatacaactaacaacatactccatggtacctcaaaggcaaccaaaagaatcacccggattttatttgccaattactttcactgcattcaaatccgaagtagtgcagcagacagcttacttgatattctaggccactatcatacatgataaaaacacagaaaaaaaatagtggcatggtaccaaattatcaaccaattctgtagttattgtccactatggcaaccaaactcacacaaagtcaatttcaggctcaagttgaagcatcattcttttagaggatatggccaggcactgaacattatctctggaaacaaaaaggaatggtgcaaaatcaaattcttttgcacgcaccagcatacgagctttttttctgaagtttcaatcattgcaatttggaaaaatattatagcataccctcagcctgtaccatcttgcactcctacaaactattatctaattaatcgaccatgataatatgatatagctacagataccattatctatataatttgcccaagacattttcctgctctaacctgaagaacaatatgggcttgtgttcaacatggcacaaaaaccgtagacaagtgtgggggtttcaccaggagcaggacaccggtagttcacaaataagcggaacaaaagcaaaaatatcaaaacctcgctaagttaaaccgtaatttcactgtgaaatgcattgctttgaggtggaaaatgaaaatccgcctacatttttcatttagataaacggtttataaggattgcatggtactgagctttaagcctagctgaacatgctggtgaagtgttttgatttttttcttgtctacattacaatggcatgaaaggattactcataccaaatttgggtgcaggacacaaccgcaatggattgacaccgggtcacagttccttgattcccttcaaacagatgcctggtagaattctggacttgtaaacttgcagaggcttccctggaagacacctagttcctagaaattcctcgtcttcttggatgcttgaccgaggtcagccaatttttcctgctgcttgcgtaggtaaccacctgaaattcttaagatcctgaatcaaccactaattcgcagcgggcgatggctctaactccaattaaataagggcaaagtaagctggtggtcaactactagacagtaagctatatcttattcgtaaaccacaagtaaactgagtgagctgagagctgtagtttcgtcgatgttaccagacatagagacgaggttgatgcgggagcggggcgcggcgaacatccagctgtcgtcatcgagcgacctgacctccttttgcagcgcctccatcacctccgacttgagctctgcggggaagcaaccacaaacatagccgattcagaatccaaaaggagaggaggagcggaaaagctagggcttgcgtgagggtttgcctgccatggcctcatccttgcggtagagcgcgtcgatggagtcggcgacgtcgtcggaggccgagatcgcgcccgcgctggccgccgacacggtcgacctcgccggagagctcatcggaatcacgcgatgcttttccccttttctgggtgaaatcgaattggagtcagtctctactgtttgagaaaagggagacgacgagaaattaatgggcccgcgttattgggccggcctgttaacgcgagatggagacggcccatttagtgtccactagttgcgtcttcgcagcggagatcgaacagaagcagaaatccccaacccaatcggaggaggaagagaagggcggcggcggcgagcggagatggtgaggaaggcgaaggtcgagttcgacgagagcccgccggatgacttcgacccgaagaacccgtacggggacccggtggcgatgctggagtacagggagcacctggtgagggagaagtggatccagatcgagaccgccaagatcatccgcgaccgcctccgctggtgctaccgcatcgagggcgtcaaccaccaccagaagtgccgccacctcgtcgaccagtacctcgaggccacccgcggcgtcggatggggcaaggacgcccgcccgccggagctgcacggtccgatgagatgatcccccagctctaccatttcgcttcctctagtttcgttttctctacttgattgatgataccattgccttgttggtgttgcgcagatcccaagaaggtggttgaggccgacgagtagctttgctgctgctgctgttcctgggctggagaggtgaggctatttcttgtctgatgaagcactccaattttatctattatgtgtcaattatgcagcttaaaatgaatgatttgttgttaatattaacttccatcattctacaatacttatctattttgtgtcaattatgcagcttaaaatgaatgatttgttgttaaacttaaccatcatcattctaacaatacttatcctagcatttagaggatgtttgcaattcagcacacacacttgagtaattaattagagctgcaataccctgttctatgttttgcgtggggcataacctgttgttcgatttgattggggattttgtgtgaatataggaagcgttttcgtttaggaaggttcggagtcttgagactgcctaccgtttccattgtatgtagttgtagggataccttctaatgaacaaattcagcatatgccataaaaaagaccattcctgctctcagggcatataacgtaaggaacaatgggtaaagggaaaagtggatacgtgtgaagggggcaccaatcttttttcctttggaataactctatatttaccattagtgctgtcagctatttagtttgtttaaatttatttctaaggacaattgaatggcttagaaacactccacatacattcaaaaaaaatcttaaaagcatcctctagcatgggattctccatatgtcatgatattctgctatcgctctttattgaagatccctctcaatctcttgaccttatctttgcttgcctcgtaagatcgaatagaagaatacatgtggaaatattttgtgcaaacataatctccagcctcttaatctgatgtgatcatgtgatattcccattccaagagggaaaaatgctgattataatatggtcattttgtgatgactctggaatctcttttgtttgattttaatatatcatatttctagtgcccgagtgtgatcgttcacagacatggcgcagttaagttcgctatttactccacatcacaaatcctgccttgtccatcatgcttgtgctactatatgtattgataattatttgcttgatatcttttgctacctctgaagcaccatataactagcatttgatttatcatctgttgaagaaaaatggaatgggaaaaggtacaactatatttatgttgtatagttatagatcatgacttgaatcgcttttatcttttgtgcaggttatctttctattggatttgaaaggagtaaaaatgaactgctgcagtccttattttgacctctctagttgctcatggatttacaataaatgatgatgtcgaagtaacattgttgtgtgttgcctgtatttttccctgcccgttctataagagccgagcaaatacatgcttgaatttatctgccttgttcttgtactcaacgatatgaatgatatttagttttcatttaccctgcgccatagtctcccgtgatgccaaatgcagtgcaagtttctttttggattaatgctctgtcgagcactagctgattgctgattccgagccgttgtcaagctctgactgatgattacatggcgtgttgcaaaccgatcgttatctagtttgctccagtgtatttgacacatataaacgtgtgacttgaaagagatagcctattttagttgctgtttgtgttaggtaacatgtccatgttgtgacgttgccaatgatcagttgatcaccacggtccatccatgaggtcgatgatgttagttctacacaacacaacccaaaatgcaacaaccaactctctaccactgcaattctctctttgacacagattctggcctgctacattgtttgtgatttcgcatctcgcaaaacacaaaaaagaagggcaaacaacagaaagacggtggtgagacagttgcattttctcgaatctttttataaccatttgaatggcatttgaactttttgaagaaaggatagtgctcagagagacatctttcgtggaaaatgtggagtaggagacgcacgggtatctgagaaaatcaaagcaaggcatctgatacgagagaacaagaaaaacattgggtgaataaacatggagcaaaaacaagaatcatgcagcaaaaaagcaagcaagttgcatccatgacctggataaacagaaaaagaaccaaacttttttcatatgagatgctcactctggataatgacccgtctcggccacaaacaaccaatcacatatcacattcccaggaaatgatgttgatgatacatacatccatccacaatccacggattaataagcagatcgatatgcacatccccagcagggggatcctctagagtcgacctgcaggca

SEQ ID NO: 71646 - DNA, 23167 bp, Oryza sativa
acatttaaatacgggagggagtgtttattagcactaactaatcttgtgattaacactcatcacataattagtgtcagcgcgtgtgggcgtcgcacacgggctaattaaattcttttttctctctcacccaaacagagaactcgcgaaaaaaaaaacatcgaactacctatttctacgcgcgcgcgacttgatctttctgcgcgtgcgcgcgtattagaagcccccacatatatatatatatatatatatatatatatatatatatatatatatatatatatatatatatatatatatatatatttccagtaatttaattacaatgtatcactgacacatggaaaacacgaataccaaccttacaataataagtggtgctacaatacatagcatatatcctagacaatgtccgatatcatactccctccgttttgagatgagcacatatttgaccgtttgtcttattcaaaaacttttgtgaaatatgtaaaattatatgcctacataaaaatatatttaacaatgaatcaaatgataggaaaagaattaataattacttaaattttttaaataagacgaacggtcaaatatgtttaaaaaagtaaacgacgtcaaacattttgaaacggagggagtatatatttgtccaggtttattggctagaattaggttttatttagggtggagggagctccacatatagatgacacttaggccttatttagttggagaaaagttttaggtttggttgtcacatcggatatacggacacatatttgaagtattaaacgtagtctaataacaaaacaaattacagaccccgctaggaaactgacgaatttattaagcctaattaatccatcattagcaaatatttactgtagcaccacattgtcaaatcatgacgcaatcaggcttaaaagattcgtctcataatttacatgcaatctgtgtaattgattttttttctacatttaatactctacgcatgtgtccaaatattcgatgtaacagtgtgaaaaattttgttttgggaattaaacagggcctaaatggttgtaatgtgggccgcttcctggctccagattgtaccctaatagtttagctttgatgtgtacatctcgtgccggaccattcgtcttctccttatcaccgtcgttagtatcagccgtcacctctatttgctgctgcaacaatcaaatcataggtaactaattactcttttcgattcatagtattgtcgtttgaccttttttcttgttaaacatatttaagtttaaccaagtttataggcaaatatagtagtatttgcaatacaaaacaaacatgttatcaaaatatatttaatgttaaatttaatatataaaactaatttagtgctgtagatgttgctttttttctactccatccatcccaaaatataaatttttttagcatagtgacaagtcaaatatttttaactttgactattaataaaaaaccaattaaaaaagatcaatcaagtaaaattgatgctactatatttattattaaacaatctatcagaatatgcaacttttttaaaaaatatcttacttttatagatattattagtcaaagtagcatcttgagtccaaatatgcttatattttagacaaaggaattataaatttagccaaatataaaaaacttttactaagaaaaaagtcaaactgacatgaaacatgagcgagtaactatatgaaacatgagcaactaattaagttgctcgtcaattacttcttcctcccatgtaaatatttggcttttaccccatagagtcagtcaaacttttatatttctggcatcgataatttctcaaacgcttactttacggacaaaacaatagtagcaaacatatactctttgtctaaaaaaatactattatatataattgcataaatttattgtattttgcaagcttgttctagtatatataacttaatttatgtatacacactactgttataatttatattaaatataattttgttatatttaatagaacgcatatgctatcgtatataatattatattctcatgatagtatatatatgagtaaatacattgcattgacttactggagcaccgtggttgtcgcaggatgacggaggagaggcaccggcggcagcgtcgccgccggagttctccttctggatcagctcgtcttctagggctccggcggcgtggtcggcggcggacttctcgcccgcggccgcgttgtgcttgagactgcggctaccgttgctgccgcccaggaatggagaagaacaggctagacgaatcgcgctgccggcgccagggacggggaggcggtgagcgtgagccgggcggcggcggcggcgagcgtgcacaagctgctgcttgccggcgccggcggccaccgtcgagacgtcgaggcgagcgagcgccgggcgggccgccatggatgagctagctagctagttcgctatggctgctcagcaactatgagaagcgctctatttatagcctgcctgcatgtcgttaaacaacaacgactagattaattaatttgcatgttgtatatatatgtttaacttgaaagtttggcaccgtaaaaagtaaattataggtcccggcctatatcttttcgtttagacatatttaaatgtatatataggtatcttaatggtaatctcgggtggtatatattactccctccgttccaaaatataatcatttctagctataaatctggacatccgtcccaaaatataagcattaaattctagctatgaaactggataaatatgtccaaattcaattgattatattttaggacggatggagttatatcaatagaagtacatggaccattgattatgagttctacgtactcccccgtaaaaaaaaagcccaacatttgataggatgggatatggattggatattttctaatataatgaatctgaaccgtctttgttgttctataaaacacatcccatgcatcatatcatatatagctaggttgtctttttatcgacagagggagtatgtactattgctaggaaaaaatattattcatgctattgatttgagttgaggtgtagtataaatagaataaactattggattataaaaaaagatgaatagttatcaatggattccattttaaaacatcgcatgattcaaatgtgacaggttccccttttagttgtactagcaattcatttatactacacaagtaactaaattttgaacgcgtggttagattatatcctagtctctccataaaaaaaactcaacttgaaaggggatgcgacataaaatgaatctggacaatcatttgtctagattcattgtattccccctcctaggttaggtattttttacggaggaagtacatcatatatagcctttttagactcgcacatttgttcaaatatcatcgtacatgtaatgttctattacgtcacaaatttattcgaattttatatgtcattccaaattaatttggagccctaaatcacttggctatgtcgaattttttattcaatgttcaccgaattttaattaaagttcgacatgatgattgaagtggtttatgaatctgaatgttggatgatatatataaatttccgctggggctaacatttcagcccaaaatgagattgcacaccggtttacctttaatttcttagcatatgattttcttttgccactactaatataatatagtgaatccacaccagagacgacacacaacagacttagcttgtttgaagtcaaatttttgtattatttgacacaagtttcatgttaaattaaacaatgcactattcaaacatattgatttgggcatatctatttgcaccgtgacctttcttcgtactacaccaattagaaggaactagtcggtaattaacccattagtacacagttttgctgtactatgtacctaattaagtcattcaatccgcagctagttttggtcacctatatctaactaacggtgatgtatgtaaaaatttgacggatctatttattagtctaatccaatcatagtgacatgaactcacaataattaattagcacttaaaatgtcatctaagttataacccaagcgagaccactcgtcttattaaaaaaaatttatgcaaataaaaaaaataaaaaattgtgcttaaagtactttggataataaagtaacaaaaaaaataataattccaaaaaaaaattaataagacgagtggttaaacagagcaaacaaaaactcaaaatcccttatattatgggatggagggagtaaaagatagcacatctaaattataatctggatgaaaaaaaaaccatttgggtagctttttgttctcggagaatctacagctaccataagctccccaaacaagtcccaaatccttacttaagcagggagattctgacagctgctgctcctctttcagaatttccaactcactcaaacaatccagattctaacctagattcactactaaaaaaatgatttttcatggcacttttcttttatattttcagataaactaaaaatagtgccgccagtgaaaataacgtttatttttaccaatgaaaaccacataatctttactggtagatgacatacgcatctaccagtgaaaatcgatgattaagttgtccaccggtgaaaatcaattttataaaaatatgtacttttacctaaatttttcataaaaagtcaaatgaaaataaagtttagttgaaaacttttatgtttgaggttatttagagttcaaaatattcgttttaagattcaaaatatattttacaaaatttcagatatatgattcaaataatctctaatggacacatgatccttgtcaaagttgagctcaacgagatctacaactttgtagttcatgacatgttttcatttggaattatttagagaggcaaataagtattttaagttttaaacaatggaaatcaaaacaattaatagcattctgaatatacaaaataagtgcttcatagttgagatggtaatgtaatatatatgtgtgtagagaaaggacttgagatcgaatactacaaaccacacatttgtgaatttaatcccaaaaatgcctaaattgtcaattaggatgtgtagttgtgttatagatacccgataaaaatcaaaatatttttttcattttattttcgcaccggaaaaatcaaaatgataaagtggaaatcaattttcgttggtgtatgtgttatgtcacatgtcagcaaaaatcattttcactggtggttggatgctgtcaatgaagatcattgattttcactgaccgttaaagttggcggaacgtctagctgccaagaaaaatatgttttagccaacagaaaaaaaatatgttttttagtagtgattttgagaattatagaatttataattgtatgaaccaggtaataatcgaaaagccagaagctgaacaactcagccttttcttgattctcaactagctagttgcttcccgaaatctgaagctcgactaaatagggcgtaaatttacctcaagcatgatacataatcaggcagaagtccaataccattcaacaagtccacttggcgttgcaagtgtgtaagcgtgttaactagctcaagtgtggagaagacactaagctcgctaataggcgatgaatcaaataatatatatatcttcgacgatgaacatgtcaacatgaccttatgtccttataaagttgcaagtgtagacctaatcttaattattagccaagtcaaccgaaaaataccaatgaaaacatttacattttaacttaaattacgaatcacaccctgccgactaatgaagacatgcttccacatcaacacgcgcgtggttacacacacaaagctacaaataatactaccagctagcttgctatagtgtgtgaactttgacaggcaattgctgatcgtgtcttagtcatgactcacttttacgactacgaatcatcttctcgtattagtctcctaaaacaggagttagagatgtcggacatgttttacagcaatacctcaaatgatattctgtgtgcttgtaaatatgcgaaaaaaaatattcaagatgcaattatttcacatatacatatataatactccctccgatttttcaatgttggttgcggttgattttaaacatatgttttaccattcatcttattaaaaatatatataattatcatttatttattgtgattttttatcattacaaataaattaagaccttaggtcattggtgcctgttccataaccgacacccttgagatgcattggctcaattcgagctgatgctttgagctaagaacttaatctcaaatcatcacaaatctaaccaaaactaaatctcaatccaatcaaaatcatcctaaaataaatcacaggacaagagacaatccaatcgaaaatcacaaaataaatcacacaggagatgacaggagagggaggggcgagcgagaggccacccacattaattaggtaaaaggtaatttagggttcaattattaggaatacacaatttgaaaataaaaataactgaaattcaaaatgaaaaacaaccagtattgacaggacgatgcatgtagaacgagactaataaaaattaagaataaaaagtaaaataaattccgaatttataaaaaatagaaaaactgagttcatgtacgaatacaattgtgaaataagagacattcataacgaaaaataagaaatattaaaaagaatactccatgtagaacacaataccagattaattaaaataaaaaaataaaataattttcaaaattagaaaaattaaaaaaataagagttcaagtattaatataatttataaatactaaaaatcagaatataaataaggaatataaatagaagagaccatttaagaatccaacacaaaattaattataataaaaataaaataaatgttgaaataagaaaaaaagagagagagttctagtaggaataaaatttagaaataaaaaaaccgtaataaaaataagtgatgaaagaacagtcgatgtagagtacaatacaagattatttaaaattcaggataaaaataaaataaatccccattttttagaataaaaaaaatgagagttaatgttggaatataattttaaaataataaaagttcataataaaaatatttaaaaagttcatatataacctaaatgtgaaaagtaacaataatgaggggacaacgggtaagccggaaaggagtagggttgcgacggttgatggcacatctaatctaaaaacaaatgctcaatgacaattaggtttgattttttttaaatcccaatgactattaataagagggcagcgggcacaacgtgacgaagtagggtcgcggttgacatgaggtcgataggacttctagagaataataaaagaaactcaataattatcatgttcgatttttaaaatctcaatgataataaaaggggatagaatgagctgtaaaagaagtgccatggtggctttggtgagacttctaaaagtacaaaaacagaacctaactataaaaagactacaaaggtctgatatttgaagattttatggagaatatggagaggataaattaatagatgttatgtcggaccgggcaagtaaataattaggcggcaattcggcaaaggtcctagggatgatgtttggtgtgacttttaaaaactgtaaaattagaaattccattaaaatcctaagacaacgcctaagacaacgggatgactggatgcatattttaaaaaaaaataaaaaatcgtgagtaaaaaaatgtagataatattatatggttgttagctgcgcaattgtgtgggccacccatctagctgcaataatattgtagtacataatccgattaattttttgttgaaaattagtaacaaaataatcgaaatgatatgtggtagttcaagctttcaaattggtccgattccgcgcgggagttcggacgaccacgacgacataataacagtagtagagagattaaacacgggataatcctccctaacacggctcctaatcggattcgattcaacgcgcgtcactagcatataatcacccgcccggattagcgacgcataattaatccgtctacgtaggattttgcacacgattaacatctagcattatcgccaacgatttgcgatttgatcgtcgtctcgtctcgatctccggcgaaatcaacctacggccatggcggcggcggccgccggcggcgacgcagaggaggagaagcagcagcagtcgccgtcgtcgtctacgttcgagaggctgcacggcgagctcgtcagggaggccggggagctcgcggcgtcgtgcggcgccgacgtcaccgtgctggccgtcccccccgcgcgctcctcctccttcgccggcggcggcgtcacccgcttcgtcggcggcggtggcggcgccgccgcggtgccccgaccggaggaggtcgcgagcatgggtcccgatgaggtcgtcgcgctcgacgagcggctgcgatcgctcaggctcctcgtgatgcggaggatcaaggcggaacaagagaaggcggcgacgaagccatgacgtgttaattagctaggttgattgtttgattctaggtgtatatattgtcacatgtcatgattaaatttgtgttgttccaatattaaaacaacaggtcaaaatttctacaagtaagaacatacttgtgtaattctccaaaaaaaaaaaaacatacttgtgtgtgtcaatgtgtcatacagcgtttaatctttcgatttgtacgtatcggaggtgccgatatttttttttagataatgtaatataatatctcggcctttgctcaaaaagaactacagccaattattataaagatccactccagaagagagtgtagttcaagacaaattgaacaccccaaacaagagaagagaggacccaaactgagaaaagcaaaacaaaatgtggagctagaaggcctcgtcaaggactaggactgaagtttgaagcccatgcatagaccaatgacaatatccttgcatgaagaggtttcttcaaagcggtgcccgcaaggaggatgcgacgtggatcgctgccaccgctcgttcggaaccgaagcaaagtttttacccggagaatatggtagggaaaggaaaggggtatgctaaaacaacgcctccaaggaggggaacaacgccaaacggcgtcgccgttgtcagccagccaaatggcttggcaaggctttcgcccacgattccatatgcaaacccacaccaccaatccgcacaagaaggatcgtcatcggtcaacaacattatcccttcagcgattcggccaaggcaccgcccacagttgttcccgccgtcgatggcgcgcccgcacccggactcctccttccccgccgccagaccccttccccgcctccacataccgccgccgccgacgacgcaccgtcagccggatgatagccttcaaccattgccgccataggtaccatcgtcgacagccgatatgatgagtacttcacttcatcggatacgcacgtggcttcacacgtttcaatgattgttttaagtccaagtccagttcggtctccagggaaagcactgactacaaacggactagtgtcttcatgccaactttgatttgggtgatcttggacttgatgaaaaaattatctcgctacctttcaaacgtatccggtctcatatccaaattcatttttgagtcaacggaaattgtcaaaacaagacagtgttgttgctaaaatagaacttgggccttggaacctgtaataaataagcctatctcggaagtttctattttcctctatctatgtacgccctctacaacatttgggttttatttagttgaatttcaccaagtgtcattcatcttgtctctagtcctcactcgattagtcgacgactacagattcagagccctcaatagttggtgtgttgatttgccgggtcgattagatctaccactttaatctcaactatttctttgtgcgtaatcacctatatgcaatatttagattgcatcttatctcgttattgtagtgttctcttatttgcattgcagggatcatcaaccgtgcgtcatagttggtacgacatcatttgtggtgtagtgattgcacggcgtcctggacttgttctgttggttggtagccacatcgcaaacgtcgcactcgatcaaagcgagagttatcccctcaccagaaaatcgggccacgagatagatcgtcatcacgatataccgaaaatttaaacaaattttaatcaaacttaaacaaaatgttgctaaatttacaaaaagaaagtgaaaaaattaaaaatgtccggttttttttttgacccgaatgggtgggcacgacagctgtgtctagtgcgagtatataagcataaatgtaatagggagaggtatcgaatttgaaaacacaaaactattccctagctaattaatacatctcagttcttttcacttcttttcaaatcaatctactaactatgtcctataataattatatttctattatttgaatttgttacaaaatacttatcacaataaagtactaatggtttcattaatcacttctcatttaagtttctctctattttatccttaattatccttccacccttatctatacagtatttaataagggtattatatgtagtttttttggttaaatcttaatatatactaaacaacctacaattaccatttatataagacggagatagtgaattccttcctcggtacattagctgctttctattcggtttacctgctcaactgggcctgtagaaatacggcccataaactcaccctcctcaatttccctcttacattttgcctaaatacgaccaaaaaatagtcaacactatttttcttatgcaaatcttaatcaacactaaatcctaaccctaatcctactcggtttattagtctcaaactcaatgcttagtcatctcggattttaacgccaccaagctaatataatcaccagattagcggccgcttaatccgtaatcccgtctcgattttgaggtttttgttagcgatttggcgccactcgcgaaattagccgagcgatttcgatctcgtcgtgttctagaacgcacccggccatggcagcggccgccggcggcggaggcggaggcggcggagagagccagcagcagctgttcgagaggctgcacggcgagctggtcagggaagctgaggacgtggcggcggcgtcgttcggcgccgacatcaccgtgctggccgtctccccgcgctccggcgagccgcgcgtcagccgcttccacggcggcggcggcggcgccggcggcgaggagttggagcgggcggtgggcgtcagcacggaggagatcgcgcgcatgggtcgggatgaggtggcggcgctgctggagaggctgcggctacttcggatggtcgtgctgcggaggatggtggtccagaggcagaggagacggcgactccggcggcagcggccggcggcgccgccgcggagcatcatggtcgtccagaaaagacgacggcggcggcagatctgctagctataggtcgtctgaaatggttgattatttggttctagtaggtgtattaattgtgccatgatctataattcattgtgtaaataacaacgattgatcgatattatgattgaatttgtgtgttagggcaagtacataggtagagtctctactttaattaaagactatcacgttacaatatttaagataatacggtctctaaccattaatgtaccaaaatacttttttactggtcacctttcctttattatactcaatgcaacgaaaaatttcctaataaatgctaagagtcgactctatgccgttgtcatgcgtagcaattatctttctatttccttcttcctctctctttcacgtcaccaaatatgtttgcatgataatagagagaccgctaataaagaccattatacatgccctggtcaaatcatcaggtctggtctcttctactccctccaattaatgcctccatttcatattataagatgttttagtctcatcatgttttagattcactgatatccatataaatttgaacatatatatatgaattacatatatgaatacatgaatgaatctaattttccacgcaaaaaaaaaagaatgaatctaatctaaaactaaaaccgttgtagaatgtgaaacagactcatggtgtatagcagtgtatgtgcgtatgcgtttcatgggttcctaatgacaaggcatatctaaccctcgttgggattggaaaaacaacggttgtggcactagctcgaagatgagaggattggccttaagggtgtaagtggatcaaccacaaatccattcaggctaaatatactcatttacttaatctataagtaggtttgtggctatcccttaactagtctggttgacaccatcaagatggatggcgtgtggtgctttggggtggggccggacaagtggcaagagtgaccaagctgaatgagagtggaattaggcatataaatagcaacatatataattcttagggcaatcctgggtcctgaccatttaaaactcaaaccatcgtagaatgtgaaacagagacctatgaatagcaagccaacatgcatgatagtaagttgaaagtagttttttttattattattatttggcgtgcattcctctttttttttttcgccgacgatggcgtggcctctgtctattacgaaaaaaaaaaataatgctagtgaaaattagccagcaagtagaaaatgctaccacgagtattcatcacccagtctctatggcaacattggctccactaccgatctctcgtgtattcttcgccccgttcgactttactcaagacgaagacacatataaccagaaatcccgccattagcacataattaactagtgtttttttgcgacataattaattgagtgttaattattctaaacttaaaaaaataatgtatctaatattttttagcaacttccatataaaaaagaagtttcacacgaaatacaccatttaaccgtttgaaaaacttgcaaactgaaattgagacaagatttgtatcttactcagaaaatatacgtatatgtattatcatccgcgtgtaatcataaaaaactaaaacaagttcatactatcgaatgaacaaaaatactacctcgtttcatattataagtcgttttctaagacaaacttctttatatttaagcaaatttatagaaaaatatagcaatattttcaacacaaaacaaaaaaatatcaaaagatgtgcaacattagatgtaatgaaataaattggtgctataaatgttactacattttatataaatttggtcaaactaaaaaaacctataatatgaaacttaaggagtagaaaagaccgaaattttacctcctatgcttttcgattttgctatatatttatcgataatttttttctaaaaaattgactgatgtaaatatagtgcaatcttaatgtatttacattgtaatttgcatgtaaatacaatgtagttttaaaccgttcgatttgctttaaaaatcgtgcaagggaggaaggcaaaaaatcacaacccactgttaacgaccaaagttggtaagatatgaaccaggttcgacaatagagtcgaagcggattcggcaatgagatggattcgaagaacagagtatgcatcggctgcgaaggcatcggctggagtgtgcatcggctgagatggatcggatagaagacagccgatacagccgatagagatgaagcaaccgattccgacagtagtggcttcaaggctgtttctagaatcaatcgacgtgcttcacaaggattaccacgatggagataaagctcttagataggcaattgtatctattaattaggatatcttatgtaatttccttagagatatgtttgggcaaaagtctgccgcaaagacttatggtatcttagagtttgttagagataagaatcgtgtccggcaaggacatattttgtatctcgggtataaatatgacccgaacccatgtaatcaaacaacacatgttcaataacaaattcggcgcatcgccacccttttattctattttgacgagttcttgctttcggattgagttgcatcgattcgatcttcaactagaggtaaacttgtcatggtggcttgcgttctcgggattagtgcttccatctttatgacactctaatcttgtttatgtaattcgtcgagttatcatatgtactatataatctttgttagtttcgttacataacttgtcatcggctggtttttactgttagaaagtagccgatagagttaaatctcgttattgatctagattatatcgtatgtctaccatctctcagagattttcatcatcttgtttagatcttacagttattttatatgcttaatgctgcattggttaagttcgatctattaagttttatctatagttgtgatatctagcttgttttatgatcatctatagagatagcatcggagtttcagccgatcttacctaatttagctattctaatatcatatgcttaattgttatgctaaatctgccctttatattaagatcttgttgctttaaagttatattaagttcttatttgatatatcttgcttgtttcgatatcttagtatagagtagtatcggagtactagccgatacatgctaaatctatctgatcggctatgctataaacatccatataatctttgctttaacgtatatttcgacttaagtgattcatactgtctcggcatgacggccgatctatcccaatcacttagtttaagtatacatcgaagtaaaaactgtatgttgttaatatctacagccgatcgagtagatttagttttattttatctattaatcattgccgatcgattccaacatgacatcggctcaaagataaatgatatgtcattggcacctagccgatcggctatcgtttatggatttaaccgcagtttttcttgtctttattcttattgattgcagaatcaaatcaacaggcacgctcacgaacctaaaggcgagattttggacttgcacaggagttaagcagatcttccaggccagtgtgtgtttttcacatcaacgcatatgtgagggtattcggtactattacttatgttttcactgaaatagcatgccacctagggaatttcaaaagttacgacatagttacatacaagttacaacgtaattagaacatgattgtacaaatttttcagttgaaatttaacgataactgtatagctagtccaaggtttaatatttcggtttagtgttttgtatcggtggtggccgaaataccgaaattttaaaaatttcgatccaaaactatatgaaattttgaataaaatttgaacaaaatattaccaaattcatgaaaaaatgaaaaaaaattcggctgaaataatatggtatggtgaagggtgggaggggggggtccgatagaaccgaattttcgaaatttcgatccgaaattgtgaaccctgagctagtcagtcccatcctttttcatgcaaagtgataagaatggcatgggcgcggcaaacgcgggcggtcccaagctccgggcgatcgacgagccgccaaaaccgcggggcggcagctcatgtctcgcctcgccgcgcacatgacattgataataacaccgtcgtcagcgctacccaaattcccccaaggcgccgcaacgttccccgacgccggccggccgcccacggccctcgcgcgcatgggcggcttcgctccccaccccgtcgtcgtccccaccgccgccatggacgggaccagcagcgttagcgcgcggacggcctcgtctctgtcgtcgtcgtcgtcgtcgctcgacgacggcggccgtggccggcctccgccggccgggtcgacgctggagctgccgtcgcggaagcactaccggtacccttcccggtcggcgaggctgttccagaagctgcgccgctcgctcccgctgctgacgctggcgccgcggtgcggccggatgcaggtcggctcggcgagcgaggtcgccgcggcggcggcgtccggcggaggaggaggaggagcagccgactcgcacctgatgtcgcacgtcgtgtcgtcgttctccggcgcggcgcggccgatgcggcgggtgacggggacgctgttcggccaccgcaagggccgcgtcgcgctggcgctgcaggagacgccgcgctgcctgcccaccctcgtcatcgagctcgcgatccagacgaacgcgctgctccgggagctcgccaaccccgccggcgcgcgcatcgtcctggagaccgagcgccgcgcgccatccacggacgccgccgccggcaagcaccggagggcgccgccgctgctggacgtggcggcgtggaccatgttctgcaacgggaggaagaccgggctcgcggtgcggcgggaggcgacggacgacgacctcgcggtgctggagacgctgcgccccgtctccatgggcgccggcgtgctccccgcctccaacaggtcgtcgtcgtcgtcgtctcagtcgccggagaagggggcggcggcggcggacgacgaggtggcctacatgcgcggctgcttcgaccacttcgtcggctcgcgcgactccgagtcgctctacatgatcgcgccccagggcggcggcaccggcccggagctcgccatcttcttcgtcaggctatgaccaccaccaccacctactcgccggctcgccggcgatgcaccgatcaatccatcgccaccgccatcgcgcgcgccatgcaaagcaagacgaagggcgcgtcgtgattcgtgcagccctcttgacggcctcgagattcgtgaggagcaggcgagccacctcgactccctacgtcagagatggcttagcttaaatttaatcatctgattaagcactaatcttgtgctcttagtgggtgattaggttgtgaggaggtcattgcataaatcgggtttaatggtggtgcccaacacctcattgcacacacaatctagtggagtacggagaaaattatattaattaattaagttgcttgcttttgctttcttctctctcgcgtttaattatcggatggtaattttgcataatttatttgtcagtgcaaagaatttgagaattacatataaactccattttggtttagattaactaaatttttgcaccaaaaaattgtacatatatatatatatgtcacatataatctctatctcttctctactattataaaaaattaaagatctttttgccgatattttgatacggcatccgtgtttgagtcggttcttaagttggttccttttagaaaaaaaatccgtgtttgagtcagattttaagttcgtttgcatttggaaataaaaaagagttgtataagaaatctcttttaaaaaaaatttgcatgctaacttgagatgaaagttggactcatgattgcagctcatgattttctaaaaaaaataatatccaagcgaattcccccagtgaatttcacactaagtgaactgtttctttacctctactattataaaatttgaaaatgtgtttgtcggtactttgatatgtcatccgtgtacgaatcaatttttaagttcattcgcttttggaaacacaaatacatattcgagtcggtttttaagttcgttcgcttttgaaaatacagaaggaatcgtataagaaatctctgtaaaaaactcatatgctaacttgaaatgatcggactcctaatagtagctcatgattttctaacaaaatatatatccagccgaatttaacaccgtaaatttcaccttaactaaaccatataacaacaataaaattaaaatagccttcacccgttgcaacgcacgagcatttttctataaaagataaaactgagaaaagctccatccgctcaaaacagaggaaaattgtatatatatgttgcataaaatataaatttgagaaatttggtaaaaaaaatctatatttttttacaggtccattaggtatttaggctaaaaattaacataattaaccaaaaattccacattttcctagccatgatccacggatactatatgttagttgagcaaataaaatgtactccatccatctcaaaatataaaagtatttttaaactttgacatggtcttcgagatactattttgaccaattatatctacaaaagttatatgttttaaataaaaaaattgcatattatgataatttgtttaataatatcaaaattacatgattaatctgttttattttttactattaatagtcaaaattttaaaaatttgacttgacgctattctaaaagtaattatattttaggagagatgtttaagccaaacgacatatttgtaaacgagaagtaatttgtgaataaaacttttatatatatattcttagcgacctaaaaacaaatgctacaaaataaacttcgatgagaaatcctcgaaatcagttaaaaatttaagattgaaaatttaaattttagctgataaacatatacataagaaaaatatggggcaatatggggccggtagtagtattgtgggtgtctaatcaatcaaatcgaaacgtctggatcgattcgtcattatggaggtagtgaaggtattaatcatgccacgtagacaaaaaaatgtgcaccaagtttggctccattgtcgaaaaaatatcaaaaataaatgtgcaccaagtttggctccattgtcgaaaaaatatcaaaaatccggcttcctttacacgcattaaagaatgcaattcgataccatgcatgtcttgtatacactgtttaatctgaactcaggaatacattcccaccgattcgaaatagtattatattcgattccaaactgaactgtgcaatttgaaattaattaataatccggataaaatttctacaccctatggtcaaaaccaaaagtacaattactataacgttaatattatctcttaaagtcaatgcaatactcattttagtcaaacatacatggcaccatcaaatttttgaaactttaagatatcaaatttagaaatactttgtatggaaacataaaacataaaaaaatatactacatccaactcaaatatatagttgacgtcctaaattatctatagttgaacttcaaaatgttatgtcgttaataatataaagttattatgatttaatatgtgaaaattaatattaataaatttatcatgaaaaattttgtccgagaagtgggaaccagggccaccggtctttgggcgcgcggggtgctgtgaggcccaccactcttagagtagggcaatcataaggacgcaggcagttgccccgaagtataggaaaagaataactagcccgagcaatgagccaaggccccgaggtcgatcttggggctggaggattgtcctagctacaccaccacaattaaggagatttgacccccacgttgcctctcggtgtcattctgcgctaatagcataatgatgtgtttcctgtggaaaaaacgtgggtgataggacgtggcatccttctcactcttgcccacaacggtcttgaaaaaggtaggggatagtgaatgtgctgctgggcgacgtgattgttgcttcacattgcccgctctgatttgttgtttgttttggcccccttcccagcatcagtagctgacatgtgggcccaatgatgatcaaagtgcaagcctcaatcatcctgcgccacggggtcggaagaaagggtaggcactcgcattggacaaggcttcaccagatggaccaacgcaagaccaaatgtgcccactccaatatgttgggcctcacctatgtttgtatgttttaagatatccctttgctattataaaaggaggaccaagccatcgaaaaaaggattcgaaatttagacaactcaagctcactctccaagaaccacaagaacaccctgcaagccaaatagctaagcaaaaatcatatcagtagggtattacgtttctgaacaatccaaagatgtatacatcgtttaatgttcattgtttccacacgtgattcttcgcactcgagctggaacacctataccctagcaaaaactccaaaaggagggtatctagccttcccactagaggagcccgtgctacgacatatatatttttatagttgtatttgtttaatattttttatgaatagttaaatatattgatagagcatatgtattggagattgtgccaacgtttaaaacgtaagtaggaaacaacgctaggtagtaacagtaaatgtagatttgtctttttaaaagatgatttcttatcctcgtgaacttagtaaaatttacaaacttattcagataaaaacaataataaaagctatattccaaagacccaaaaatatcaaatgccatgtattttcgaccgaatagtgaataaattaatattacgatatactatatacaaagaccgtgcgttggaatagagacgtgaaacagaatccactatagattgaggtgacaactatgtggggaatttatatattttctagatatatagcctttttagctgctggaaaccacagaagatgtgcttaaatatgcaaacaaatcttagtggaggtggttaattatatacttatatgctactgctatacattattgcgccagctggcccattatatatacgagctaggttgtgtggccattagattagcttagctagagtatatacttcaattaagctcgccatatatagctaagctagctagctccacagctgtgagagtgtgagctttctgctacagctagcttagctccggccgccggcgccgccgctcgccatggccaagctcgccgcgcagctcaaggacaagttctgcggcctcatcggccgcatcaccagctgtggccgcgccgcccacaaggacgccggtaagtatatatacttattgttaattctatcgcatcagattattttgtcgtgaattatttattttgttttttcgtgtttttaaaaatatgtttggttaaaaagttttttcttctgtatttgttgagatcccttgttgtaagctactatttgctaagtttatcttttctaaaagtatttaatttgtgtctaattattgtcgtgaattatttgtttggtgtttatgtgaatatgttttgctaaaaaaaacttttttcttatgtattgtttagatcccttgttgtaaggtactatttgttaagtttatctttttaaaaagtatttaatttgtgtctaatttaattatgtacataggaataattcatttcaatcgtcagctaaaattattataccatattcagtttgtcgtatgcttcaactcggccggggtaaaatttttacccgacgaagcgtgtgattactaattttgctatttactcggataattaattaattttgctgattgcatcatgtcttctttctttcagcagctggtgtaaaagagacccattcggcttcatctcaggtactctagctagctcgtttaatcacttagttacgatctcgatctgattaatttggtacgatcggttattgctgatttttccaagtttaactcggtcaattaattaagggcgattattttttcataatttacatatttttttagaaaataattgctgtttccgttggtcatttgcgcagcacacagagataaggtcaaggggacttccaccgtctgtgtcaggagggtccaagccccataccaattaacagcgacaaattaccattgatcaaaatcgatagatctctctgcttaataattaatcaacgtctactcgttctaatactgtgtggtaatgcacaattcattgtgcaatagctatatgaagcttttcttcttctactatctgtttgctgtattttgagaattttggtgttgaccagttcacaggtgtggtcttcagactaaattaacttgcgaactcggggcttattcggttaatccctttaccatgtgtgaaattaaccgagcaagttaatttacaccggggattttaccggggttaacccccggctacgaaatgtatacatgtatgtgtgtatgtttagtggggttgtacagaaaacggctggttgcctaagccctccaatctcttccttaattagcatcatatatagcatgtgtgtgcatcataataagtgtggtggagttgtatgtgccatgctgtttagataatgaaaacaataagtgtattgctattttatttttttttcggtgtaagctagctctttggtaaaatgtttttttagcagttaattttgtaagagtctcatgtccccatcgttggcttatttcctaataagccaaaacggcttattaggaaataaaaataaatttgtaggtgaaacttttataaatgtgcttttttacttaaaagccaatgttgaaaaagaaactacgttgaaaatatctcaaaatcaatctcaaaattaagcttaaaaatttaaaatttggctttttctttggctgattaggccatccgatgggagcctcaccgttaaataattgagattatgaattattgtgaataaaaattttgcaatgtgactagctgtctacctccttgtgcattgagaaaatatccaagccattcctgaaataaatttggcacatggaaagacggaaaggtcttgaatgtaacgaagaggaaactaggaagcacatgcaacatttgtgaatctctgcaggttttcgatgtgagaggagtttattttgccttctcaaattacaactttctccgtttctttttcctcctcttaattattaacctcatcccacttttcccaaatataatattgaatgagtagataaaacctagcggaatggatgtggacaaacctctctgtccagattcattatactaggtaggataacatcaagtcatatttgttattattcagattctttgtactaggtgatttaatcttagttactatatattgggacggatgaaagtagtattctcttttatgagtaaaatgcattggcggtccttaatcttgtagggttgtgtcatataggtccctaaactctcaaaatgcatattcaggtcccagaacttgttaaagtatatcatctagttcccaaatcgacacatctcctctacgatcctacgtggcgctgatgtagcatgtcacatggacgtga

SEQ ID NO: 71647 - DNA, 9599 bp, Oryza sativa
cgacaccgccgaggccgccgccgccgcctacgacgacgcctgcctccgcctccgcggccccggcgccgccctcaacctcccctcccgccgctgcgtcgctcccgctccgcctccaccgcctcctccgccgccgccgacggccgaggagaagaagctgctgctgttcccgccgccgctgcctccgaggaagaaggcgatgctattcccgctgccgctgccgccgaggaagaagccgctgctgtacccgccgccgctgccgccgaagaagaagccgctaccaccaccatcaccaccgccacagccgccgctgccggagaaggagaacaccccgctcccgccgctgctgctgcctccaaagaagaagccgcttccgccgccgtcaccgacagcggcagcgaaggaggagcccatcgagctcgagcatgcggcgccgccgccgcctttcgtgccccggccggtgtggcccctcctggccagcggcggcggcgggaagcggaagaagcagtcgggctgcggcggccgcatccccgccctcaacaccgccgccgccgccgtcgaggagaccggccgcgcctgatcctcctccccggcgacatggatgccaccaaaaaaaaactaaaaaaaataaaaaaaaacaaataacaccaaccatcctaatgtgaaaagcttagtggatcattccttttgatgtgattcgatgatgctgttaatctaaatctgatctgatgcgattatcttctttttttattttttgtacatacatatgctttgcttctcctgcattaggatcttgggagaaactcaaaaactgatctgtaatattttctgtaatatcatctcgtctcatgtagttgtgacattgtggtgttgacattgtaacgaatcggtcgattcgaagagaacttgtggaaaaagaatcgagtcaagattgattcaaagcctggtttcgtttcgtttcttggatgttgtcaaaaagctttggttctgtttgaagtgcttctataatcttcagctgtcaagcttctctaaacaatttagattttcgctcggtttatgagaagctgctcggtttttaagaaactgtagttgtaaaatctttagtttctctatattttatccgttatttcttagaattttagttgtagaaggtcgttcagattttcgcccggtttataagaagctacttaatttctgagaagctgtagttgtaaaatttttagcttctctatattttacttgttgtttcttagaattttagttgtagaatcttcagcttctctttcttattagttgttttttaaaattttaaactcctcaaccaaggtcatagactcatctggtttgcttggtagagggtaaaaaagagactagttttttaaggatgagttggatgctgtcatcctggcgttcctgtggctgtggtccaagccgttggatttggggcgtgtggttgagatgagatgagatgagatgaccgcagcaagattattatcttccttttcttctgtttgtttagtgcgtgtgcacgtgcattcttcttgcttttctgctactgctgctgatgtctgccagcagcaggagtgagtatcttgacatcgagtttttgcagtcgcaggttggtcatatggattgcaggtgtaaaaaagaaaaaaaatacatgggagattgcttcttttagtactagtcgtgtgatggagaaacaaaaataaaagcttactttctttttcgatccgttgtgttcagcagtagtttatttttatgtgtgacttggaaatatctcatgtttgttggctacggtctgcaccactgtttctgtatagctgaatacatccatgtatgtggttgtgctagtattggaaaaatcttggagagtaggataaatacttgtccaccctgacgaaatcagaaattgtcgagacttatgactcgagtaggactcaactggtgagatattaatttttttaacacattacatagtggtttatgaagatttaaatataattatggaggcaaacctagagcttaagttcaagctgattttggattacctacgcccctgcttgtttatggctgcaaatgttggaaacatcttagaggatgattttttttttaaaaaaaacaaattaccattaggttgatttagatttagggagtaggagatatggtgataccatggtctcaccactattaccaccttattttcttttcatggataaagaaagcgtgattgtattgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctaaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgatgtccacggcgctgcgacaggagaagacgcgcatgaccgcacgcatcttctcctgcatccagtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgaaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtattgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccattggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcaagtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttatagggggaggcaaaaatcgccctcccccagggcggcaagggggccgcctgcaaaattccatgccccctcgccgcccat

SEQ ID NO: 71648 - DNA, 14542 bp, Oryza sativa
atctagcatgaaagaggggttatatactacacaaaaacataaacagcacccaccatgaaacattaggattattctttaaacttctaacatcaaggggcggtgttaaaaaaaaacatcagctgggatggagaatcctagtgtgactgatgtcatcgattgtacaaagcagcttatgcaaattaccatattgaacgacctgaaacttcttacatatgctgcgcacaagaaatactcacagcattgttctgtaataattcgagttcattaaccggtaccaattttgatgcaaagagagctatggacattctccttaccataaccaggccttacaatttaagatggaaactgaaaaggcctgaggtaacaatatgagaaactgcaaagctgttaaggctagtgtgtttagataacagtgttaatatttccatatttctttgccctaactactataaacagttaatgtgctgtttctcacaaattttaactccaaaactataccataaaaattactctctttacacacacacacacaaaaaaaaaactccctctgaagcaatcatgtgcacaaaccatgcaagtattgggataattgtggcatcagagaacaagataaatgaactaagcagttgaaaagaaacacatcagaggctacaaagctgaatgaaaataaagggtgcaccagaaggaaagagtcatatatatttttctaaaaaaatcgttttcaacagcagtccaccagatgaacaaaacattaacatatcatagtcacaacaacatcaagaagttcaaataacaatatcaaccaggtttataggccttatatgttgggatcctcgtattatatttgccaccaattacactcagaagtcagaaaaaaaatatgtactcttggaaatgtgagcattccatttttttcaccttttaaactgaagaggataaagggccgttgagacatattattaatgcaggatataaatgttcaatcatatcctaccatttccctttcaataaaatggataaactgcacgatgcaacttacgctacaaacaaaacaagatacatatagcttgccctggacataaaagggaactatccgtaggtcaatcaagtgatcaatggacactgaatattagacagtacagaacacagatagaacaaatttgagatgcgccaaacttaaaatatctcacagtatgaaggaataagaaaggggcagcctgtcattatgcaactttgacgcggcacagcttgtcgctacgccagttttggcgccgcagcgattcactgcccagcacttgctgggcaaggttccaaccaatggaagcactttaaattcagccaattagtgcagagacatgctcaaaagaaataagatggaaatgaccaggctcaaaccaacttaataaacaaagaatcaatcaggtagacataacaatatagcatcctttccgaagcatattcaaccttgttcactgatttaacaataatgatgataatagaactggtgacataaacagaataagaatctattctgcatgcaaatgaccaaaggatagaaggtatgcatcacccaagggtttcacatgtatcaatttttaatttaattgagaaacgttgatcatcgcagtactgttaaggatatccagaggaaagaaaggacccagtgattgatcaggggatgagattaaaccatttatcactactatgttattacttgcactaagagagtctttttttttctaaatttttctaaactagttcatctagttcacgctactaccagtctaccagcattctggtaggtaggtacataagagaaaaaaaatatgagcaaatttggcgactcaagaacaaaaattcatccagtactcaggaacaaaagttttgtgcaccgagcaaattttctttgagaacttcgttcttcatttcttttctctctcttggctgctctaactaaactagatgaagcaaattacgaagaacagaaggatacctaaaacaaccagtatgaaaggagttaggagaaaggatttacaccgcaggtagggtctgtgcatggcaccggtgaaaccccgacatggtcaggaatccgttaatcccgatctccccatcctaattgcttgctcgttattcccctcatcagattttctgcaaccagcatacctggtacctcgcgctgacatccaggcattgcacgtttgcgagcatggcagtcgaaattgatgtggctcatttgacatcctcgtcattggggttggggttgaggttgggcgtgtcgtcgtccttgtgaaccatctcccagaagaaatcggtgagcacagtctcgtatccgggcatcttggcatagccggggaagtagttgatgtcaatgacgaggtagcgatccccagcgcgggcgtcccggatcatgtcgaagttgaagaggtggaggccgagggcgcggcggagggcggcggcgatgtcgttgatgaaggcggtgggtggcatgatggcgtcctcgaggcgcatgtcgtcgtagtactcctgggcggtgcgctcgttggggaggttggagacctgggagaaggagagggagccctcggcggaggcgtcctggaggacgtcgctggagacgtcggggaggctgcggcgcttgacgcaggtgacgtgggcgccgacgacgtataccttgaagatgacgccgccgtggttgacgaactcctggaggacgagcggggggcggagcttgcggaggccctcgcggtggtagacgagggacatcttgtgggacttggcggtgccgtcggcgacgaggggcttggcgatgagggggaagcggagggcggcgaagaggccggagtcggagagggcggcggcgtcgtagacgacgacctgggaggggatgcccaaggtgtggtggtggtgggcgtggagcgggacgtcgagctcggagacgacctggagcatggagatgcggttgtggaggcggtcgatggcgtggggcgggtcgacgacggggacggctgggtgcgcggcggagaaggcgtccagctgaccgcgccactcctcgccgtagagcttgtggatgaggaggtggaagggcccctgctcggggaggggccgcgaggggtcgacggggacgaggtccatgccgcgccccgccgcgcgcgacaccagcgacggctggatgaagctctgctgcttcttcggcgccagggcgtagccgatgaggtagcgccgccgctgcccgtcgccggggaggggctcgtcgccggccatcgattcggttgagttgggttgggttgggttggttttgcttcgaatcgaatcaagcggaagcggctctctctcctccctcctcctcgcccacgcgatttcctttgttttttctttttttttctttcttttattttatcagaagagacgagacagataaaaagaaggtgggagtgggagagggggggctctcttctcctcgctttttgcttccatatgaaccaggttcctcgtggccttcccgtacacttcactgcaccactcttgtcacgtcacttatactagtagtacattttacaattatatatactactacatcatccctaaccatgtactgtatggcgttgattagttcatttttacatttgtagagagcactaccttatccatctacagatactagtactatctactggcatccttcgtatcaaattaacgtagttgcaaatgaaataatggatgagatttgccttcacaaaatactccctccatattttaatattttaatatatgacgcgttgacttttcgatcaacgtttgactattcgtttcattcaaattttttgtgtaaatataaaaatatttatgtcatactcaaagaacatttgatgacgaatcaagtcataataaaataaatgataattacataaattttttgaataagacgattggtcaaatgttggataaaaaatcaacgacgtcatagaggtagtacgtaatatagctcgagtgtcttcatcttataaaccttgaaccgcaatatatatctaacaaccattatttttaggtttagccgtaaccgttgtttttctttatttgtgcaggcatgcatactcctacacaaattttgccttaattttgtatcgtccatcccttcctcatctttggctattaccgacagcaccaccgccgttaagcctctagatctcaccttaatctccctctaaactcaccctctttatctaaccctcattttgtcccttctcaaccaaagatctaaatcaggaggggtcaccaccacattctctccatcagatattgctggagtcagaaggaagaaacatatagcataatcttgattcgaattggatagtagaaaatgtataagaactctcttttgattttttctatcgaacgagagtcagcaaataaagaagcaatgtttttatctagcataataatatgatccaatatattaaactttatcttgaaatgggtcatttttgtaatcttatgtgttttatcgtaattttatcttatctatggatatcattttctaggaggggcatagtgttccgttgtagctcctttagatcttgtttgtttgtttaattcttaatatggagggattcgagggtcgggattgagaaaaataatttaacaccataatagatataatagatatggaataaattttctttaaattttttcgtgagagggattaatcaaacaagtccttaaaacgcttctccctaatttggtaaatcttcgttgatacatttgattacatttttggatcacaatagcacgtaagcagaaaccatgtatatatgtgaggtcatagaggtggattgatgtgaatagaaagaaagaaaagcattaagaggaacattttgacgtaggttgaacatgtcatcacattagaaatttagtgcaataatataggtaagaaaagaagaacaaaagaaaaaagtcaaataaacagtactgggcctcgccgcaagtgagagattagttaatgacaaggtttgctagtaagaagggtgtaggggatgacacgatagtgagatgattaattagtagtagaaggttgaaggaggacgtgttgttagctagtgttaagagtggtgattagtcaactatagtcagtgaatctcacctggaggtgtttgttattgtgtggacatggtccatgagatccatgcatgcatggtataagtggcaccgcacctgatacggtttagaaggtataagtgctgtaatattcgtgttagcgctaggaccccgagcaaaattccgcggggatacaagaggtgccatgtgatgctatagaagttttttgtccgtctaggtccccgttcgaatacactaaaaattttggataaaaatggcacgcttttcaaactgataaatggtgtttcgtgcgaaaattttatatatgaaagttgttctaaaatatctgattaatctatttttcaagtttgtaataattaaaactcaattaatcacacattattaccacctcgttttacgtgaagcacttaatctttatctttatcttcatctcctccaaggagtcacgacacttaagcaaggggaggtgttagtatatgttgtgcgtggaatgtggatgtggtccatgagaagaaaggacccaccccgagcacatacatcatcggagcggagaatggtgatgaaagagaaattggacattctaccgctaccaaaagagggtttcgctataatgccattccgccgatttgatttgataaaatgccacccccaagcgatgcgaagcatttgttttgccatattcgccatttcattccattttcaccattttttgcacccgggctgaccaaaatacccctttaggtggcttcttctagctcaacccttctctctccttggccactcgtcgagctgaggaagcggccatgagaggtggatgcggcggcggagctcgatccggcgtcggtggtgccggccgcagcctccgtctcagggctctcgaagaggcagcccatacggcaaaggcgggcgcgatggtcacggtggacgagaggcagcggaggccgaagcaccatcggatgcggcggtggtgactgcggcgcttgagctggaaccccatggccaacgcggcggacgccatagtggcgggcgggtgtgttggggccgaggtgggcacgacggctgtgaggcgacaacaccacccttcgttgcagcggtagaaggggaggtggtgaccctaccgccagcggtggcatcgaggccgtgccggacgtaccggatgaggccgttgtccgtcatgctactcccctaccgccactggacgcgcatggatcccctttctagagctcgatgagtggccaaaagagaagagctgagctagaagaaagggtattttggtcaacccaggtgcaaaaattggtggaaatggagtaaaatggtgaatatggcaaaacaaatgcttggttgggggtagcattttaacgaatacaatcggcaaaatagcgaaactctctcttttggtagtggcagaatgtccaatttcttgtgatgaaatgagtgcgagggacacgactgttgtagaacggctacgtcaacggatcgcccagatccgctcccttccctcccacagaagatggggcgcgagaagatgtagaatcccgtatcccttcccaaacaatcataccataggagacaatggacacaggatataggggtggagctctctctttattaatcaatgattgtgtgtacaatgatgggcacccctgcccctctatttataggtagagggagtcttagagataagaacggttttatctctaaaaccgattcggattggtccacaagttagaatcttatctccccatggagataatattcgtaacactcccccttggacctatccacgaccaacttatgcctcgtcaaaactcctaccaaaaccctgtgggaaaaaggctaggagaaagagtacacagttgtcgccatgcatcacacaccgttgcctcattaaaaacctttgtgaggatcgcaagctccactcaactaaggaaaagagtacaacgttgtgaactcacctgtccactaactaggccaaattcaggggtttctctccccctaaaccctgcaagtctctaagtcttctcatcccaatgtctctaacgaatttttggaaagtacatgctgggagagacttagtaaacaaatctgccaaattgtcacatgacttggattgcaggatcttcacctcaccttgcttctgaagctcatgagaatagaagaatttaggagcaatatgcttcgtcatattgttcttaacatagcctagttgcatctgtgcgacacatgctgcattatcttcatagataatcgtgggggcattggagatactcaaaccacaagaccgttcaatatggtgagtcatccttctaagccatgcacactcacgtgtggcttcatatagtgcaatgatctctgagtggtttgtagacgtcgctaccaaggtctgtttactagaccgccacgaaatggctgtaccaccacagagaaatacaaaaccagtttgagatcgggcattatggggatcagacagatatcctgcatctgcatagcccaccatggttaagtctcgttgccttggaaagaagaggccgagatcttgcgtaccctggaggtacctgagtactgtcttaacgccaacccaatgtcttcttgtaggagacacactgtatcttgctagaagatttaccacgaacgcaatatcaggcctggtgcagttcgcaaggtacatcagtgctccaatggcgcttaagtatgggatttccggtcccaactcttcctcagtttcactcctaggacggaataggtctttatccttatcaagggatctcacaaccatgggtgtcttcaaaggatgagcctttgacatgttaaatctctcaaggacctttttagtataggtcgactggtgcactaaaatcccattagggagatgctcgacctgaaggaccaagcagaacttggtttgacccaagtctttcatctcaaactccgtcttgagataggcagtcgcctcctcaatgtcctctacgtggtcaatgatgttcaaatcatcaacatagactgagatgatacagaaatcactctgtgactttctgatgaacatgcagggacaatcctcactattgacatatcctttccccaaaaggaagtcactcagtcggttgtaccgcatacgaccagactgttttaacccatacagcgatctttctaatttcacactgtacatgttgcgatttgctttgtccgggaccttcaacccgtcagggactcgcatgtgaatctccatccaacgatccgtacagatatgcggtcaccacatccatcaactgcattttcaattccatgccagctgccatagacattaagtatcagaacgttatgccactcatcactggggagtaagtttcatcataatcgatgccgggtctctacgtgaacccttgtgctacaagcctcgctttatatctcaccacctcattgttttcgttctgcttctggacgaaaacccacttgtacccaacagggtgcacagtggggggtgtcaggcttaccggcccgaagacacgcctcttagcaagcgagcgtaattatgtctcaatcgcttctttccatttgacccaatctgagcgctttctgcactctgccatggacttaggttcaagatcatgatccactatttcagcgatcttggagacaaaatttatgtcgacatgtgtagtcttccgattatacaattctcccgtgatggcataatctgtggcaatttcttcactcatttcctcatcctggtttcccaaaacaggagagggttccgatgcaccagttggactaggtgcgcatgctagtctactgggcgttttgtcgttttggcgtccgtccccaggatggatctcctttgagactactgaatgggagcgtgatgcgagcggtactgtgttcagctcttgcggacgtctccgcttagcatgaatcagaccatccgggtctctcccccttttcctaggcttaggggctggagtaaagtctccctccatgggtatctctactctctccggtgcatttgccgcagggatatgcaactttgacactcctcttagatcagtaaaagcatctggtagatcattagctaagttctgaaggtgtatgatacgttgaacttcttgttcagcatctggcgaacgcgggtcaagagtatggatactacttgagttccattctatttcacggcattccttagagtcgaggtactttcctccccctaatgccggaaaatgctcttcatcaaagatgcaatcagcgtaccgagccgtaaacagatccccaattttaggctccaagtagtagattatggacggagactcataacccacatagacccccaccttacggtgcggtcccattgctgtacgctggggtggtgagatcggcacatacacagcacaactgaactttcgcagatgggaaaccaccggctcttgaccacgcgccagttgacggggtgaagcagagtgatatgcagacggtctatactggattagctttgcagcatgcaatactgcatggccccaacacgtagtgggtaaattgctaccctgcagcaacggtctagcaattaatttgatccttttaatcagtgactcagcaagtccattctgagtgtgaacatggggaactgaatgctctacattaatgcccaaggccatacaatagtcattgaatgcctttgatgtgaattcacccgcattatccatccaaatcgttttaatgcggttctcggggaactcggcacacagacggatgatctgtgcgatgaatttggcaaaagcgtgattcctcgtagacaacaagcatacatggctccaccttgtagaagcatctatcaacaccatgaaatatctgaatggccctgaccaagggttaataggcccacagatatccccttgaattctatccaagaacctcgaaggagggtcgaatgatcagctttcccgttgcacaagcgggacacacgaactccttagggaagtttttagtgtttatgctatgacctagtgagcttgtgactattttccgcatcatagtcaatccaggatgacctaatctctcatgccagattctgaaagactttgggttcttaaagatggtctgcatcgcaatgtattcatatgggggttttatcttagtgtagtacagtccatcgaagctccctggcattttctcaaccaccgtggtctcatcgccctcagacgatgtcatgaagagaaatttttctcctccttcacgggttgtggcaaggtggtaaccgcagcgacgaatatccttaaaggtaaggagtgtgcgttcagcacttgggtataggaatgcttcttcaatgaagatccttgtacccatagggaggacgactgtggctttccctgagccaactatgagaccattactcccagcaatggtgaggatgttctcatccctcttacgcagtgtcgtgaagtacttagtctcccgtagtatcgtgtgcgttgccgtgctatcaaccaagcacgtctcaggctccattggattgtactacgcttgttctatatgagagattgcattgtttcaagttaattgaaagaatgaaaagcaagaacatagaacaagacaaaggccaaacataactcaacgggaaaactttattaatgcaaaggaccatcctaaacacactgaccaggatgctttgctaaagcatcattattacatagatgactcaatgttctgaaaaataaatcacactgactcagtatgatgagctaaatcatactaacacatgatagcctagacttaagacacatatttgataacttgggaactactgcatgtccccatgtatgtcctcattcatgaggtcatcggtctcgccgtccccgtcgaattccccgaggtcaatatcgtcatccccaaggctgttatcagctgcagcagcagtcttgggatcaacctccatgggagcatcagcaggaggggtatcagttccagtcactttaacaaagtgattttccggcccctgcttcttcttccaatcctggtacatctcaatgaggtgaggttctgtgttgcaattgcgtgcccaatgcttctttgagccacaatggtagcaaccctcaccgccctgttgggatcctccactagcatcgtcagcagcgccactcgccgggttgcccttgcgacccttgcgactgcggggcttcttgcccctcttgacgaccctcttgaagtgtcttccattaggtagtgtgcggctaccggatcccttccccttggaggaaccttgtccagagttgttacccttctaatgaacaacgtgagcctctggaataggctgtgaaccaacataacgattgttgaagttggtcatcagaagtttactgtggacttcagcgtttaacaacgactgaatgagcttggagtacttagtgtacttagcctcacggtactgctcctgcatcatggaattcttggggtggaatgtgtcaagagtcttttcaatcatgtcttcgtctgtcacaacttggttacagaaacgaagtttgctgacgatgcgatgcacggcactgttgtagctttccacggtcttgaaatcacagaaccgaagctgagcccattctgctctagccttcgggagaatagcagtcttctccgcggtgtaccgttctctcagggcctccaacagcaggagaggcccacgcagctcgaggtactcaaccttgaggtcctcgtgaatgtgcttcctgatgaacgcaagtgcctttgcccgcttcggcatgggaagcggggcaacaccggctccttgtcgtcggatggattctgacagttccatcgcggtaaggttgatttcacagtccatggaccaggtctggtagttcccaccgttaacggtgaggatggggaactctttcttggcgtaatccgcatcagacatggcctgtttaacatgcaaaaaatcaacgccgggttaacttgcatgaaaacaaagtcacagaacaaagtagcatagtcatatgtaattactggtattttcccggagtttgtcttgcatttgttgattttctgtgattattattggccttatggcatttaatatcaagaattatgcccacagaaaacattacatatgcaagaaaataaacccaaataatgcttccggggaggggtcacttacactaggtgagcacaattttatggaagcattaatctagaaaccttatctagattttagttggagttgcatcagagttaaaagcaattaaattgcttaaaaacaccattacatggttgttaacgagtccagggactcacatgcaaaaaaaccaactagaacaaggcctaaactacaaagttgtagcctatgtacacaaagggaaaaaaatagggtccaaaaagtaaaaaaatactttcaacagtgaactttaggcgtaaaatcaaccatcccgaagggatttatacgcaaattttcagtagattagaataaccgggccgaaacgccgttcggtctacggtcttattgggtcggtttttaccgtagcggcccaaatatcctattggaccgaatgctacactctaggtccattagaatttctaatttactatttttagattcctttgtgtgggctgtctcgatctgatgggccattgcggttggtccgaggagagagcaggccggcccagccggcccaatgaggaaccgcaagaggaggggggtgagaggggattagggtttcccctctcccaccggcacctgtcacccagcaagccggccggagaggcacggtggcggcgacggaaggcgccgactgtcagtgtcggaggggattgaggcggcgcacggcgaggactccggccgacgacccatcttcgcccggcggcaagacggcgacggcggtgtcgctcccgagcggcgttcggtgcggcggtggttcggcgacgtccggcggagctccgccacgacccacacgtccagaagacggcggcggagcgtgctcgacgtcgacggccaaaacaccagcgacgacaaccgatcgcgtccggccatggcgtcccgacggaagctaatccgaagtcggcggccggtcgtcccatcctcctcccaccacggctcagggcgcgtcggcaagaggttgacggcggcggctgcccgtcctcggcattaggtcctgcggcggcggcgacatggggtgttggtctgcctcgtcgtaggcggtttcccgcaacggcgccgacgcgagggtcggtggcgttccatcagcgacggcgagcggcggccacccggcgcggcaccaaaacccatcgacgtgggtggtccggcggcggctcgcgtgctcccggcatggctccggcgaggtagatggctgagagagagagaaaaattgagggatgcggggggatttgggggcgtacgcgaggacgaccggttcggcccagccgaaccgggttcggtcccaaaacaggcatccggtcaattttccaattagaacacacggttttcttccggttttcatcataaagcaatagatgcaaatagatctaaaacatgaaattaatctactgctagatcatgtgcatgaaaaaccaatctactgctattattgcatcaaaaacatgatgaaaggcaagaaaacctaatcaatctactaattgcaaccaacaatttttaccgtagattgatcggcgcagtgggactcgaagcagtggcaagtcgattgcggtgacgagttagcagatcttgtcgtagcaacccgtcaacgtcagcccagtggtagagctgctgataacgtgttgtgaacggctacgacaacggatcgcccagatccgctcccttccctcccgcagaagatggggcgtgagaagatgtagaatcccgtatcccttcctaaacaatcactccacaggagacaatagacacaggatataggggtggagctctctctttattaattaatgattgtgtgtacaatgatgggcacccctgcccctctgataagaacggtattatctctaaatccgattcggatgttaaatctttatctccccatggagataatattcgtaacaacgacaacgcgtgcgtgagcgtggatctgtgcggtcgccaaccccgtccaggtgtcaatggaaggagaggacaggcgacacccgtgcgaccaacaccatggatccaacagtaggagtcatacatgggccgggctggaaggattaagggaagaggatgcacggcccataatggtcaacatgaacctcgttccgatccaggacgacgcctgggccgagtgtgtggcctgccctcacgtaagcccaacataaattcttgctcgatcgaaccaacaacttgaaagagtatgctgaatatggaattttttttatttataatttttcttattaaaagttttacaaaaataattttccattttgaaaattgacggaaatagtcgcctaccgccctctgggagggcgatttttaaaa

SEQ ID NO: 71649 - DNA, 9787 bp, Oryza sativa
aagggggggcatgaaaatttgcagggggcccccttgccgccctccgcgagggcgattttgcactgtgcggggggccgtctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaagaaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtaccagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcgtataatgagcaagcggaggacgacgcatcatccgatgaggaaggtgatgtaatggccactgatttgggcaaatgaggacttctctggtcttgttatatcagagggtgatcatgtaccctgggagtataaggagtacgaggtaattgagggtgccaggtatgctcataaggatgagatgaagaaggcggtgaagcattggcaagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctgagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgagtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttcttttttttccttcacataacatgtctaattccgatcatgtttattgcagcgtcgttacgctcacgtccaggtgagacgtggttacccggacttcgtgttcgagtttgaccgtctccagccgagcgacgtcatctaggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgatgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgcctaaaaaataataaaattgtattttaccaatcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcctgaatatgctgtgttgtgcgatggatgatctcactcacaccaatgtcccaacggatggatgtattaatggatggacatggaaatagaaaacaaaagttgtattgtaggagtatacaatacaatacaattaggaaggaatacatcctggcagtgaggagggagatgaaatgaaactagcttgaaagaggtagtagtagctagcatttgactcgagtataattaattagcagagtgaatttattatgaggtgttacataaagaagcaacaagtctggttatccatgtgcaaagtgtggtacggtgtggatgaatcatccagccgtccgtccgcacttgaactgagctgctctgctctgctcggcggcctgatttgcatcttccaaattgctcgatctgctcgccgccgcgcgccctggcttgcactgcagttgaattgatctctggtgttcatcagtgtgtgtattgacgatggatgtagccaacgatccatcatcaagaaggcgctagctactggagtatgtacagaagaagcaaactgatggagcaaggatcgatgtgctagtaattaatttgtacaagcgcaggcaggcaggcaggcacaccaggatggatcgtgtctcgatctgcctttgacaaaagcaagctctcatatgtacacaagcaaaggcaaacgccgggttgggttagcaggacgccggcaccagcggcggtttcatctcatcctctgcttcgtcgtcttcatcctcttccgcgtcccacaggaaactcgcgtacgatccaagcacgtagctgcacgcacgcacgcacgcatcaaatccaaccgtttcgttaattgtttgattctctgtctttaatcaatcaatcagcaaatttagtagtaataattagtaccagtcatcgggcgcggcctggacggcgcgctccaggtaggcggcggcgcggtccttgtcctgactcgtctcccacagcagctggccgtagaggctgagcaggtcgccgtcgtcgggggaggccagcagcgccctggcgtagcactcctccgcgccgcccaggtcgccctccacctcctgcaggtacctcccgtagttgcgcagcaccagcgggttctccggctccaccctcagaacccgccggtagtactcccccatgtccatgtgcccgccgccgcctccgccgcgcccggacgtcttgtcgtcgtcgtcgttgcccttgccgcgcccggcgccgtccaccaccacgaccacgtcctcctccaggatgtcgcggaggaggaggggcagcggcgatgatgccgtcgcgggcgcggatctggcgatgtcggcgtcggaggtggcgcggcggaggctctgctgctgctgctgatgatgatgatgcatgctgcgcggggagacgcacaaggctgtgggggagcgccggaggcgtgggaagagggaggcggagcgcgtcacccgtgtgccggtggcttccatggatggatttggatctacttacttgtcgatcgctgaggctgagcttgagcttgagctcgccgccggggtgagtgagttttatagaggagaagaagcaggtgacggcgagattgacggcgtgaggcagtcggctgggggagcacgtgaagcggccgtcccgtagtacacgcggccgtcccatgccctcggttttgttggcctccgctgctggtttctttctactccacactggagtaccacctttctccaagtctccatccagccaaatgcacttgctgctgctgctgcttgtaatcactgcatctagccaattgtatgtaatgtatttctttccttgtttttttcttgtttcttgctaatgaaataattcatcctctccgtggacgcataaactttaacagttttatgtttttttctttttggttaaaaatacaaagacatatactatatagttatacattttaatggatatatctaacacggtctcataacatattaattggagtattaaaacatgttactcccatccttcttcaatagtaatagacattttgaccgtacgtaacatgtcatgtggaacaatgcaacaatttagctcaaaatttaggatcaatttgcccttgtcaattgttaggcaattcaattaatgaactaaataaagtggaggtgcaggaaagggctgaaccaaaatataagtatggggcaaaattgcaatttttattaatgaaagcatgttcacgataagtatatattttgaaacaattaattaatggtctggttaaattgtcaattattcacaacgaaggagttataaataggatatatatatacacacacacacacagatatcacttgggtatatacatttgctc

SEQ ID NO: 71650 - DNA, 10316 bp, Oryza sativa
tgatgttacatgaaggaaatgatatttctatgaactatgggcattgaggaactacttaaattggaataagtcaagcagcatttacttgataaaaaggttgattcggtcctttggacaagttttccacatttgctgtctccatccatgacttggattcacagcacacatgatccatgccacaaatcacagctctatatccttcagcaggtgatgtaaaattaagaagataaactaaagcatgttcactgaagtttaatatttgatacaaagtgtgctttaacacatgcaaatgttacatttaaggataatgacaattatgaaaaattaacttcttatataaagtttgaaaagaaatttgtagtagttatccattttctggatagcttcagaaataatgtgtaaacaataatacgaagtgggtagtatagcagtagtactcaccgtgtaccttatggcgtactttctgccctagtcgaaatgcatatttcacattttgatatgcaagggccttagcggagactgccagagactctgtctacatgatgtttgaagttaatatgttatttacacattaccatcacatggccggtgcactacagttttgctgtacctcaagtttagcaatttcatcacgcagtgcagctgccaaagcatagttttcactgtcaacggccttttgcaaatccgcactgaaacaaatggataaagctaagtgacctctcaaatgaaccaatgctacataacactagaacgtcatggagaaatggaaactattaacataccgcacgcgtaaaaggtttatagctttgtcctgagcttcagtctttgatgagcctcttttagcttcacgttgcctaattatcactgtttcaatctagaggaggatattttctttagcaagtctcatacaatgaattcatttatcttcaagtgaagtcatttggtacctctgtgagtttttccctcaattgttttgccacatcaaattgctctatattcaatgcatactagtaagaaccaagaaattcaatagttaggctggacgtgcataggtaagtatcaaacagttgcatgaaccagtgactagcaactaagaatgatgcaatgatcatgatagtagatttagttagccgattgctactagtctagggaattgatccgtgaaaaaagaatagctgccggctggattggtaactttattcgctttagaaaatgatggtaaggaagcaacaactcacctgtatccgggtttgtaggtccaattggaagtagaagattaagatgtcttcgttagcagactcactgcgttccatccttgcattactactgctacggccatctcctccaaatagccatctagcattagttctcaccgtagtacccatttgccttctattggtcctcatatgtagttttttcacacaccaacgccacgagtacgctccacaggttactgaatttattttgtaaaacagcctcagatcatccactgcaagacaagctggtctaaagcatgatccatgggccgaggaaattgaaccacatgcaaaaatgccttgcattgtattagtctgagacttgaccagttcaattcccacaactgatgcagtccaatcaccacactgacagttgcaatcagcaagtcagtgggatccccaactgcgcagagatcaagaacattttgcttaaaactagtacaaaatgcactgggtaactgagaaaggctttgaattgtggcatctaaatgattacaaactactattaactaacaaactaacaagcagtgcttggaatcctaccatatcgtaaatgtgcaataaacattttactatcttctttttttgttcgtagatactgatcaatctattttgaattattaaaggtaaatcgcacctaacgtgatccaggcaagtaggcaaagaaaccatcaaactctttggaaataataaagtgctagtacacaccagtgcgtttcgtttcgagtaatatctatcagtgctctctattatcacgcaaaaaaaaaactcaaaaactaatgggttatacgggagaggtaaggggttttgcccgcaacagataaaatgctagaaaaagctacgaaaccaatcaaaggagccacagttcatcaccaacggaagaaacgaaaccaatccaagtcatttcagaaagaagaaatcactcaagtcctaatgggactccgggctacgccgaagaaacgaaaccaatccaaatcatttcagaaagaagaaatcactctcaagtcctaatgggactccgcgctacgccggccatgtagcgagcgtggcgcgcgcttcggtggaaggaggagtccgggaagcgtcgacgagaggcaaaggaggaaggaggaaggggccacgctcttctcggccataactaccactggctcaagtgtggcggtcgtcgacgcgataccggatagaatgtgtaacgcctggatcaggtgcagtcgttgcatcgactgcaggttaagcagttggggtgaaactagaccgtccaagaaccaacgaacgtctaggattctctaacctcgccttctcctcccgttcccttcaggtgaaggatttagttacaactaaggaaaaaaaaatgggacttttaactatttgccactcttacgagtggtgcttaacaatttgccactaggcccacatgtcatagacaaatgagagcccacatgtcatagacagcgagtggcaaatcattaattgccatatcccaaaagtggcaaatagttaaatttcccaaaaaaaatatccgtgcattgcaacagataaaaatgtttcatagtgataccaccgtaattaggaatcaagtaatgaattgaaacattaggatcactatacagtttaattaaaaaagttaatgaaaattttccttagttcttttccttagttttgggcctaaagtccattctttcattcctttttagtcctaatctagttcgctacctccctccactcagcacacctctcttcagtttagcccacaagttttgaaccaaacattaatggtaaaaaaaaattcagagattcagaagtaaaaaaatgtgaaagattacctagtgggcaagttttgaaccaaacattaattgtaaaaagaaaagaatcagagatttggatttcatagtaagtaaaaaaatgtgaaagattacctaatggcagcagctagtaaatcatttaaaaatatccgtgcattacaacggatgaatacaatttattttaataattaatttgtcacatggtaaatcatccgttttacttattgatacttaataaatattacaaattatgtgagtttggatgagtacaaatgatgtgagcttacatttttcgttctaatgcaactattctaagggtgtttggatgagattcagtaaccaaattacatccgctaaaaacaaaaatcaaaattaacaagttgaaagtaggtggaactgggcagaacacctgatgaggtgtgggaagggagggatgctcaccggcgagcgatgatgcggtggatgcaggaggacgccgggcgaggagacgaaattcgaggacgaggccgaggccggatgggatggattaggatgctcaccggtgagcgaatgcagcgggagcaggagaacggcggcgccacctctgctggcaggatggcaggcgagggcggcgggcgaggagatgggacggattggggagggaggcggaggtgcagggagcgctgttggtgcggcaaggcgtggcgagggatggacgcagggagcacgacgcgcaggcgcaggtagcagagcggaggcgcggagcggcggacggccactcgatctggattggagtttggagatggatgacaaggaaggggaagcgatatttttctcttcggtagacttttctattgacgcatgctgtcatggggcctttgtttatgggccatggaagtcctacagatttatctcgattttttttcttttttcttttttattgtttaaatatttacaaaaatattataccatccaaaatatttacacaaatagtcccttgccgctctctacaagggctgcaagagggtagtccgtccctcacatcaccctgtcgctctccccgagggcggcagggtctacttctgtaaatattttctccggcacaatatttctgtaaatattaaaaaataaaaaattaaaaatgaaaaaaatttgatttatctctacatgtaagcttgttaagcctcgcgagcaactcgtgagccagctcgagctggctcgttatgcctaacaagttgaaattgcagctcggcttgtttcaaaaccataacgagccgagttcagtcgagccaagctggtcacgagccacgagcttttcgtccagccctatgggtcatatgcacaggcccatgaagctggaattttttcatcacccaaaaaaagttcatctaatgtccccttatcgttgagttttaaacggtcctgaaccctctaatcttgtaaaaccggatcacttttgataccaaaggtagtattgtttttcggttttgttgacgtggtggctgagtcccacgtggaccccacaagtcaactggcaatcttcttccacctcactccccctctactcccatctcaacccaaacctcctaggcatccgccaatgggtggggagaagggtgtcggtcggcgaggaaaagctcgacggccgggagcgctcacatcatggacttgcgtgggcgagtggtgcagcgtgggtcccaactacaactgcaatgtcgtcttcacatgcacgcgcgcgtgctagggtttctgcctcgtcacgctggccaagctcctatccctcaagctcatagtcgccctcggagctgttcaaaagccgatgtgtttaggtgtcaccgagctccgcctctcgtccgcagaggagcacgcgcggttccgccgcattgtcttcgaggtcaactccatctgcaccacattgtggtcgcatcgtcctcgacgcatgtgcccttctccctgtcgttcgccactgccaagcttcttgttagctgccagccttctccccacccatcgccaggcgccgttgtcgggcttctacctactgccgccacccaacgaccaccacctttctccctactggtcaccggccaccacacacctctcccgcgattcagcgtccggcgtcctcttcatgtgcatgcatggacactcatggagttagtggtgctcgcgactatgctcaggcatcgcaacgtacttcatctcccaactgttggggatcctctcgccaatcccgatggtgtggctggcatgcgaccacgatgcggacgcggcgtagatgcgtggcaagctgccacgcaacgatgtggcagtgtaacccgaggggacgacacaggtccatgacgcaggttcgcgctcttcgccgtgcaggtccatgacgcagccgtcagtcgccactcttcttcccacctgttgtcggctgcctaggaggtttgggttgagacaggaagaaaggggagataggtgggagaagattatcggttgacatgtggaacccacatgggccccacgttgactcagccaccacgtcaccaaaactggggagcaatatttccttgggacctaatgtgacctgcttttataagattagggatatgttatatctggtattttagttcaaggacaattttgaaactcgatgacaaagaacctcaagtgaaccttttcctttcatgtctctcgtttcgatctctttcttttaagaatagcaaagatgctcgtgcgtttgcgataggaaatccaaattacatatgttatttttttcatgttcggtggcggagagttagatgatggatatttcgggcccttttttcatcaacctgagtgggtctcatgcacgtcatggatggaacatatgatgggtttcccttagagataatcaatacctgaaggtgtaattacttattggtgtggtataaagattttattttttgctgcaagggcacttatcactataaaaaatgattttcgcatttggctaaaatatctatgtaaaagaggagggatatttttgcatacggaccatttaagaggtcatgcggccccttaagattaccgcatggaaaaataggctcatttttacatgccgctctttaagagtaccacatgggaaaatggatttctgcatgcgagtctcttaatgagccatatgcgaaaatagagctcgatttttgcaaacgcaagtagttacggttcgcttgtaatctgggttctcgtatagaaaaatcattttttagtagtgtgaataatcatagtggcaagagctcaccaaattaagtcgttcttaggctatctaacacaagagaatatatcaaaaccatgactaccattttcaaaatgaggaaaaaaagcgaaagagcctatagcctagtggttacaagagcctccgtagcatctaaggtcctaggttcgactctccataggagcgaattttctaggatttaacggcgttgtgctttcagtggtaggcgacgtacccttcgatagcgaggcacctgtggtgacttcgtcaatctctccaggaagatttgccggcccagtctttgaagatgtttataggggtagggtttgcatgtgtgtgtttataggggtgagtacgcatgcgttatgagcgtctgcgttgtactaaaaaagaggaaaaaaaaagcaagaatagcacatcgatttgaaccagctacatccctttttcttataatcaggcaaagattagtacaattcagcaattcaagttggcgttccaagtgtaaacacgtcttaaaataaaaagaaatgggagagcgcactcgctaacagggatatgatataacacaaaaatatactccatccgtattttaattattttaatatatgacggccgttgacttgttatcaatgtttgaccattcgttttattcaaaaaaaagttatgtaattatcatttattttattatcacttgatttatcatcaaatattatttaagtatggcataaatatttttgtatttacacaaaaattttaaataagacgaatggtcaaatgttgttcgaaaagtcaacgacgttatacattaaaatacggagggagtactatcatgttcaaggcagtataaaaaaccatttttacatgcggccaatttcacatgcgaccagcacaaccgcaagcgaaaatctcaatttttgcatgcggtcaccaataccaactgcatgcggaaataaattcgacaaaaaaagatttcaaaaaaaaaacccaaacactagcctgccggctggccgcttcagccgctgcctgtccgctgttgccaatcccgaaggcgggagtggcagatccgcccgctgccgccgctcccgagagctgggacggtggacctgcctgtccccattgttgccgtccaccacctgccgatctacccgccgccgtcgctcccgagggtggaggcgacggatctgctcgcccccgccactgccgctactcccgtggtcgtgggcggtggatctgcccgcaaccaccaccactgccgctcgctctcgcttggtggtggagaggagaggaaagaggagaggagaagagaagagagagaggggggagaggaaaatattagaaggagagggatgagagaggtggtggaaaaaaattgaatttggtgaggagggaaagatagatgagggaaaaaatactatggagaataagaagatattttcgcatgtggactagttaagaggcccgcatgagaaaatatattttcacatgtggccccttaagaggacgcatgcgcaaatagacttatttttgcatgtggctccttaaaaggtctgcttacgaaaatagattttttatacgggtctcttaaggagtcggatgtaaaaatatcgatttttgtagatgtgaccagttaccgttcacctacaacctacaggggtaaaaaatagtttttttaagtagtgaggagttaggtttgacgcccttgtagtgtttgcaaggtttgtagacggtatttctcttcttttttagatgaatgtagacggtatctaacatttgttaattaagtcaacgaaaaaacaaataccaacatatatacatatgtttgctttctaagttgaatgtagtgtacacacttgctgacttggagaagttttcacatcaacgcgcacacggatgcgtacaactgcgatactaagctagtgtagtctttttttttttttgaaattctaagctagtgtagtcaaaactttgaccaacgattgtcgagtgaattggccatgacggataattttgtaaatctaacatgtgaagattgttgtttggcatataaagtgccacatatatacatttggttcatcttttatatataacaaaaagtttcattagtaaagaaaaactatatttgttttatcatctattttattattaatacatgaataacacgaggcatcactttcaccgtggagattagacatttccatattaaccagagaataagaaaaattagaattcaattagatatataatttaataataattgaaattcagaataaaaaataatcaatattaaaagaacgatgcatgtagaacaccaaacgagattaataaaattcataaaaaaataaagtccgcaattagaaaaataaaaaatagagttcaagtacaaataaagttgaaaaatatcttaaattcgtaataaaaataaaaaatattaaaagaatagtcacgaggaacgcattacgatattaattaaaattttaaataaaaaattaaattaaatttgaaattagggaaaaataaatgttcatgtaggaatataatttagaaataactaaaatcaaaataaaactaaggaatgtacaaagaagaaaccatttggaacacaacacaagattaattaaaatttaaaataaatgctgacattagaaaaaaaaagagagttcatataaaaatataatttagaaataattaaaattcaaaatgaaaaaaataaaaaagtcaatgtagaacacaatacaagattatttaaaattctaaataaaaatagggcatttaactatttgccacatttagatttagcgtttaaccattcactacccatatgccaatgccatgtggtttctcttgtgtctatgacaagtaagtctagtaacaaataattaattgtcacatttaaaagtggcaaatgattaaatatatcttaaaaaatagattccaaattttttaaaaagagaaaaaataaatgagatatcaagttttggaatacaatttagaataataaaagttcagaataaaaataaggaatattagtaaacaattcatcaaaaaacataaatattgcatatgataataaagaggggttatcaggcaaaacataaaagagtagggtcacggtggttgatgggacatctaatctaaatatactatcttcgtatcagaatgtagctatttctaacacagtaacttgtcccaaaatgaagctatgtctccacctatacctcatcctctcaaccaatcacaaccattctccttcacctactttcttttttcaaccaatcacacccttttcttcaattattctcatctactttcttaatactcgtgccaacctaaaaaatatctatattttgggatggggaagtatgtgattctgtggtgtggtccttgtaaacttttatgaatggtaaattcgcaatggtttgtttcaggggataacgggatatatgttgatatattgatatggtgtgtggatgatttgttatgtattatagagcatatgattttaaaagcatctgtttgttttatgcgggaaggggggattcacggggattaattcaccgtatgaggatggggatggtaaaagttttatccctatcatgattggttgggacagggtcggtgaaatttgaacctcacattggcgaggatgcagggagcaacctctgatggaaaatttcctgttgccatctctacccctagccctaagcgtgcctccttgacagaccccgtcatgatgtggtccccattagagacttagggtgtgcgttcgtttgaacaacaaatgagagtcttcgtgacttagggtcgtttgaacaacaaatgagagtcttcgatttctgtacacacatttcctgaactactaataatatgtttttagaaaagccataagaatgttgctctaaaaataatattaatttatttttaaaattttaaataattaatactaaattaatcatatgatagttgctcacattattttacatacttttttttctcctcttaaaccttctatttgtgcctaccataaggcacagggaggtgtca

SEQ ID NO: 71651 - DNA, 27933 bp, Oryza sativa
tgtaatgaatgatattttagcctttgggaataagttaggtagtttatcaaatttatctacaatagaatagccttacctgcatactttttgtggaaagcctctttccagttaaaaccaggatccggagatacttgataaatgctattctgtacatgataatcagtgttctgtacattaccagctgtaggtgtgctattgcagtttatatggcagatgccgaagaaaagggagtaattcatttcccacaggtggttgtcatttgcagcagaattccaaggccttctaagaaagatagatagttgtcaacaataaagtaatgcttaatgaattacacggacaagagaaaaaagaaataccagcagacaagaccagcagctaccaaggagcgcatgtcaagaaaactgaaaatatgaacaagcacatcgtatggtatatgtggtacacctgcaaaatgggcacaaaacaacgcatcacgatgactgccattagttagtaaatatttgtacatttgttcttttaaatcttgacaggacactgcagcttcagtaggtaaattagtttaaaactgccgaaatctatcctagcaattgaaaaatgatgaaggttgaaagcacagacaacatttaccagtttctaaatcgttgtttaccatcctaacagatcagtaagcatgatagtgtaaatgcacatcatacaacacacttgacaggagcctgtcacatacctggatcttgttgaaccctagctcgccgtttatgtgcatcaacagaccgcttgatctctgaaacagcatgcgccttcttttgctttggtagggaaccgtctacagcttggagaagaccattagctgcgcttaacgcatatcctgtctgtacactaccgggtaaaatgagttaatacaagctcctgtgtgccaactgccaatataatagaacaatgacattaagccagaaacatagcatgctaagtgagcatttgcgtgccattcgtctttagttctatgccttctataatagaacacataatcacaagtcctaacagacatcatgaatttatgagcgacaagcacgacacatttccaaaaaaaatctaacaatgcatgacctaaaagtacacaattttccaacaaattcgaactatgcacgagtcatgaccttaaaattcaacaggtcagtgggatagtgaggtggacgcggctgttatagacatagccatcgacagacacattatctggagaaattgcgcataagcgtgtatgctcaaaatcacaatttgtaagggatcggtgctttaattgatcgagcttggtgcctacccgctcaaacaaagtttcataattggacagatcaacataagaaagcaatgcctcttcacgagttgctagagggctagagctggttccactagacagaaacagtgcaaaatcactggaaattcgtcagaattgtgcacatctggggagcggcacgagcttggaagagaaaggggcttactcagggaggagccggaacgcgagcagcacgtcgccggcgacgagagcctgggcggccttggggaggtcgccgtacccgattcggaggagcgcggcgatctcgccgcacgccgtcgggtagtcccacggccgcgacagcgcggccgatatccccatctccctgtacctctccgccgcacccgtctccctccgccgcggctgccgccgcctcaccggcatcgctgcgacctcggaggggccgttccctcgtggatccgcccggacaccgcgagccgccgcgccgcctcgtcgttccgacggcgagatgttccgggcggcctggacgccgccaccgacgcggcccttgtggtggtttgggctacgcgcgtgaccggagtacacgtgtcaggcttccatggatgggtgtgatgtaatgggcttccggaattcgctgaccgtgatgtttggcccgttaggcggcccaggatgacccagtttagaacaaaatgttgctcgacttactaatctttgtacgtgttttagtgtaaactttgactgatataaattcatgtttaattacatagcataaaagtgataatgttaaatgcataacaaaaagtacttcattatacgtttagagagtcattttgaaaaatatttggcttaaattacagtaagtacagacgataatatagatttgatgatagtagaaagtaatgcacctgttggttttgccatcttaaacgatgccacgtctgttacatttttattcttagtaaacacatgtagcattaaaaagtactgtagcagtagacattttctgagcatgtcacaacgtacaacttcatcttacaaggttctgagctcactcacattgcaattctaatgaaccgagaccattgtttggcctgcgtcaactgtgtcgcaaacttgcaatctatgctgatttctatttccctacgatagctgaccttcctagcacatcttaggagaaaactcggtctatgacaaacacggccaagtaagccatgcaatttctgtttcttggcctaaaaacgacgtctatctgacaaaatttcccaatgtgttctgcacaatgctcatgccgaatccaacttgttctgcttgagaaattccaggtccttgagttgccgctgcgctgcttccttggacacggtcttgacgccggggcccttcctctcgccggcagccacctgcttcgccatggaggtcactatcctctcgaccgcctgcctcccgacggaggggaagacggcgttcagcattttgcacagcagcttcacgtccacgtcttccaccatgtcctgcccgaagcagcacacgtagatggcctccagggccttctccgcccgcgcttccattggtatctgtggcgccggagccttcagctttgctcttttctgcaataaaattcatcttctcttagggaccaatttataggacatatagtatgcattcaaatttgcagtgcagggacatgttcttccagaaaagttgctgaattaagcatggctacctcctttgccgtcttcatcatgtcgaggaacgtctcctcctcgaactcgatgtcgttggagaggcggagccgcgcgacgccttccaagatctcctccgttttcagcagcccgccaccaacggcggccagccagcagcacagcagaacgtagaagggatctcctgcctgtcaaacaacggaacatatgctcaccaaatcaattaaaagaacatttttggcatttctgcttggttttgcatcatttttggcattgagaagaagaaatcgacggcgagaggagcgacgggtaccttgccgcggcgttcgttgaaatcgtagaaggcctgggagtccatgacggtgcacttcttgctgacgcggcggcggaactcggcgaagtcgatcatgtcgccgccgacgccaccctcgtcgctcaggatgcgcgccacgaggcccaccacggggagagccccgatgaggcggcccgcgatggaggacggcgagttggggttcggctccatgtacgccaccaccgttccatgccgccggcgccggttgggggcggacggcgatggccggcggtggcgcggcaggaaggccgaggcgagcgagaacctgtgggcgacgggtaacgtccccattgtgtgtggtggacgtggcgcgcgccttatctgctcatgcgcctgcttgactgaagccagcttggactttgggggtggcttggctagttggcttcgctactgtgctacactgcgctacacttgtggtagttggttcggtactcctaatttgcacgcaaaacagtcacaatcattgaattttattgagtaatttcacaaaactacatgtattttgatcaatatatcataaaactacagatttaaaaataggaaaaagtatgaattacctccctaaactattgcgacaacacgaattaccccccgaaccacaaaatcggacatattacacctcaaactattgataccggataaattaccccttgactcaatcctgagcggtttttcttctacacgttgcaccgacgtgaaaatacaatcagcaaaaagaaataaaagaaaatataggacccacctgttagtacccctcttccccctcccctctcttctctctcgggcgtgcgtgaacgggcagcgggcagggtcgcggcgcaggaggcgaggtggcggcgaggttctctctccacctcgttccctctctctttctctgtggtgccgtcgggagagccgagcaaggaggaggcggcggatcctaacaggcggtggaggaggcgaggcgaggtggcggcgaggttggctctgcaagcgtagtggaggaggtgaggcgagcgtgacggcggagaagtcgaggcggttctgctcgccgccgtctcgagatccctcggcgaccctcccacgactctccctgccggcgccgtgaacgaccaccgcactcctcccccgacgagcgtgtgagcggcgacgcctctctcgtttccgcctccatgctgggcgcgctcgtgctcctcctatatggcgagcgtgtgcgcggatcgcccgccgttgcgagctcgccgtggaggcggcgagatcgacgacgagctccactacttgccttgatgcgccagagatggagaggggggaggggcaaagaggaggggggagaagaagaggattggctgatagtgggccccaccatatttatttgttatggctgacaagtgggtcccatatatttttcttttgttttggctgatcagactgccacgtgtgcatccacgtaggaccgaaaccaccctggatcgatctaggagggtaattcgtccggtttgtaaagttcaggataaaaaaattagtattgaagtttagggttaaaaatcggacgactgctattgttgagaggggtaattcgtacttttttttcttgaaaatatgtatcacaaaactatagattttagatattatattagaaaactacagaattaaaatcagttttattacaaaactataacttttgaaactttaatatgttatggatataaactctaaaatatatagttcttttataatttaatcattaaatctgtagttttgtgatacgatactttaatttgtaattctaagataaatttgacactaaatttgtaggtctgtgatacacatatttaaatatgtattttttataatagtttaatcaaaatatatgtagttttattatatttgttttcacctagtactcctaccagtacgcgatgaacgattacacccagatctgagcagttccaaattggccccttgaacaggcttgcacgttttgagcagttgagctttaggggacaccggaacatcacagtttgctgcaggatggttagatattttcagggtaaggaccattttgagcacaggtaatcgttattcttaatcatttcattgttggtcatacactcataatggtgtactctggtccatttcacatcaagtggctgggcattggcaatctggtacatccattcttcccttgggcactggtagaaagaatcaacctgcaacattcagatcctttgtctgaatgaatgatctaactcactcgtaggagtactagttacgacggggtaagtggctagacacggtgaaacggcaaaatcgacaaagggccgggaagattatgaacaatatccttcgtcagatgtgaaacagcacacacaacagatgagcctacaactgacgcgataaaagagggattaatcataacccagcccagcaaaaaaccgcgggaccttgagcggttgaggcagacgagatcatccataccacgcgtgccgtgcgctgcgtccattcccgctgctcggcacggcacgtcacggcacatcgctcgcttatccgctcctcccgcgcggcgcgcggctccgcccgcctcccgctgttcccgtgtgcccaaccacctgtggcgcccgtacgtgggcgagtacaccacgcttcacgcatcagctatgtcggaacaggccgcgcggcccccgcgccatggataaggcagacgcccccacccaagctcaccggcccgcgcggcgctgcagcgcgccaggtcgtccgtctttatccgtcccttgcctcggcaacttggtgcgtttcccgtcgttggcgtcaaggtagccgcaggtgcggtagatatccgaccagcgaagcgctccaatcgccgaacaatccggcggtaacgttaaatcgtagtaagaggaagctctcacggaggaagtggtcctgtcgaccgggtcaccgggagctcacagactcagctgatgtaatcgtggcagccgctttttatcaccgtgttgcagtacaatacagtagtatatacatgggtgtttgggagagaggggctaaactttaggtcccacatacaggctcgccgtggcataaacaaagagggaaacgcccaggtgtctcgccaccaggcgcgactcgacacaagcagtgatgcaagctgccccctgcttttcccccatcctctgctagctgtactgtgccgacttgcctcattagggaaagtgaaacaaaccacctctgattagccccaaagcaacggaggcacgaaggtttgactactacttttcagtatgactgtatgagcgagcctccgcccgccaccgataaaacttccgtacaaaaccacccgagacgcgacgtggcggcgggcatgcagcacccgcatccacgaccctccacgtactggccccgcgcgcccacgtaccccctcgcctcgcgccaaaaccacccacgctaacccgatagctcggcaaccaacaaagggatgctacgcaataccgccttgccttcctcctctccccgccgaaacccaacggcgcttctcgccaagccgcgcttgctataaaggccactcgccacccaccacaccgggtgtcacctcaaagtacagtttcctcttttttttttcttcggtggtgttgggagtggacaaggtagtgtgagtgagtagtgagcaccatggcgagccgagagcacctcctgctcgacccggcggcgctggccgtctcttgggctgaccccgctgcggtggagatcccgcccgagctcctcgccgcgctgggtgagtacctgtccgccaggcgtagcgacggggaggccgaggccgacgccgaggcggaggctgatgatgagttcatgatgtacgagttcaaggtgcggcggtgcgcgcgggcgcggagccacgactggacggcgtgcccgtacgcgcaccctggcgaggccgcgaggcggcgtgacccgaggcgcgtggcgtacacgggcgagccgtgcccggacttccgccgccggccgggcgccgcgtgcccgaggggcagcacgtgcccgttcgcgcacggcacgttcgagctctggctccacccgtcgcgctaccgcacgcggccgtgccgcgcgggcgtcgcgtgccgccgccgcgtctgcttcttcgcgcacaccgccggcgagctccgcgccgggtccaaggaagactcgccgctgtcgctctcccccaagtcgaccctggcctccctctgggagtcgccgccggtgtcgccggtggaggggcggaggtgggtggacggcatcgatgaatgcgacgcggacgcggagatggaagagttgatgttcgcaatgcgggagctcggcctccggaaggtgaggccgtcggcatcgtccgtaacgccggtgctaccgccggtgacggacgaggacgggccggatttcgggtgggtgtccgagcttgtgatgtagaagcacccgacaagctcaaagacatcatctctctcggcggcgacgattaagatgcagaggcgcctcgcagaacagcttcattaattaagttcacttcaattcgatgatcatttcgcaaattgcatcattcttctgtacataaacaaatatggtgcaagttaatctgaacacagcaatccgtaactgtaagtgtggcgtgcgtttgcctgcctttttttttcgaaaatcttggggagctagtagcacccttgcttttcgattattattattattatctaccagtgtagatatggagtgtaatatgctaatagcctctgcctgtttcgtgatattatcacatttgatgtacttaattatgctaaattcgatgcttttttttatctatcttcctgtggttaatcaccaggtttcgagtcatcagctgctttactgcatgtcttgatcgaattcgattcgacggaatacacgattggtgctcggagaagatagttcttcttgcttcggcttggctatcgatagagatctatcaatgtcaccatcgctgagtcagacaaggtacgagaaacattccccctggcggttccggttttggagtaaaagcgaagaaatttgagataacccatatggtccccggcataacatagtacaatgccatcataggcaggcttcgcgaagttgtctcgattcctatctcctgccaaccagcttcctccctactgaaaaagagaacagggagtgcacggattcatgttgccagcgtcaatcgtttttaatcactacctaaaaatatcttacaaaaatccactgtttaacagcgtggcttctaaattcagattacacgattcagttggcggtttcagctgaatttcgttcggtttgtgcgtagtcgtccgaaaggactcatcgacgcgacgcaggctggccttttgcggctaagatcaagcaaaaggaccacgggacggacgcatgactagtcgaagagcgcgagagctatccgatccgatcagatcagatcagcctgcgccggatagccagcccagccctgaaaacgaaacgccgccggattaggggaaaaacaacgggtgcgccctttggccccctttgactcgtacgcccacgcgcggcaccaccggcaacttggcgggcgggcgcgcgaccgaggcggaagtccaagtcggcagccactttttcaccggatctctcgtggtctcgcccacgcgcgaccacggtttagccacaccagcttcgcttcggttggctcgcccccggcgcaacggagggggtgtgtgcgggtgtgccgtcgctttgcgtgcgggcacgacgccgatccggttgcgttcaggtggcgagttcccattgttcggccaccaagttgggctgcaacgtgcgttacccttttcccgtttcaacttcgctttgtgctgtcacgacaaggccctggtggttggtacaacggggggagtactaactgctttgcactggatgacatgcggggcctgaccgtctctggagcttctgaaaagctggattcctagccggaggagccgctttattatctgtgggtgcgatgttagagagttcaatccgcctccttattggctggcggaaatatcttacgggggtgcatgcatccaggggaaaagagaccgtggtggtaccaataccatccgacaacgctttcgtgatggccaacggtaccattgttcagccgggttgccggactcttgctgacactgactagacgtgagagacagtccaatggcatggttacaggccgcctacagtttagctctgttgcgtaaccaaggtttgcgatatgccaagacgagattaaaactccctgtttgtgttttatgagatgagactaaaataaaggacatatgttattgtagatcacgatacaggctactttctaagctatgaacgtatagcgccgtccgatggactgcaaaattgtttcatactcccttcgtcctaaaatatcttaacctaagacgggatgagacttattctagaactacgtcagattcatagttctaggatgggatcccatcctagtttgctatattttgggacggagggagtagttctcttctgaatgagaataataacatgattttttaataacttcttgggatgttatatgtccagaagtggaggacgaggtgcatgtttgtttaacgtacaacgttgatctattcaatgacaaaggtactatggtaccgatgaactgatcaaatcgaaggaattagaagaagagatataccccccttatcctgtatgagtgataatatacataaggtaaatagagaacatattatagattcatgtttaaatcaaatgccttaaattgaaattaaatgttcgaacatatgcacttgctctacttatagaaaaataacttttcaattgtcacctgaaaattttcatccgtcggtctctttttacccgtgagtgcgtcttcatcgcatcgatcactcacgtttcctcccggcccatgtctgttgcctccaattctgagtgactgagtccgcctctctctcccttttcccgtgtggccgaatccagttctggcgttcctgcgtgtcgctggctgaccgccgatcacataagagtcatgcgaccccgagaaccaccgcctccccttggatctagctgcaccgagccctggggcattagatctggactagatcggcgagactacgatgatgggggcaacgacgaatgatgacgatgatttccactcctgattcggctccggcctgaagaatgacgatgctctagggacactgaggagacgaggactacccgtagtaagatgatgaccaagaacattcaacaattggatcgtgtcagccacggtgatgggctgctagacgacgtcttgcctgattcaggtggtcagggagaaaactcgttcttcggcagcctggcccggtcggcaagtgttattcggcaaggtatgcaatgcattgcgagcttagcaatgttcctagtggttagcgcttagcaggtagtagacttgaaatgtgaaacacaccgaaatatgtcatatattatgctaactttaccttggagtgttatatactttcataatttatgttgtatcttcctattcagcatcaaagacttcaagattggagttggaattgtctctttagtaacgtttcgctgaatgatatgttcaaattatttaggaatcatatacaccatgtatattaaggagtgatacactatttgtggtgtgtcgtggaaccatatacctattaatgtccgaatctggccttatttaagactttcatcacgtggaaattctaataggctagtatcctggtgtgcaacgtatctaggtgtgtatctcgtgtaactatataagaccgtgtctgattatgttttagtgattacaacatatgattttcttctggtatttaggctgaagtgactatgacaatcaggttaaagtgaccgaaacacaatagccaactactatgcgagccaacactatctgttatacaaatactacatataaaaggtatagcatttatttgtttacactatgttttgtctgtcatcccgattcaaagtctgtaattggttcgatagtttgacatcttccatcatacactcatcactgcattgctgaattttgacaaaaaaatatccattgatgagactaaacaaaaccctatatcccacacttgcctcgcaaatctaacttgtccctacctattgcaatcttcgtttttgtttattccgttgcaacacacgggcaatttgttagtagatatgggataaatagaaaacacattatagattcatgttataatcaaaagccttaaattggacatgttaaatgctcgaacatcttaattggacatgttataatcaaaagccttaaatctgcacttgctcttaaaaataacttcacgaggaaacttgtagaactccatatgacaaaaacatggtaaacacaactttttataatggaaatactttatatttcttgccaatgtagcacacgtaaggccaatacatatccgtaaaaaacaattggcatttgggacaaataagaaaacaaagtaacttcatcgtgcaacaggaccagtggccattgttgggacccttgcaatgttatgcccaacttcaaacgcatcattactctggatcacattagtggattggtcaacaccgtatgtattataacttgagttgtggttttcactattggccgcgtagtctttcagatgtctattttcaagttcaatgcactcttgcaacattgccaccacgccagtcattgtgggtcgatgtatagactcctgcatggtgcacttgagtgcgatgtccacaaccttccacacactgttaatgtcatggtctccatgcatgcgtgcatccaccacatcctcgatgttgcctcgtgccaggtgctgctgtacccattggataatgctagtgttatctaggtcccgtagtagggctggcttccctgtgaccaactccaacaacacaacaccgaagctataaacatcactcttggttgtgggttgcattgtcattaagtacctacatgtttagccaatgtaatgcatattagtacttgcactagaaaaacaatagaaaaactataagtggtatttggaagaccaaattaaataaggtagatgggattacgaactctggatcaacgtatccaggtgtgccagcaagtgtgtttgtggaaacatgagtgtcattgttgcgattaaaagccttggacaaaccgaaatcagcaatcttcgcctccaacatcgcattcaatagaatgttggttgccttcacatccctatggatgagaggtggattgcaacctttgtgtagatactctagccctacacatcacgatgtcaatattcacttttttagcaaaatcaagtctccaagaaaagcaatagcagcattaggtttagcattacttgccttgagcagattctagagcgatctggagccgccgtctccagggtaagaatcttctcctgctgttttcttctattgcaggcaaagtaaatgaagtgtatcatatcaaccaaaagcatttcaaatgatctagagataaataaaagtaaaatatcaatggcttatcattatcattatcattatcattctttttttgggtcaattttggagctgttgtaccataccatgcacgtagaatctaaatattttaggtactgcaatgtgttcttgtagagttccttctgacatgtactcataaacaagtgccatgttatccccatccttgcagtatccaatcatggaaacaagattcttgtgatgaatccgggttaaaatctgtgcctaagtgatcggttgcaactttcaattttcactctagaaagatcaacaattagtcaaaagagaacaacatatacctctccaaggaactccttgtctccttgcttagagtttttaaacatcaacttgactgccactcgagtgtgatcctccaaaaacccatcatagacacacccaaaccctccccttccaagctctagctggaagttgtctgtcatcatctctagttcccggtatgtgaaccgacggttctcaagctgtagtgatgaactatgcatgtggccacgatttttcgaagcatactctgccttctcattttgtggttctgtggaattgctccttggtccttgatatgcaaaggatgcatatgaaatgggttagttttgtttgtggatattccttagctattaataaaccacatgatgagggatttgtagaaagcctcacctatcctttttcttttcaggtaaaagagtattagatatattggtactatcaccataaccagaactatgggaacaactatgtagatcactaacttgttgttccttttcacaagcttgcatgaattgccattggtgtataagtttggattatttccgtctctaccaaaaaatgaagagtttttaagtgcatcttagtacttcccaaggacctcaaagaagctcaaagataagataaatatttgcactatgtttttgtcgtggttggtgtgttaattattgggagacgggttgtgctgaccttagatctagggagccatcttgaattcttttgagaagtccagatggaattgatccactgagctggtttcctgccaaatctctaaacaaaatcatatagtattagtacgagacaacaaaaggtgctataaaaattggaattaggcaaatcttgatgttttacttacaagactgacaatagaggtaattgtgaaagggcatctggaattgagcctgtcaaattgttgtttgacaaattcctgcaaaacatggacccagtttttcccccatatatatttatgacagaaatcccctccaaaaaaagcttataaagagcttagaacatacaagtattggactcccttgagattcgcgaaggaagacgatatatcaccccttagatcacttgaggacagatttctgcatggagcaaatatatctatatcaatttcattgtacatttaatcagtgcattctgctttatttttttctcatttatctttgtggtgaagacaagtctatatagatgtgaactacttacaggctagtgattcttggacggatggaagtggaatagctgcaggtcaaactatcccaagcaagtgtcttcggaacacacggatcacccatccagttcttcttcacctgatactttaccttgatagccatcatggcagaggctgttaaatgcgcccaatgttttcagtaatacacattaaccatcatcctgtcgatctcacttattcttatactcctactagctaaatacctatgtcttgctatagataaatatgaattagtattgttgggaataaatattgtgaggtttttagaacaactcatccctgaggatgtctttgcacaataaacttgtattttagagataaataacatataaccataatatgcagaaagacgattttgtaatttgaaagtacatcaaggagtggtttgtaaaagatatataaaagagttggtgaggtgtagctggtaaaactatataaaacaatatgtggtgtggcaaatccgctgacaccaccattacattcttttagggcatctctagcgtgaagttgtgtcgacgcgtgcatgcggcaaaaaagaaaaaaacccgaaccaaatacaccgtgagatgtggctgctatttgttagagaggaaactctcagtcgaggagtcgatttagccgattaaaaaagccatttcttcatcagtttgcatgaggaagaaatgatatggctgattttacgtggtcctggcaaatcgatgctaacgctagaactaccgaaccaatttgaacttcgtttctattagcggtgcatatcgaacttaggactggagatgaccttagaagaaaacagcagcagagccgaggcctggccacaatgggcaggtgcatggactcccgggaaggtgcatggactctgttgcatgcaactggttgaatactactccccccgtttcacaatgtaagtcattgtagcatttcccacattcatattgatgttaatgaatctagatgcgcatgacttacattgtgaaacggaggaagtactaagtactccttagttgtttaccaaattagctaatcaaaaccatatacaaactaatgaaaaccatattagccagcaaactagaaaagtataagcctcactacaccacatatgttcatgtcaatagtaaataatttatagagatatatgaactagaaaggtggctcgcgcctatgtgcgagcatttatattgttgaaaggtaacattttagtttgttcagagattgtctaatagatagcatactaaaggggatctatttttttaacatatctcaaaaaccattcatcgacttttgaatagaagatgaattaagttcatacaacttttgtatcgagtaaatattaaacaaccgcaagctaattatcatgcataccattttgtgcacataccatgtaaatatggctacaaacaaaaattacgagatcagcaaactcaaagtttttgtgattaaatcgcctcatgaaggcacgtgtgacaaacaaattaaagatagattaaaagttggatttttccctctatataaattcaacaatattttctccatagttttatataactttaaagggttttggtgcacacaaacacctacacaattgcttagcttggtagtgcaaaatatcagtttgaagttaatttcttctttttcgcatgttaggttattttgtttgaaacaatatttatttgaaataaaaccataactatataaatttaattagtatgtgcagtttactcataaattttgaagtgttttatagtaaagtttatttctaccatgtaatacggttatataagaatatagttttgtcatgcatgtaaattataatcattaaattcaatatgatttatgtcaccataatgaatgaaactttgtaaatgcaaccatgactacttaacaaaagaaatttttttgcctatttttttaaaattcaaataagcacatattcataatcaaagaaacactcttcgtacaactgacacatcatagcatcactcggtcatatatagatgtaaactatttgtcattagtttcggcccgctcattgctcggtggtatcctctattcacccatcatcttgtgatagtcctatagaccatattttatcaaaatttatctacttatttattttacataaggggcaacgccatgcttctactccctcgtgtatagggcgcaacgtccaaaattctttttcccaaagcatgttcttaattaacacatgtaaataggttattgcatgtgtgatatatatatgtatgcgacacatgttttttttctagcttcaccccgtttatatacgtgtagagagaaattaattatattaaactcgcggtgcttgattcttcttcttgctacattacatctttgatttgtttttaagttactaaaaaaacaataactatccattgatgatttgatacatcttcgcctcggcaaaagcagtagcgttgtagacttgcagtggtcatgatcaccttagctgccttaggtatgacatttcatcatacgtctcgacggcaaagatacacatgtgcattgtgcagatgtccagagagaggtcttccaagacttttttttaaacaaaagatagatctaatggtctaaatagtaggtccattggtttatgtgaaaatcgatggataaatattcttattaaaaatattttaaaataataggtacataatataatataatggtgtaaagtttattttcaaatattgtagagctaattcatttatttctacatgtaaagagttatatgctgatatattctatgtttgtaaagtaacttttatttaaaatttattatcactaattgttgttgttgttgttgttgttgttgttgttgttgttgttgttgttgttgttgttgttgttgttatctcaactatatatcaactaattaaaatattcgtaacttttcgatcgtctcctcatccgtcaatgcactcatttttcgtccgtccacccctccccccctccaaaaaaaatcctagtcgttccgcaacgttcgagatgagagtcgaagaccaaaagaaaatcatctagagtccgcatcaacaaccaaatgcccgagcgatctagcgaaaatttatcacagacatagatacaaaatccaataggacaatcaagcgaaataggaaaaataaaataaaaacgtcgctgaagccgctcacaccgtcatcgccatcggatccggcgcgggaagccaccaccaccgtcggatccgacgcgggaagccggcgccaccggcatcgtcgtcgccgtcaaatccaccgcgggaagctaccgcactccacccctctctcttcttttccgctcgcgaatggagttgtgccttcgttgtcttcgtgccgtgtcggcgagataggagggagaggaagagagggactggcgacgccggtgaggggaggaggagagggggcggcggaggaggagcggcgccactggtcgggagaggggaggggagggggagaggcgctgccaggaggggaggagctaacggtggggggatgggaggggaaggtgtgattagggttagggttttgatggatttagaatcgatccaagccgtccatcaaaccgaatggctcatatagatcccgtgtcgagccggcctccatatcgggccgcaacactactgggccatgcacgcttcatagtccgggcgcgcaatagcaggccgatagggtctaatgggcctttttcccctttttttacaactttttttttatttctaaggatatatttttttgaagggctcatatcatgaaaaactaaatcctaatcatctaatatttttttagtttacccgttgcaacacacaggcatcttttctagtatataaaaaaaatataaaggttgtgtactaacgtatgcacgtacctatggaacataatggatggagaggtggaattgtagtcgccttttggtttgttttaagattaatctaatctaacggtttataatattagacccgatttaagtgaaagatcgagggatatattttttctcagattattttttaattttctccaattaattaaagcgtcacgtgacggcgtgagagtgttcagagaaaatttgatggacttttagtattagattagcgtgtatctattattattaagtttgctcgaaaatttaatgatccgtcactgaaagagtacatatatgtgcacgtaccgtcctcggaatccgtggcgacattgattgtgggcattacggagaacacctcgatggcgttgatgatcggtggcagcgtcgagttggaggtggcgttgatggagatgttgtactcggggtatcgtaggaagggttttttctcgtagattaagtcagcatagaggtacaacggcgtgtagctctcattatacaccaacctgccgttgaggttgatgtagaactggcgcaaggcgttgctggggaggagctgcacctccgtgaagtagaagttggcgatgtaccccggcgtcggatccttcggctgcgtgtaggcatcccaagcgaactcaatgttaccagaggcgttccgcggcgtaatcgccgtctgcatcacccgcgacggcgcctcgaatatgtcattttctatgttttgcaccatcgtcgtcgttgatatcacggtccagtcgaagggattgatccaaggcacccattctctgtcgtgtggatcgtcggggtacctagtcacaatcgaatcagtacgttgattcactgcacgtataaggattcagcatcttgggttgactatttatctgatcaactcagatcgatacctacttttttttaaaaaaaacactcagatcgatacctgatgatttcggtattactagtcgggccaaagttccagcgaccgaacaaggacaggccctgcgtctcggtcacctgcgggtagagcgtgctcttgagaggcctcaggtccaagccggagatgaacggtgtcccggtgccggtgttcaccaggcagacctgcacgaagtcatccggcacgacgacgatggcctcctccagcgccgcaccgtcgagccccgtgatgttcaccatcgtcaagaagttgacgccgatgtagaggtcaaatacggggggcttcttgaggccgtcgtagttgccgtacacgaaggcggcgcggatgaggtacttgagcccggccgtcaacgaccggagcgtgtagcagttgcgctcgccgtctgggaagctgcgcaggttgtagttccgtctggagattaacggtgtcatgaattcgaccgagatgttgtggtttgtgcccgcgtcggtgaagccgtcgtccgggacataggacaggttggtcttgtcgtccaggtagcctgtcttcccttcaaggccacagtctatgctgatgaaacctgcaatgcaaactctgagctatgaataatgctcatcaaatcgtcattcgctagcttgcctatctaaactgtgcacatgtgcgagcgtgcagatcaagagggcggacgaagagtggagcatatacctttgaggtcaggctgcgcactagtttgaagtacgccggcgtcggccacggcaaggcagaggataaacaaccatgatcgcgcggccattgctctcgctgttgattgctccaaagagcatccgagcaagcatgcagctagctactactactactagagatcatatacataataagactataggtgccccaatcatatatagccagcctttaactaaacaagcaacagagataatttgggggatagcacgatcctgtttggccgcctctttgtgggaccgcgacgccatgccaactaagagaggaatagtcagcgagttgacaacaatgagagctgagttaatcgtcagcgagttgacaacgatgacagctcgtcagctgctagccacttcgctatataattcttttgaaagatctctgtccatggtatagtggaatgtatattcttctcgtttcctctccatttttgaggcgaagcatataatgtagcagtagtacacaagaagaaggtgtcacatagtgatattaattgttccaggaaaagtgatgttcgtgccttcgtggattgtatactttagaacgtatataggcataacaaggtactgctgccccactaatcaaggcagtggaatgaactaagcatattaacattacaaggttgacattttcttaatgaacccgcaaaaataatgatgaacaaccctatttaaaattactcttattttgaagatcccgttagagttacaacaattaattaaaaatgagtacaggggcagggaatgtggacatgtggtcacaaaaaaaaaatggccataaaagaaggggagaagaaagaaatcgaggaaaatagaacagagaaattcaaaggatagaaggaataaaaaagagtaagcgttgcaagctgttgtgacaagtatttaacaactggcataaacatccctacaattatttaaaattttactatatccatctctgatgtcttcttttgtgcattgaaataccaagtgtaaatatactctccatataactcaataaagtcacagttcatatacgccacaaatttcatagtttccccgttattcagaatattgcatattagtctactatgtaaacacaaattgggagtatgttctaacccaaattttggcattatgcatcaaagtggcctaggttgcactaggttggcatatatgatataaattctgtgaaaccacgagatatagcacgaacatatgttggagttgacttgtaggcactatttatgagcaacataaataaagctatttacttcctccgtttcacgatgtaagtcattttagtattttctacattcatatttatgctaataaatctagatagatatatatatgtctagattcattagtatcaatatgaatgtgggaaatgctagaatgacttacattgtgaaacggagggagtagttgctatcattttggtatatttgactgagtcttaataaagctttcattattaaaaaaaattatgagcaacatgcatgcatgtccacttatttttcacaaaccttcaacttaacacaataacagcctgatcatttgtacattttgtacttcctcaggccaaataataagaccatcattgaagaccacacgtacaaatcaatgtagtaagaacccatagaaatgggtaaagcaggcttcttgtcgtgcaacaggaccaatgtccctagttggcactaccctaagattatgcttcatcccaaaatagtgttgccctagctcatctcagtggtatatgtgttataactcgagtttgggtctatgctgctccctgacatataactgctactcgtgtcgcctttaaagctggtttcctcaagctctagacactcttttagctgtgtcaccacgtcagtcattgtgggtcgctgcccaggagcatgtgcagtgcatttcagagccacatctgctaccttccagatacagttgatgtcatagcggtcgtctggcatgtttacatccaccacaccctcgatgttgcctcgcgctaggcgttgccgggtccattggatgatagtagtaggttccgggagctttataatgggcggctgtcctgtgatcacctctagcaacaccacaccgaagctgtatacgtcaatcttctctgaaacttgtagggctgtggcatacctgtgccatgacaaaacatatcactatgaagtgtactatttggtcaataatcatcaaggcaactagaacgtggtaatatgcatagtaagatcagcatactcgggtgcaaggtagccatatgtgccaaccaccctgactgtggatacatgtgtgtcaccgtcgcatttaaaagccgttgtcaggccaaaatcggcaaccttggcctcaagatttgcattcagcaagatgttcgatgacttcacatccctatgcacgaagcgtgggctgcatgccttgtgtagatactctagtcctgtgagcaacatttttgcaaagggaaaaagggtattcttgttatttctcaatatcagtatgatccatatacaataatactaacatagaactattgtgctagaatgtgtaccttgggcagattctaatacgatacggagcctttccctccatgttaaagatctacctttgcgatctttgcctgtcgatcagaagatcgtaaatgtatttttcttccaaagagaaaatatcattcatattgaaattcgggaatatgtgttttaattgtttatgaaaaatggttttctgtaccttttattgtgcaaaggctatgacttagtctctttccttagttaaaaagaatatacaaatgaaatacttagcaaacctctaagcttatcttccagagttccttctgacatgtgctcgtacacaagtgccaaatgtatctcatctttgcagtaaccgattaatgcaacaagattcttgtgatgaattttcgttaaagtctgagcctgaacaaggaaaaaaaagatcaccttctagagtcggaagaaagttttcatcattcacttgcaaaatgctgatgctttgctatgaatttctgtattcacatgtttgaactattccatagtatcagaatatataatatgccaattgtaaaaagcattagtgggataacatattcactgtcatcatcactagatcatttaaaagctgtatagatatactattcttgatcaagcattacctctgtcaggaactcactatatccttggctggaagactcatcccgtagtttaactgccacatgagtaccatccttcaagaagccgtcgtagacggggccaaaccctcctttgccaaggactcgctggaagttgttcgttatgactgccaagtccttgtacgtgaactgacggttgtgcagttccagcaggctccctccactgccattctgactgtgtgactgcacgccattccccaaaatctgtggcttcacagcaccctttgctgtccaggcaaaatgaaaccagtattatcgactgttaattgcatttacatgtaggaagttgattagtactacttgattattgatgcgctttaatgccaaagctcacatttgttcttcttcttcctgatgaagaaaatcaggaacactgcaactgctcctatcaccactactggaacagcaacatagacggcaagcatagagttgctcttcttttgtgggagctggcatgaactgctgttactgcaaaggtttggattattgccgtacctatcaaaaagaagagatggtgaacatttgttttttgaatgatggtttaacaattttgatcaagtgcaaaagaaatattggaaaaaccttagggtcaaggagccatcttgacttcttttcagaagactagaaggaattgatccattaagctggtttcctgtcaaatctctggatcacatatacataacgttgaagtcaatatttgattttcacaggcacatgcttactcaaaatttatgaacttacagaacatcgagattttagagtggtgattatgacttatggcaataaaattgtatgactaaattattagagaaagatgtcaacatggatcggactgcttacagaaccgcgagaaattgtagctgtgaaatgacattaggaattgatcctgtcaagttattgtgtgacaagtccctgaaataaaatataggcgcatataaagtgcaaatttaactccaaaatcattgtaaaaatggattaaaaacttcttacttacaaattcttgatttcttttagattggcgaaataagatgatatatcgccacttaaaccggcatacgacatatttctgtagaaatgcacaatggtttagaaagcagagtttttgaaatagcattgtttgcgtttgtgcagaaactgaaatgaaacttacactcctgtgattcttggaggggttgaaatggcatagctgcaggttaacccatcccaagccagtgtctttggagcgcatgggtcacctgtccaattcttgttcacctgatacttggccttgattgcagtgatggcagaaactgcattgtttcagtgacagtgcaaaggagcagtggagcacagttatcagatcattcacaaatcacaaataaagacaactaaatgtaccaatcaaccgatggcagaaactgcatgcattatctttgttcagtaacacagcacaaagaggcgcaattatcagatcatcacgcacaaagaaaaatatttaccatcctgagcgtctgttgcaaggtcggctgtggagatgacggagaaagcctccgcggcgttgagtatcggcggcagcgtggagcttcccgcggcgttcaaagaaaagttgtaccgggtgatgccccggtagggtcgatctccgttgtacatggcgtcggtggacagataaaccggcttgtatggggctttggtccaaatcacgccattgatggtgacgttgaactggcgaacggcattgccggccaggagctccagctcggtgacatacaaggtaaaaatcgacctatatttgtagagacacccaagggttaattacgaattcagcatgcaattacaattgaaatttgaaaaaaaaattgtcgttaattgctcattaggccgtgaagtttgggacaaatttaagaagtgattgacttgtacccgggatcagggtagacgtgattgggtttggtgtcccaggagaactggatgggaatggaggagttgcgcgtcgtgatggccgtctgcatcacgacggacggcacgtcgaacacgggggcgatcgtgttctggaccttgtccgccgtggagatgtccgaccactccgccggcgggttgctccacggccaccacacgcggtcgtacgtgtcgtcggggtacctgatcacggtgctcccgctcgcgccgaagttcctccggtcgagcaggaccaacccctgcgtcgcgttggcgggcgcgtagagcgagctcggcaggggcctcaggtccaggccggagatgaacggcgtcccggcgccggtgttcaccaggcagacctgcaagaaatcatccggcacgacggcgatgacctcggcgttccccagccagtcggcggatggcacggtcaccgtctgccagaagttgaccccgaggtggaggtcgaacaccggcggcttgttgaggccgtcgtagttgccgtacaagaacttggcacggaccaggtacttggaccccggcacgacggacgggaccgtgtagcagttgcgcgcgccggcggggaagctgcgcacgttgtacaggctcctgtccgtggtcgtcgtcggcgtggcgaactccgacgagacgttgtggattgtgccggcgtcggtgaaggcgtcgtcggaggtgaacttcagcttcgtggcgtcgtccacgtagctggtcttctccggcaagccgcagtctatgctgatgaagcctgcgcggtactcccgatgcatgaacagcatgtacacgagtccaaaatgccggcgagttggcgatcgaagtttaaagctcaccggacgtgtcaggcgcgccgccctggccgcgaacgacgccggcgacggcgaggccgagcagcagcagcagccaccaccgagccgccattgttggtcgatccattccgctacgtgcgttgtgcgcacatgcatgccaccaaccagttgcaattagacttgacatagtatgtgttaaacaacaaagattgactctgaacaaattcgctaactgcatcggccagtggacagcttggacatcaccgaacacggtcaaagtcgcgaagaagaacaaattaagtagacaaatgaacgctgattagtggggctctgccatttaattaacatggtacaactgtaggtaaccatggcaatccctctgttcagtttgattttagagtggactaagaagccactttgtgtaatttgcactaataaaccttatagtcagaagaagcaggaaatcacatggatgatcctgtagttgactttgctgggagttagtcaacgacttagctggaactcaggctctactactctagtttatcacttcagccttttttttttcaaaacaacctccatactagacattgcaaagtttcgtatctatacagtaggaaaaaatataacggtcccatcgtttcgcttatacggcatattcgcaaacgaaaagtagtttgtgaataaaacttttatatatgtgttcttagcgatctgaaagcaaaggctgaaaaataaacttcgatgaaaaaaacctcaaaaatcaacttcaaatttaaggttaaaaattaaaattgtggctgataagtataagcataagcgaaaagatgagatcctaagattatatcctgtgaggctataatctaagaaaataaaaaagaaaaacacaccaccccccatgctggcaacttatacacacaaattattaataccagctagccaccgttgtgcacgatctgttgttgtcaacccttcaaaggggggacaaacgcatcgccctactcttctctaaacaaaatatcatcttcaagcttctgaacatccccaagaaaaaggtagttatgggagagagtcagaaagaagagaatcaactcatccctcgcataacctgaagacatcctagagtaccatcgtagaccaaatcgattggagactagaaagatagaaaatgtgatctcctagacaatatatgcttccatgaaggtcgtgacgtcgccacgtcgcccgcccgcccgcccacccgcccacccaagacctagacaagatttttacctggaggatcccaccatgaagggagagatggatgtttctcagcaatgccccatgggggaaatgaggcacccaaattaaggcattgcgaccaccctaacatcgtaaccccatgttctcccgctatccaacctgcaccaacaatgtgccctgtcgcatgtaacgccccgattttcgttcgggtttaaaaatcattaaataatgcattttctagaaattaaataaaagttaaatcaatttaatcaagtaaaataatgggagaattaaaattttcccttaaaaatcattggccgggaatattttgtaatattctttgtgccctaatgtactctccggaattttccgtgaattttcggagctcgagaaatagttttaaagtcacgaagatcatttaatcaattaaaataaaaagagaacaaataaaatcctccttcatctctttgggccattttcggcccaaattcctccccctccttcctctcccgcggcccgcgcgcctcctccctctctcgggccggctcccttcttccttggcccgctcgcaaaagtctgttttgcgtccctccttctctcccttcgccgacaggtgggaccggcggtcccacccgtcagctcctcctcctacctctcgccggccgacgccaaccgccatagccgtccacgtcgccgcaaaatccggcgccctcccgcacccgagctcgcatccaacgacgtgggcacgatcccctccacgtccctccaccatttcccccactctccccgcgaaaatcggcgccggttaacccctccaccaccccacgtcggcgccccacttcgccggccgattccgccacgtccggcctcgatcccgcctcccctcccctat

SEQ ID NO: 71652 - DNA, 35813 bp, Oryza sativa
cagatatgatcaccagtgggactcataccgagcccgcatgtgtagagtctttgtttcctccacagtagggtgaaaaagtggaatgctaggggatgggatacgtccctccaacgggatagctcctctccacacgcgattcttatccatacactcacttgccgccatcaccgtcccccgccgctgccgcgtccgtcccccgtcgcctccttcgccgccgccgcgcccgtccgccgctgccgcagcgcccgtcccccgccgacgccgtcgctgtcccccgccgccgtggcggcgtccgtaccccgtcgacgccgccgtcgccgccgcgcccatcccccaccgtcgccgcgcccgtcccccgctaccgccgccgtcgccacgcccgtcatctgctgccgccgtcgccgtcctcgtctacaagggacggctgctggggcgaccgcgcgtgtcggggtgctcctctcccaacgggatgcccaactatatctagtaggaatcacctgatacctgataggtatcatccgatacctcgcaagtatcacgtgatacatggtagaaatcgtctgatacctcgcgagtatcacgtgatacgtggtagaaatcgtctgatacatgacaggtatcgcatgatacctcgtgagtatcacgcgatacgtggttgaaatcatctgatacctgacaggtttcacatgatacctcgcgagtatcacgtgatacgtggtagaaaatcgcatgatacctgataagtatcacatgatatttgcaggtatcacctgaaacgtgtgtagaatcgtctgatttctgataggtatcacacctgatacctattcgggatcatcctgttgtgtagaattgtctgatacctgataggtatcatacctgatacctactcaggatcatcccgttcgaaaatgggataccgttatatagcagcccccggagaaaaatcatgacttctggatagaagctatcttgccacgatacggtagcacgacaactcgagagaatctatcattaatgcgatggacatgctcaatagctggtgcatgcaccgcatgttcgcatccgaaagaagcatgaaatcccgtgagacatgtctataccattcttgagcaagcgaaaactccaggaactttaatttaatttctctacctaatgtcttattttaataattacatctattcttcttttttattttagatttattcttaatatcagtacccagctctaagtccttatattttaattaagagtaaagtccttatattttaaaacagagtgagtattttagttcttaatagtgcatttatttgctgtttgttgatattggtgtatttttctataagacgattaaaattagagaattttgactctcaacaaaactaaaattacttacaatatgaaatgggagtatatttcataacttcagagaaccttcactgaaaagaatcgatatggcccaaaaatgataaggacggagccacagaccgttgaagtatactcctttcattttttaaatagatgatgccgttgacttttggacacatgtttgatcatttgttttatttaaaaattttgtgcaaatgtataagatataaattatgcttaaagtcttttaataataaaacaactcacaataaaataaattataattatgtaaatttttgaataagatgaatggtcaaatgtgtgcttaaaaatcaacggcatcatgtattgcaaaataatagagggagcatttttttcttcgtgccccagaatgacaaggactatacacggaaccatggactgatgaactactggtctatttgtactccctcttcccttcagaaagcctcctttcattttttaaatagatgacgccgttgacttttggacacatgtttgatcatttgttttatttaaaaattttgtgcaaatgtataagatataaattatgcttaaagtcttttaataataaaacaactcacaataaaataaattataattatgtaaatttttgaataagatgaatggtcaaatgtgtgtttaaaaatcaacggcatcatgtattgcaaaataatagagggagcatttttttcttcgtgccccagaatgacaaggactatacacggaaccatggactgatgaactactggtctatttgtactccctcttcccttcagaaagcctgtactgtacctttatgagccgggtcccgctcctgaatcctaactagaactagaacacatgtactttataccggcttctgaataacatgtaaatctgtagagttagtacagtagatacatagcattataaaaacagaggaggaagtgtatttcggcttgttctttcctagccactctcctatccgactagatggattctaattgtccgaatgaacattcgcttgtatgtcaacaaaatgctttcaatatttttaaatgataagatagattaatatgtaatatttcgctccacaaacatgtaagttaaaattcaattttgtataaattgtaataaatataacaatttagacattaactagcatatgtatattcatgttaaatttgttatttttttactcataaaaatcaaatttaaacttatatgtttatggtgggtgatatattacattgttttgtttcttttcgtgctgactccgttctgacttccgaccacttcaccaaactgggctaattgaccgctttactattgaggcattgaccaccgtcttttgatccacaagttttcttcgtctccctctagagaacttttatattggcagaatatactatcaacaaattgtaccatagaagtcatcttgttaacgtgaaggaaaaccgtagtgcgatattaagtacgatgtgtattgctatcaataggaagcagcgatatataatattcatcagtttttaggtgaaaatctttgaagtgtaaaagtagtataattggggtataattacaatgtaactctcgtatgtaattgagtaaaacatgttggtgcttgactagctagggttgcaagcttgctactcccactagcgcacaaatgtgcgaattttttaatttcctctcttcacgcaaatctcggtacaatattccaacgatcaaaattcataagttttgaggggaaaacatcggcgtaattttttttagcaattccgatcaatgaatcaacgcaatgcccatcaagccatgaacatcgaaaataatgagtgaatgacaacgttgtaccgaccgcgccgatgtgcaatcctggtccaacaatgccctccgagcctcccctcaacatattttgctctacaaaagttctctactaactcggaagagcaccactcatcccacatcgatcgacgccaaactagctagctactagcaaattgaagccaagatgaagaagaccatggtgctctaccctggcctctctgtcagccacttcctcccgatgatgaagctcgccgacgagctcgtggagcacggatacgccgtcaccgtcgcactcatcgacgacccgctccaaaagcaaatcgccttcacggccaccgtcgaccgcgtcatctcgtccaagccctccatatgcttccacaggctaccacgcgtcgaccaccttcccgccgtcaccaccaacgacggcgaattctacctccccgggtatctggacctcgtgaggcgacacaacgagcccctccatggtttcctctcttcccatttccgcggaggcatacaggccctcgtcgtggatatgatgtccgtcgaagcgctcgacatagctgagaggctcaaggtccctggctacctcttccacccatcgaatgcaagcctttttgccttcttcctccagattccgtccatctgtgcagagagtaaacggagcttcagtgagctaggagacacccctctcgagatccctggcctccctcccatgccggcctcccacttcatcgacaatcggcccgaggagccgcctgagagtgaagtgtacaaggccgtgatggatttggttcgcaggtacactaataaatgctccaatggcttcctcgtgaacactgtcgactcgctggaggcacgggtggtgaacacgctcaggcacgcacgccgtcaaggcggccgggcgttgccgccgttctactgcgtcgggccgttggtcaacaaggccggcgaaaggggagagcgacccgagaggcacgagtgcctcgcatggctcgaccggcaaccggaccgcaccgtcgtgttcctctgctttggtagcaccggcattggcaaccactccacggagcagctcagggagatcgccgtcggcctggagaaatccggccaccgtttcctgtgggtggtgcgcgcccccgtcgtcagcgacgatcccgacaggccggacctcgacgcgctcctcccggcggggttcttggagcgaaccagtggccaaggcgccgtcgtcaagcaatgggcgccgcaggtggacgtgctccatcaccgggccaccggcgcgttcgtgacacactgtggatggaactcggtgttggaggggatcaccgcgggcgtgccaatgctgtgctggccgctccactcggagcagaagatgaacaaggttctcatggtggaggagatgggcatcgccgtggagatggtcgggtggcagcagggccttgtcacggccgaggaggtggaggccaaggtgaggctggtcatggagtccgaggcaggcgtcgagctcagggcgcgcgtcacggcgcacaaggaagccgcggccgtggcttggaccgacgttggctcgtcgcgcgctgcgttcacagagtttttatctaacgcagacagccgacagacatcgtgagttcgtggccgtatcgtgaactccggacatgggtggaggcataagtctaacgggtgaccgttcgagcgcagcccggacacgctagcgcattcggcccagtccacatgcattaggccaatcatgatatgctattccaagaaaaacgtactacctccgttttttaatagatgacaccgttgactttttctcacatgtttgaccatttgttttatttaaaaaatttacgtaattataatttattttgttatgagttgttttatcactcatagaactttaagtgtgtttatatcttatacatttgcataaaatttttgaataagacgaatggtcaaacatgtgagaaaaagtcaacggcgtcatctattaaaaaacggagggagtataaattttgttgtatatgtaaaatttatatatacttggtacttgctgaatacccataatttaccaaaaataaaaatatattataatattgtctaaaagaaatacagataagattcctataggatgtgttataatccttttgctatagtaaatattcaccttgttttggtttaatatatactccctccgtcccaaaaaagacaaaccctggtttccgtgcccaacatttgaccgtccgtcttatttgaaaaaattatgaaaaaaattaaaaagacaagtcacgcataaaatattaatcatgttttatcatctaacaacaatgaaaatacgaattataaaaaaatttcatataagacggacagtcaaagttggacacgcaaacccagggtttgtctttttttggggcggagggagtacgtggctatccattgaatttgattgtcttctaatattaagaagtagtaccccatcacatattatgagattcaccaatcacatgcgccttgttgtcacgtcgtctatctttgaaaagataattagttgtaaattgaagcaccgtaaatgcgaaatcaccatgtgcctcgctgtcgacgggtacatcatctaccactgaaagaataattagccataaatacgagcaccggtgccaaatctagaacttgtacctggatgaacacgttccaccaccagaaatataataaattgagttacactcacgttgtagatttgatagtaagttcaacaatactatctttgtcccaaaatataagatgatgtggcagagctatagtttctatggcaagctaaggtctggtaatgcgttaaatgtgacataactaacttgtgtcttggtaagttaggacaaccatccgaatagccccttatatttctttttctttatgtatcagagagtttcttctcacatcattgaggcgcactgtacacctaacagggaagtggatttcttttctgggaggacatctccttgttttgtagtgtttgaaaagtcatcaaaaaattataaaaaatgccaacaaatagatttgtatatgataatttttttacaaatatacaagttaaaattcgacttatacaattcagaaaaaacaacaaatttgatcacgaattacatgttctattcgtagtaaaatttgttattttttttccaattgtacaagttaatttgaacatgtatgtttatggagtggcatatcacatattgatatatcttaatttttttaatttttttaaatattttttcgggtgacataaaaaataaaggacatccccttaattcatgtagactttcccaccaaaaagaacttaaatggtaggagctcaggctcagcacccacccacccccacactacccatctcatcaaacagcgttccgaatcatcaatgatcgcgttcattcgtcgagctttaactgccaccaagctttcttctcccctcaaacgccagatcgtcgggagaccactcagtaatttccgacgtagactgcaaaccagctagaaaattcagagcccacaatgaagaagaccatcgtgctctaccccggggtcgccgtcagccacttcctccccatgatgcagctcgccgacgagctcgtcgaccacggttatgccgtcgccgtcgcgctcatcgaccccgccttccagcagcacaccgccttccctgccaccgtcgaccgcgtcgtctcatccaagcccaccgtacgcttccacaggctcccccgcgtcgagctccctcccgccaccgccaccgacgacggcgacttcctcctcctcgggtacctggacctcgtgaggcgacacaacgagtgcctccatgatttcctctgctccatgcttcccggaggcgtacacgccttcgtcgtggattctctctccgtcgaagcgctcgacgtcggcgagaggctcaacgtccccggcttcgtcttccacccggcgaacttgggcgcctttgccatcttcctccagcttccttcgatccgtgcagagggtgagccgagcttcagggagctaggagacaaccctctcgagctccctggcctccctcccatgccggcatctcacctcttctcccaatttctcgaacacccagagagtcaagtgtacaaggccatgatgaacgtgagccgcaggatgttaccgacttggaagagaagcaagatattttcagagaatcagagagaattcggaagaagaggagaagaaacagagagaaagacagagatgtagagagagagagagagagagattgagtttgtattgagttggaaattctgtctttacatgtcatcctcccgattctctctccctcctttatatacagctagttaacccagtttccacccttatacttcgggttgggcctagttacacgaacatgccgttgctgggccgtactctgaacagagccagcgatcttggacacttgttcctgttcatcatcaggtgtgccggtgccggatgtaacattcccccttccttgaaacacagcttgactccaagctgtggcagaaggaaagcgatgccttaactcctccagatcttcccaagaagtggtggaagacgaagtaccagaccaacgaactaaagcttgaacaatcatcttatcaccacgacgacgtagccgctgttgcagaacctctactggagtagccagatgcccagaatcaggatccaatcgtggtaatgttgattgaacaacttcagaagcagctactgctttcttcaattgagacacatgcaccactggatgaatcaaactggtagcaggtaattgcaacttataggcaacagaacccacacgctgaaggatctgaaagggcccatagaacttgaaagccagcttctgattagcacgagtcatgacaaattgctgcacataaggctgaagcttcataaaaacccaatcagcaaccgcaaacacacgatcagtacgcttagaatcagcctgactcttcattctttgttgagctcgaaccaaatgatgatgaatcaaactttgcatgttatgacgatcctgcatccaactatccaatgcactaggcaccccaaccgaatccactgagagcccaaaatgacgaggtttatgaccaaacattgcttcaaaaggagtcaacatcaaggcagaatgaaatgaagtgttgtaccaaaattgagcaagagataaccactgactccacctagatggacaagcatgaacaaaacagcgcagaaacatttccaaacattgattcacgcgctccgtttgcccatccgtttgtggatgataagaagagctcattcgtaattgagtgccagaacgccgaaacaattccttccaaaaaaatactggtgaacactcgatcacgatcagaaatgatggccagcggtagtccatgtattgaatgaattctgtccatgaataattgtgccacagacacagcagtgaatggatgggataaaggcaaaaaatgagcaaacttagtgaacttatccacaatcaccaaaatgctattataagaggctgaacggggcaatccttcaataaaatccattgatatgacttgccaagcatgttcaggtatttgaactggttgtagtaaccctggataaggcacatgttcaggtttagcttgttgacagactacacaactgtgcacaaaatcctgcacagtttgccttaaacctggccaagcaaacagctgcttaacgcgctgataagttacttgaattccagaatggccccctagagcagcagtgtgcaaatttgctagaacttgctgctgaaactgccgattattgcccacccaaacacgtttcttgaaataaagaataccattttgcaactcaaaatgagcagaatgaggtgtaccttccttaaaagaatgcaaaagctgaagagcttcgggatcagatttataacccgaaacaacatcctgtaaccaatccggtagaccaacagataatgcactcaaaattggaagaccatcagaagatctacgagataaagcatctgcagctccattctctaatcctttcttgtaaacaattcgataacgaagacccaacaacttagtcattgctttatgttgccaagaggtggttaatcgttggttatcaagaaaggccagactgcggtgatcagtgcgaattaaaaattcctcgtgttgtaaatacgagcgccaatgatcaacagcaagaataatagccagactttccttctcataagtggaaagaacttgagtccgaggtcctaaagccttactcaaaaatgccaccggatgctgatcttgcataagcacagcaccaattcctcggtcagaagcatcagtctccaccacaaacattttctggaaatcgggcatgaccaacaccggtgctgatatcagactctgtttcaaagtgtcaaaagctttttgatggtgttgagtccagataaaaggctgccctttacgcaatagctcagtaaatggcttactaatgatgccaaaatgtcggacaaacttgcgataataccctgcctaacctaggaagctgcacacatctttaacagatacaggaactggccattgccgaaccacctgaatcttttctggatctgttgaaactccatcagcactaataatgtgccctagataagacagttgagtctgtgcaaaagaacatttggataatttgactcgtaactgatgcttactcagagtctcaaacacctgacgcagatgattcttgtgctcctccaaagtgcgactgtataccaaaatgtcatcaacaaagaccaagacattttgacgcaattgatcagctaaaactgtattcatcaccccctggaaggtagctggagcactcgtaagtccgaagggaagcaccttgaattcaaaatgaccattgtgagttttaaaagctgtcttagcctcctcaccaactgccatccgaatttgatgataccctaaacgcaaatcaagcttagaaaaccagcaagctcccgccaattcatccattaactcatcaattattggaagaggatacttgtttttgacagtgatagcattaagatggcgataatccacacaaaacctccacgtgccatctttctttttgactaacaaaacaggagaagaaaaaggactagcacttggctgaataattcctttttgtaacatatccttaacttgtttttcgatctcatccttttgagcaggtgtataacggtaaggtctcacattaactggcacagccccaggaatcaaaggaattgtatggtcataatctcgagcaggaggtaatccacttggttcctcaaataaatgagagaattcctgtaccaaagactggacagcatctggaattgaggataactggtctgtagaatcactgagggcagcacataagtgaaccaaacctgccactgagtcgatactgtgcagatgctgtaaatgctgactagaaatcaaagcacaatcagacgtattggactgcaccccacgcaacaaaacttcatgacccataactatcaagtgaatagacttaagctgccaatcaatgtgcattggactatacttagttaaccaatccatgcctaatattgcatcataacctcccaaagccaccactttaaatgtggtcaagaacttctgaccactaacaaaccattcagcagaaggcatttctttctgacaatgcaacacctgtccattggccaccttaacagacagaggatgagctaagaactgaactccagtaagacggtcagccaattgatcactgacaaagctagccgaactaccagaatccacaagcatcagtatattcaacccctgaattttgccttgtaaccgaatggtagactgagaatcagtaccctgaacagcatgaactgacatagctaacaatgaagaatcactatcttcagaagatatgccagcctgatcctcatttacgttgtcaggaaatagtgcaaagagctcctgaacagcgtgaagctgaactgttcctgaacatttatgtgtcggcgaccacttttcggcacataagtaacacaaaccttgtgcacgacgaaacgatcgaagtgcactaaccttgtcagaaagattagtaccccgattgagctctccacccttcttctcctcagatttcagagccttggttggtggcaatggtaatggatatgcatttttaaacttctgcgatccatccccaaatttcctttgctcttgattccgctcagacaactcctcctgtaatagagccaaaaccagagcagactccaaatccttggggcaatgtaacaaaacagctttgcgaatgtcaaaacgcaacccttctatgaactggtgaaccaaattcaaagtgttatacataggatcatacgtcaacaactgattcatcagatcatcaaaccattcataaaactcgctcactgaaccggtttgtttaatctgatcaagctgtcgaatcagttgccgatgttgatttctatcgaattttcggttcaccgcttcacagaatcgaccccaatcgacaaaaacttcatgagcacgagatgaacgtagccaagacgctgccctccccatgaagtaaatggtggctacccaaacccacaaatttggatgagttccataaaccccaaaataatgctcacaacgcaacctccaaccctgtggatccgagccatcaaactgaggaaaatccaactttggtagtctatgattgaacccttgctccccatgcaaatcccgatttccccgactcgaatttgcgccaaactcaatcccatgaggaacagaaaattcagtgggaatttggtacgtacccttgaccggaggtggcccgagagtatgaactacccccgatgccttcccccggtgaaaatttgcgacgcggtggccatctggaccgagttcgctcgccgctgttccggaaaacaacggcggcgtgctgggcgtaggaagcagaggagtttggtgactcccttcctccgccatccttgacgcctgcgaggtgttcgacgaattgccgccctcctcgctctgcttctccaacttgaggacatgcagcttcagctcctccatgtcgtgctgcaacccttgtatagcagcatcaacttgaggtcgccatccagccacagatttgtccagtttgagcagcatctcttgtgtctctccttgcttgacgaccatggttccgatcgccgcttgaatctccaacaaagtcttctcgaatccctcgttttgcttcgccatgtcgtcgacttggatctgaagatgagttttgaactgaggtttctccaggattgcggctctgataccaaatgttaccgacttggaagagaagcaagatattttcagagaatcagagagagttcggaagaagaagaggagaacaaacagagagaaagacagagatgtagagagagagagagagatattgagtttgtattgagttggaaattctgtctttacatgtcatcctcccgattctctctccctcctttatatacagctagttaacccagtttccacccttatacttcgggttgggcctagttacacgaacaggccgttgctgggccgtactctgaacagagccagcgatcttggacacttgttcctgttcatcatcaggtgtcggatgtaacacaggaacgcgcaatgttccaaaggtttcctggtgaacacgttcgagtcgctggagccgcgggtggtgaacgcgctcagggactcgcggtgtcaccacggcggcccggcattgccgccgttctactgcatcaggccgttggtcgagaaggccgacgagaggagagatagagcagagaggcatgagtgccttgcgtggcttgacaggcaaccggaacgcagcgtcgtgttcctctgctttggcagcacaggcgcgggcagccactccgtggagcagctcagggagatcgccgtcggcctggagaagtccggccaaaggttcctgtgggtggtgcgcgcgcctcgcgtcgccatcgacgacgacgacgactcgttcaatccccgtgccgagccggacgtcgacgcactcctcccggcggggttcttggagcgaaccaccggccgcggcgtcgtcgtcaagctgtgggcgccacaggtggacgtgctctaccaccgggcgaccggcgcgtttgtgacgcactgtgggtggaactcggtgctggaggggatcaccgcgggcgtgccgatgctgtgctggccgctgcactcggagcagaagatgaacatggttcttatggtggaggagatggacatcgctgtggagatggccgggtggaagcagggccttgtcacggccgaggaattggaggccaaggtgaggctggtgatggagtccgaggcaggcagccagctcagggcgcgggtcacggcgcacaaggaaggcgcggccacggcctgggccgacggcggctcgtcgcgctcggcgtttgcccggttcatgtcggacatggaccgtacagccaacatccgctaggacaacgtgaattcgtgaccatccaagacacaggatattacgcctttccagagtatcgtgcatgacgctcgcccaaatctgtcctttcttttttttgtttctgattaagcctaatgacgttttcactccttttttagcaccattttcccctgaaacgtacgtgtgcgcaagaacgggtttccccgtgcacacggccacgcctacgtgttcattgaatattttctcattgtaaactttactaaatatgttttaaatgtatatgtagaaagtttccttataataatggaaaattaaaagtgctcgtgggcatgtgtaacatcccagcttatgacttaataggatttatagaatactcatatcaacaagttgcaacttttttccgaaagccgaacaccgactaggaaattcttcccgggtgcatacgagtggtttggggcaatttcgggatgggtgactgactggaaaattctttccggatacacacgaatgagggcagtctatgacatctgaaagctgccagatgtaagcgggcccggcctgggagaggcaagatgttacagcatgggaaagggaaaaggctgaaacgagaacataatattgatcattttgactttgatctatcgtacttttgagttcacaatctcactgtaaatttacgaagattttatccatcatataaatgctcatattttttaaattttttttatataagagtacgtcaaaatggttaacagtatggttttataaaattttagaatttacgtattaaaatttatatagtttttcttatttagaacataaattatgtgctacgtactaggagttttatgatatagtgctatcaatcataaaactcagatgatcataaaactcgaccaagagaacagacagaaggaaagaaaagcatatgatcacactgctatgatatagtgctatcaatcattcaagaatgcaataaacacagatgagtaaggccctgttattttcttatgaagattatgattttccctccatttccattagcatgcttttcaaactactgaacggtacgtttcgttatggaagttgctttaaaatatcacatatatccatttgtgcatcaactttatctccatcaacttggtctttatctcgttttatgtgaaaagcattggccccaacccgcaggcctacatgggctgcagaaagggctgtcagggattgcacgttagagtatctccaacaatctctctatcccactctccaagccaaaatttagccattatagacaaaaaaaaacgtattccagcagaatttctatccggcttgccaagccatccggctggctaaactcccccagtgagtggccagatttggccatgctatttggcttgctaatggtgagccccaccttccttctctccccgtctgcagccgctgtagttagtcccgtcgccgtagccgaggaaagcggaagtgggaggcgccccactgcggcgcgatagcaaggagggaggatggcgagccggagccgaagctttgccgccccgctgcccctaccctccctttccctgccctcttgcgccatctcccgtgctcgcctcgttcgccatctgcacaaccgccgttgtgccgtggtctggatcgccatccactcagttgcctatcgtcgctgaggtctgggccgccatccgccaccaccttcatcttcaccacctcccgtgctcacctctccgccaccatcgtcatcggggccgccatccccaccgccaacttcgctgtcggcgtccacggatatggatcggaggacctcgttggaggcagcgggtgcaccgacctcgagcgcattggggaatgctatggcggcgtgggcggggaccaggggtggcagtgtggcggtggggatgagagaggcggtggtatggagagagaggagaagaataggagagagggagaggaggggttgaaaaagggtagtgagcctaacatatgggactcactatttaggttggacagtgtaatagagagtctattggagtgaaatacaaatttggccatccaaatttttgacaaactggccaaatcaatatttagagtcaaatttgaagagactgttggagatgctcatacccaccagctcgatggagttgttgtgtacatatgtgtgtgaaatcgttgtaggaatcattgtcttgagttatatgtcgtgatgaacaattggccatggtgatggttagtccgattgttgaattgttgtggttgtgttggtgaagggtcggtgtacaggtggtccaaccagagcttaagtccgattagaccggatgcgcatgggcggccgaactgatggctgaggtgcaattagaccagaacattcttgattatattggattttgagttatttttttatgttaattccgtgatgtttatggcttccaattatttcgtatgtgtattgtgtttatgctaatgtgagtttaagttaggaaagtcggatatggtttcttcgtttcccatatataagtgttgcttaaggctgagaactgtctatggtggattggaattgacttaagtatagttgtcctaacgatcaagaagattatacaatatgctaaggctaaagattgaacaataaactggagatggagtttttgtttggcataagcgagatgtgtgtagataaaagaaaaagtcaaagttgaaaagagtactagctgaagtaggatttagggtttgaatttacaaagagataaaataatacatggtttgggaggcttttctatatatagaagtaggattcctaatttaagtaggattttggcttttgtggagtgcctttatgtacaaataaataaggttgagcatcaagaggtaacacttttttaaggtgaaaaattagggttatctttaggtcttgactctcgagttgagtttgaaagttgagagagaagtgcttggagacactttataaacacatcttgatgtaatataaagttgatcagcttattttgtcgagttgtgtttttgtcttctaccagttgtcttgcacgagcaccagcggttagactggaggaacactgactgtcagatcgagatcccatcaacagtcgaaccaacgatgtaaagatggtcagactaaaattccaacaccggtctaccaactttctgaagctagctcaaggaacgtattaatggatgaacaacccaacccttagggtccattctatattttagagctcggttctttcaacttaaaaaagatttttttttatgatctccttgttcaccttctctggtagtcttgcttcttatgcttaatcctacaatatgaactacatcgtgttaagtgattccatctaaaaacaatccactatttcccttaaattcagcatgtgctctgtgaagaggccaccaaccttgtttctccaccgttcccatatggtgatgaaatgcgcgattggagtctgtgttaatattatctactcgccgcgctcgatctcaatcccctttcagccgacgagcaggggcaatttggtctcatcaagtagaattccaacgaaaatggaattgaaaatgacgaaaatggagaaaatggcaaagtagctgtgatctcgcgctttagattggcattttagcgaaatgcgtttttgggatggcatttcagcgaaaccgctttttgaacgtggccaaatgtccattttctccatgggaaggggagctggtggtggcaggggagcgatggggcgaggggaagggaaggaaccgatgggggcgatgtgcggtggtgctggtggcgacaatggacttcaaaggaggagaaatgtgactgtggatctaggtttttgactgggagaagaagggtagagagaagggttttgtccccttttagcccgtgcaatccattttttctagcctattgtgcgctcgacttggtgagctaatctaaatttctgcccccgtgatgtaccctttgccgactgttggcgtgaaggcaattgttttgtcgacagataatacgttgcccatgaatcaccgacattttgtttgtctcaaaagactagaatcgccgacacataatacgttggcagtgctatatacatatttgcctacaaatgatgtgttctgtgtaccgacgttttgccaacagtagtagtcagttggtgaagatgggccatcatgtagtgattgtctaaaataaatataaataagtttacctatttaagtacagttatggatttccgtatccaacgtttgattgtccgttttatttaaaaagtttataaaaaattaaaaaaatagccatacataaagtactatttatgttttatcatctaataaaaaaaatattaatcatcaaaattttaaataagacagacggtcaaatattgaatataattggatataaacagtttaaaactatactcttctaggatagagccacggaggtaatattaaacttgctcctaggagagtatagtaccactacccacctcaccaaacagacccccatcataaatggctgatttaattgggctgtactccctccgtcccaaaaaaagataaaccctggtatccgcgcccaatgtttgaccgtccgttttatttgaaaaaattataaaaaaaataaaaagacaagtcatgcacaaagtattaatcatgttttatcatctaacaacaataaaaatacgaattataaaaaaatttcatataagacggatagttaaagttggacacgcaaatccagagtttaactttttttagggcggagggagtatatatggggcaatctagttctcttctcccctcaatcaaacgagccagaggtaggtcgggagaccactctacagtctaccctccagtgcctccacagtacaaactagccagaaaaattcaaagccaccatgaagaagaccatggttctctaccccggcctctccgtcagccacttcctccccatgatgcagttcgccgacgagctcatcgaccgcggctacgccatcaccgtcgcactcatcgaccccgtcttccagcagcacatcgccttccctgccaccgtcgaccgtgccatctcatccaagcccgccatacgcttccacaggctcccacgcgtcgagctccctccggccatcaccaccaaagacaacgacttctccctcctcgggtacttggacctcgtgaggcgacacaatgagtgcctccatgacttcctgtgctccatgcctcccggtggtgcacacgccctcgtcgtggaccctctgtccgtagaagccctcgacgttgccaagaggctcaacgttcccggctacgtcttccacccagggaacgccagcgccttcgccatccacctccagcttccattgatccgtgcagagggtcagccaagcttcagggagctaggagacacccctctcgagctccctggcctcccacccattccggtttcttacctctatgaggaacttctcgaggacccggagagcgaagtgtacaaggccatcgtggatttgtttcacagggatattcaagactccaatggcttcctgatgaacacgttcgagtcgctcgaggcacgggtggtgaacgcgctcagggacgcgcgccgtcacggcgacccggcggcgttgccgccgttctactgcgtcgggccattgatcgagaaggccggcgagaggagagagacagccgagaggcacgagtgcctcgcatggctcgaccggctgtgaaaatcagaggtgcagaagcgttgaacctcgttagtggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacagcccccctcaatcacaaccttcccaggttgagattgtgcttaaagttctctaactgtcttacaggcaaagccttggtaaaaccatcagcaacttgatctcctgtaggtacaaaatcaatctctaatagtttctgagatactctttctcgaacaaaatgatagtcaacttctatatgctttgttctggcatgaaaaacaggattagaagaaagatacttagctcccaaattatcacaccacaacttggccataggcggactctgcacttgtaattctgtcaataaagtctgtacccacataatttctgctgtagcattagcaagagctttgtattctgattcagtactagacctggaaactgtagcttgtttgcgtgcacaccaagatacaagattatctcccaaaaaaactgcaaaacctccagttgatcttctatcatcaagagatcctgcccagtctgcatctgaataagcactaacaagcatagacttggacttgcatagtttcaacccaagtttagtacactgtttcaaatatcttaagattctcttaactgcagcccaatgaacagtggttggtgcatgaagaaattgacagactttgttaactggaaaggcaatgtctggtctagtcagggttagatactgaagagcaccaactacacttctataatttgttgcatccagaggccctagtaagtcaccctcatgagcagataatttctcactagtagacaacggtgtacttactggtttacaatcaaacatatttacccttctcaggagatcacaagcatatttatcctgtgtaagaattatttcatctgttaccttgtttacttctatacccaggaagtaatgaagatctcccaaatctttcagggcaaactcctttttcaaatcctgcagaagagctgacactgcctcctgtctggagctagtgactattatatcatcaacatagataagaacaaatatgattagtcctcctttgttataaaagaataaagatgtatccccttttgatccttgaaaaccaagatcatataatttcttgctgagcctggaataccatgcccttggagcttgctttagcccataaagggctttatcaagcttgcacacatatccaggaaaagattcatcctcatatcctggtggttgtttcatgtatacctcttcttcaaggaatccatgaagaaaggcattctgtacatctagttgtctcatgcaccaacccctagacacagcaatagacaagacaatcctgatagtagcagctttgactactggactgaaagtatcttcataatctataccgtatctctgtttaaatccctttgcaactaggcgagctttatacctgtctagacttccatcttgttttcttttaattttatagacccacttgcagtctataacatttctaccttgcttaggtggaactaggtgccaagttttattattcatcaaagcctcatactctatatccatagcctttttccagtttgtattttgcaaagcatcagttaaattttttggttcaccagtcacagtaagaaaggtattcttgtatttaactgtgccatcggtatataccttctcttttcgaatacctctttgcagacgagtagttgggcgagacggcgcttgagtcacttcctcccctgtcgcgaacggctcggatgcagagatgtgtgatggtgacgggacatcatcattgctggcaggcgtcgcggtggcgtgactaggttggctcggcgaagagctgtcggccgagtgatgcgtcatcacgtcaggagaggcaggaaaatgtaccacgtccagggatgtggcagcgccgggttgactggcagcggtatctgatgcagacggtgatgcagcggtatcctgatggatctgttcagccagattttctgtggcaccggaagaatcatctgcttcatcattttctgcagaaacaggctgcacattgcttccaaaaatttgattagcaggattaacaggaatattagccatattgtcatctagctgttgttccccaggatttgatgttggatttaggagatgtgaaggaagcaataaaatttctgaacgaagtctagcaccggcgtttgtgtgaagtttagcaaagggaaaatttgtttcatcaaagataacatcacgggatatatagacacgacctgtggagggatcaagacacttgaaccccttgtgtagtgtgctgtaccccaaaaaagtgcactgctttgatctgaactgaagtttgtgtgtattatagggtctcagatgtggccaacaagcacagccgaacacccggagagaactataatctggggtttgattaaacaagtgctcaagcggtgtgaggaactgaagtagttttgtaggtgtcctattaataagatacacagcggcttgaaaagcttcatcccaaaattttagaggcatggaagaatatgcaagaagggtgagaccaacttctactatatgtctatgctttcgttcagctgagccattttgttgatgagtatgtggacaagaaacgtgatgtgtgattcctatctttgtaaagaaggagtgaagtttttcatattcacctccccagtcggattgcatggctattatcttcctattaaacaaacgttcaacaagagcttggaattcatgaaacttttggatgacttcagacttatgcttaatcaaataaagccaagtaaatttactataatcaccaataaagctcacataatattgtttgcccccaacagaagtgagggcaggaccccaaacatcagaataaataagttccaaaggatgactcgacatactagaagatctagaatagggcaattgatgacttttaccctgttgacatgcatcacaaaccgactgtttatttgactcagctaaacaaggaagattatttttgctaatgactttctccacaattggagaggctggatgacccaggcgactgtgccatcgctcaaaggatggcttgatggctccaaaggcttcttttagaggacgaggacgttcatgaggtgatgaagatggaagagcgtacagtcgcccccggcatggtcccctaaacagaagtttcttcgtggccagatccttaagattaaaatatttagagtaaagctccatgtaagcagaattatcagagacaagtctattggcagaaacaagattcttatttgcattgggaacatataggatattgcgaagatgaatatcacgatttggggttctaacagtagaatgaccaatatgactaatttccatacctgcaccgcttgcggtgtgaacttgatcttgccccttgtagcgatcgcgaaccgtgagcttgtccagttcgccagtcacatggtccgtcgcactcgtgtcgacgtaccaatttgtatcaatcccataagatgttgccgatcctgcatatttttcatcgggaacaaaatcttcatcatagcgataccagcagttgattaccgtgtgtcccctcttgtaacagagttgacatttaggtctgttgtcgacgcctcccggtggtcgtgcgccgccattgttgccgcgtcccctgccgcggttagcgccattgttgttgccgccacggccgcggccgccgttgccggtgttgccgccgcgttgttgtcctccaccaccgccacgtcctcggttcgccaaattgacagaagagtctccaccgtgacgaagcgcgagacgctgctcaaagctgagcagctgagagtaggcttctcccagcgtcatggtgtccttgccaacgatggtggagatgacaggttcatacgtgtcgtcgaggccggcgatgatgtaggagatgagatcatcgtcatcaacgatcttgccggcagccgtcatctcatcagcgagggccttcatcttggagacatactcgttgatggagagagtgcccttcttggtgttggagagagcgatgcgagtgttgatgaagcgcgccctcgtgacggaggagtacatctcctccagcatctgccatgctgctgcagccgtgccgcaggtggccacctgtgccagaacgtctctagctagggtggagagcaggaatcctagaacctgctgatcggttgcaacccaatcatcaaattctggattgcgaacagtgacttctttctctcccttgtcgcctgctgtcgtcgtgatcagggcgttgggagttttggtggcaccggtgagatgcccctcaaggcgagctcctcgtacagccgccatgacctgcgctttccatagcgcatggtttgatttggagagtttctccgagatcgcgttcccgccgagaggattcccggccgccgtcttcgacgaactcgccatgagttggattagatgcgattttgtggatggataggctctgataccatgtgaaaatcagaggtgcagaagcgttgaacctcgttagaggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacaccggcaaccggaccgcagcgtcgtgttcctctgctttggtagcaccggcacgggcaaccactccaaaaagcagctcaaggagattgccgtcgggctagagaaatccggccaccggtttctgtgggtagtgcgcgcccccatcgtcgtcaataacgatccggagaaaccatacgaccctcgggccgatccggacctcgaagcgctcctcccggcggggttcttggagcgaaccagtggccagggcgccgtagtcaagcaatgggcgccgcaggtggacgtgctccatcaccgggcgactggcgcgttcgtgacgcactctggatggaactcggtgctggaggggatcaccgcgggtgtgccaatgctgtgctggccgctctactctgagcagaagatgaacaaggttctcatggtggaggacatgggcatcgctgtggagatggtcgggtggcagcagggccttgtcacggcagaggaggtcgaggccaaggtgaggctggtcatggaatccgaggcaggcaaccaactcagggcgcgggtcacgacgcacaaggaagccgcagccgttgcatggggcgacggcggatcgtcgcgcgcggcgtttgccgagttcctgttggatgcagacagccgacagtctcactagggcacctatggatctggcacatctaccttcaattcaaacatactatgtatctttgttattgttatatgagtccgataaactttaaaataagtattttatcattgacacgtgatgtgataaaccatgaattcacgtatcaacatgataaaggcacggtggcttttaagtcagaggatctcaatccaacatctatttgtcttttaattttttgtgttgtctaaaatactataaaaaaattatcgtttaatttaataagttagatcgatatatgtgatatatcactatacaaataagaaaaaataaaattaatttatacaattaaaaaacaaacaaatttgactcccaatttaacgcatagttccagtaaaaattgttttttttctaacgtgcagatccaattttagcttataggtttagaccccgtttagttcctaaatttttttcccaaaaatatcacatcgaatctttgaacacatgcatgaagcattaaatatagataaataaaaaactaattatataattaggggggaaatcgtgagacgaatcttttgagcctaattaatccatgattagccataagtgctacagtaacgcacatacgctaatgacggattaattaggctcaagagattcgtcttgcggtttccaggcgtgttatgaaattatttttttcatacgtgtccgaaaagcccttccgacgttcggtcaaacatccgatgtgacacccaaaaatttttctttacgcgaactattatgcagtggcatatcatatattcatctatcttcatacacacgatataaacaagaagatatcctctggtaggttaaaaattcatcactatagtactttctcagtcctaaaatatagctatttttagcacagtaccttgtcccaaaatgaagctatttttccaactacctcctctcaaccaatcacaatcattctccttcacctactttttcttttcaaccaattacacaccttctctaatcattctcacatacttttttaaataccagtaccaaccttaaaaatacctacattttaaaacggaggaattatttatcaccctatccatctacatgtgccctccgtcccagaataaccgtttcaggaattgtcacttcagttcagattttttgtccctaacccagcaggccagttagtactcacacgtgaacgttcctgctcgctgttcgtaatacggtagatgcgttttttttttaatctccaggatcagaaatgataccaccagtctcagaagatagtacatgtagatgagttaaatttccccccaaaaaaagttaaatttgttattttatatttattactcatatattaaatttgaatttaaatgtttatggaatgacatatattatattgatatatcatgtcagttttttaaatatatatataataactatttgaatactacctctgtctcaaaaagtagttttgcactacttatataccacatttgaccgtccgttttatttgaaaaaaatatgattcgtatttttgttgttattagataataaaacatgcatagtactttatgtgtgactaatttcttttaaattttttatattttttagataagacgggcggtcaaacgttgaacacagaaatccacaactacaattaatatgggacggaggtagtaccatatacttcctccgtccaaaaaaaataatctagtattagtattagatgtgatatttttaagtacaacgaatttagacaaaagtctgtctagattcattgttgtattagaaaatgtccaatccaactaatttaacttatacaagttgatacaaaaataacatatttaactttgtatttaatgtgaattttcacattcaaaattattattttgtttatacactatgaatttaatgtggattttcacattcaaatttattattttggtttctaattgtatagatggaatttgaacttgctcgtgtatagtcagtcatatatcacatatgaatctatcttattaatttttttaaaaaaaataatgactttttaatcgacatgcacaaaacgagtaatgtctcatatgaaaaaaaaatccagcaccatctacacgtaaccctcaatcctcccaatacaatataacgaagccaatcccaacaaggcgacatggggcatgtaacggccggggctacaaaccgtgtaaaaaatgaagggattatcttaaaaaaaactgctgcaagttaatggctccgaatagtttttttttgtcttttttgttttcgttggatatacttccgtatcggtttccaaaaattgtcttaattattccctccatatttattttgagatagaggttgtagctcggttcggatccgttttgtagcaagttacccggccggtattcaactgctcgctgtttgtagtaatacgggaagatgtgattttctttttaatctccaggataaaaatgatacagcggtcgagctttggttggaggaaggactacagcctacagggaaaacgccgtttgcctttgtccattgaatgcttttgttgtggtcggtcaccttcgatcggatgcatttctgattctttcttcttggaaaagaagggctaaagattgtcctacggggctcggtgctgtagtatgggacaaaggcagaggatgtgaacccgtatgactttatttctaactctgtatcacgatcaccggactaattgactttcccgactaataataaactctatcacgatctctatctgattcgtcgtgtccttattttactcctgtagacatcaccactgacggcggttcctaaaaacaatcaggcttgtgaatctcgaggcctaccggccaattaatttaatcacatctgttagttggtggcggcacagacgaacgactagaagccatcgatgtgtatcctgccttgcctgcgtgtgatgatcatactgtgatcccatcttgtgcagtactccatccgtttcacaatataatcattttagcattttacactttcatattgatgttaatgaatctagatatatatatttatctagatttattaatgtcaatatgaatatgaaaaagctagaatgacttacattgtgaaacgaaggaagtagtatacgccagacgtgagctctcttccttcctcgtctaccagtttactgaactgctgactttagtgaaagagtagtcctcataattcctccaaaactttataaagccaacgtgaaatttgtgttggttatgcaggtcacattggggcgtgtcaacgttgctcaccatggcttaccatacaacccctctatatatacttgtggctgtccgatttgagggcatttgtttccgtcttttttacatcccgtttgatcggaagttcggaacagcagcgagccatgacgacaaagacctttgtgctgttcccgtcgctgggcgtcggccacctgaaccccatggtggagctagccaagcacctgcgccgccgcggcctcggcgtcatcgtcgcggtgatcgatccgcccaacaacgacgccatgtcggccgacgcgatggcgcgcctcgccgcgggcaacccttccgtcacgttccgcatcctgccggcgccggccagcccggaccccggcgcgcaccatgtcaagcgcaacctcgacacgctccggctcgccaaccccgtgctccgcgagttcctccgctcgctgcccgccgtcgacgcactcctgctcgacatgttctgcgtcgacgcgctcgacgtcgcggccgagctcgccatccccgcctacttcttctttccctccccggccagcgtcctcgccgtcttttcccacctcccgtattactaccgcaacgcgccgtcgttgagggagatggataaggcggcgctcatccgatttcccggcattccgccgatccgcaacgtcgacatgctggcgacggtgaaggacaaggagagcgagacgaccaagatcaggttgtaccagttcaagcggatgatggaagggaagggcgtgctggtgaacagcttcgactggctggagcccaaggctctgaaagcgctcgccgccggtgtctgcgtgcccaacgagcccaagcagagagtctacttcatcgggccactggtcgacgcccgcaagaaggtagggagcggcgccgagaggcacgcgtgcctcgcgtggcttgacgcccagccgcaacggagcgtcgtgttcctctgcttcggcagccagggcgcgttcccggcggcgcagctgaaggagttagctcatgggctggagagctccggccaccgattcctgtggaccgtgaggagcccaccggaggagcagtccacatcaccggagccggacctggagcggctgcttccggcggggttcttggagaggacgaagggcagaggcatggtggtcaagaactgggtgccacaggcggaggtggtgcagcacgaggcggtaggcgcgttcgtgacgcactgcgggtggaactcgacgctggaggcgatcatgtcggcgctgccgatgatatgctggccgctgtacgcggagcaggcgatgaacaaggtgatcatggtggaggaaatgaagatcgccgtgtcgcttgacgggtacgaggaaggagggttggtgaaggccgaggaagtggaggctaaggtgaggctggtgatggaggccgaggaagggaggaagctcagggagaggctggtggagacgagggacatggcgttagatgccatcaaggaggctgggtcttctgaagtggcatttgatgagttcatgagagatttggagaagagcagcttggagaatggagttcgcagctgatcaagcagagtatgggtcatgactgcattagtgtaccaatggcgtcagttaccacatgaaatgtttgcgatttttgttaagttagaagcaaagttgtccgcatagcgatgtttttttcgtcctccgatgacggacgcaattgtctcccgtgtccaaaagttgcagtgtcaaccatttctgtataagcaaattaaaataatgcatagtcttcaaacctgaccaatactagcgaccaattattcagagccacacaaacaacatgaacccactagactggaaatcactggctctagtcaaatgcaaattctctaagctaactgaaatgcgaaattaaaaaataaggaatactagaagaagagtatagagtccatatagaaatacaatttaaaaaatagaaaataggaaataaaaaaaggaatattagaagaagagtatagaatccctacaggaatttagaattgaataaatttcagaataaaaataataaaattaaaagtagagcttagagtccatatagaaataaaatttgcaaataactaatattcaaaattaaaaaaataatatgggaagaagagtttataattcatataggaatataatttagacatactgaaattcgaaatttaaaaaataaagaatattgaaagatgagtttagagtccacatagaaatacaattagagatcattgaattcagaattaaaaataaataatattagaagaagagcctagagtctatgtagaaatataatttacaaataacaaaaattcagaattaaaaaataagaaatattaaaaagacgagtctacagtccatatagaaatacaatttagaaataactaaaatttaatattaaaaataattaataactatcacgtatatacagtacaacatgaatattacacattgatagtttggtaaagttagtacaaaatttaaaattatgttatcattttaatatattttaataaaaaaagaaaatataataatgctagcctcgcaatttgcgcaaacctctatactagttcttattaattttttaactcatccctaattatatggatctggtccgttacaccgtacagaataaaaactttcttttcttcgtcattgctcacgaaaacggccgtgacgtgagctacctggtctctccttcctcacgtagacttctacaaagcccatgtgaaatttgtgtcgatcatgcaactcaccgtgaaacgtttcaatgttgctcgccatggccttctttgccaagaaatgggttaccattcaacgccgctcgcactatttagcttgtgggttgcgagattatattggtaagccaatttgagagcatttgctacgtttttatgcatactgtttgatcggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccgtgctccgggagttcctccgctcgctgcccgccgtcgacgcactcctgctcgacatgttctgcgtcgacgcgctcgacgtcgcggccgagctcgccatccccgcgtacttcttcttcccatcccaggccagcgcccttgccgtctttctccacctcccgtattactaccccaatctgccgacatttatggagatgggcaaggcggcgctcctccgctttcccgggatgccgccgatccgcaccgtcgacatgccggcgatgttgcgggacaaggatagcgaggcgaccaaggttaggttgtatcaattcaagcggatgacggaagcgaagggcgtgctggtgaacagcttcgactggctgcagcccaaggccctgaaagcgctcgccgccggcgtctgcgttcccgacaagcccacgccgagggtctactgcatcgggccactggtcgacgccggcaggaaatcaaggatcggcggcgagaggcacgcgtgcctcgcgtggctggacgcccagccgcggcggagcgtcgtgttcctctgcttcggcagccagggcgcgttcccggaggcgcagctgttggagatagctcgtgggctggagagctccggccaccgattcctgtggaccgtgaggagcccaccggaggagcagtccacatcaccggagccggacctggagcgactgcttccggcggggttcttggagaggacgaaggacagaggcatggtggtcaagaactgggtgccacaggcggaggtggtgcagcacgaggcggtcggcgcgttcgtgacgcactgcgggtggaactcgacgctggaggcgatcatgtcggcgctgccgatgatatgttggccgctgtacgcggagcaggcgatgaacaaggtgatcatggtggaggagatgaagatcgccgtgtcgcttgacgggtacgaggaaggagggttggtgaaggctgaggaagtggaggcgaaggtgaggctggtgatggagaccgaggaagggaggaagctcagggagaaactggtggagacgagggacatggcgttggatgccatcacggaaggtggatcttctgaaatggcatttgataagttcatgagagatttggaggagagcagcttggagaatggagttcgtagctgattaagcagagtaaggctcacgattgcattagtgtatcaatggcgtcagttaccatgaaatgtttgcgatttttgctacggaattgctattaagttcagaagcacagtagtgcgcatagtgatgttcttttcatcctccaatgacggatgccattgtctctcgtgtccaaaagttgcagtgtcaaccatttctgtataagaagattaaaataatgcagtcttcaaacctgaccaatactaacgaccaattattcagagccacacaaacaacatgaacccactagcgtggaaatcactggctctagtcaaatgcaaattctctacgctaattgttagtcatccaaaatagtcctgagtaggctagagaatagagatagcgcaggatggacagtgacaacttacaagaggatggaaccatcactgaaattcaggtgcctgggaataccaaagaaggtaaaaatcatgtcttctttttttttttttttgaaacgaaaaaaaaaatcatgtcttcctctctggccatacttgtcaattaggaaatctggaagtaacagaccgctagcaccagatgctgcgtggtttaaccttattgaacgaaacctaaacaagtttctgctagtccataatgggtgtaagttgaaactgaagcactgaatctgctaacctgactaactgtgacaacctgcaataaaacaccaaatcggacagagcataattcagagcaaaagtgtcacctctcagcagcaatcttgtcgagtcgccgatcaggcacaagggatcatccctgatcatcttcgacgcttcatcatttgcagcgctgcaaatcatccacgaaatcagagaacgccgtgcacgacggcccgccgtctgccagcgcctccgcggccatctccttcgccattgccagccttcctctgagcttcttgccttcgtcggagtccatcaccagcctcaccttcttctccacttcctctgccttgacgagctcctcgtcgtagccgtccatcaccaccccgagctgcatcccgtccaccacgagcaccttgttcagcctctgctcggcgtactgcggccagcacagcatcggaactccggccgtcgccgcctccaggatggagttccacccgcagtgcgtcacgaacgcggcggtcgcggcgtgccggagcacctccacctgcggcgcccacgacatcaccaccattcccctctccctcgtcctctccaagaacttctccgggagcagagcacccaggtctggctcagaacgcggcagggagaacttggccgggtcctccggtggtgggctccgtaccacccagaggaaacggtggccggaattctctagcccacgagcaatctccttcagctgctccgccgagacggcgcccatgctgccgaagctgacgaacacgacgctccgctccggctgcgcgtcaagccacgcgaggcatgcgtggcgctctcctttcgccgcgtcctcgcccttcacgatcagtggcccgatgcagtacaccggcggcgtggggcggtcgggcacgcacgcgccgtccccgagcgccgtcacggccttcgcctccagccattcgtaggtgttgatcagcatgccccgcgcctccggcatgcggcggtagtgatagaccagcgaagcaccgatcacgtccgcgcagtcgagcacgttgtgcggcatgtccgacgccgggatcggagggacgccgggaaagtggaggagcgccttccccatgtccttcaagtcgccctccgtggtggcgaagtagtgggggaggtggaggaacgcggcgaggacccccgcggaggaggtgaagtagaagtacgccgggacgccgaccgccgcggcggcgtcgagggcgtcgacgcagaagaggtccagcacgacggcggcgacgggcgggagggagcggaggaaggtcagaaggattggcacggtgaggcggatcacgtcgagcagctgctggaagccgtcagggtccggctcggggtagtccggaggcgggaggttgtggaaggagatggaagggttggcggcggcgatgcgcgccaccgcgggggccgacgaggcggcgacgtcggcggtggaagccggaggggtcgggacagcgatgatgactgcgaatccacggccgaggaagagcttggcgagctccaccatgggggcgagatggccggcgccaaggatggtgtgcagcaccacggtctgactctgttttgaattgggctccattagagcgagccggcgacacggtgagtctatgcgagtgttaagggaggtgccttctcgcgaaccacttgaggggagagtttaagcctcggttgctcgtataatttctacaaaacttcaatgctcagcctacaggtttgaaactcgcactgtgcgctgctatataacggaatcccgttttcaaacgggatgatcccgagcaggtatcaggtgtgatacctatcagatatcagatgattctacacaataggatgatcccgagtacgtatggtgtgatacctatcaggtatcagacgattctacacacgtttcaggtgatacttgcaagtatcatgtgatacttatcaggtatcatgcgatttctaccacgtatcgcgtgatactcgcgaggtatcatgtgaaacctgtcaggtatcagacgatttcaatcacgtatcgcgtgatactcacgaggtatcatgcgatacctgtcgtgtatcagacgatttctatcacgtattgcgtgatactcgcgaggtatcatgtgatacttgtcaggtatcagacgatttctaccatgtatcgcgtgatacttgcgaggtatcggatgatacctaccaagtatcaggtgattcctactggatatagctgggcatcctgttgggggaggagcacctcgacacgcgcggtcagtaccctgcagccgtccctcgtaaacgaggacggcggcggtggcggcagcgggggacgggcgcggcggcggcggcggcggtggcggcggcggcagaggcggaggcgaggggggacagtcgcggcagcggcgggggacgacgacggcagcgagtgagcaggaatcgcgttgtggaggaggagctatcccgttcggggacgggataccgtcccctagcattcccgatgatttaagcttacaagagtactactccgtggattctacagaaaaggggatacacatcgctcattgctgacctcaattttcattcctgccaaattgctgtcagttatcgtgtattctccagcccaagagtgtccatgagtgtacagttgtacatagggagtgaattttcatccctggaggggatatccactcgttgtttgcatatcactcaaatggttatgaaaaaaattgaaaaaaattaagaagatgtattaacat

SEQ ID NO: 71653 - DNA, 1979 bp, Oryza sativa
ttcctgcagccccatcattcatagttgccgtgggggagaacattttctggagcgggccatgtctacttcaagtccatttctccgatatacattccctcttccgtaggaagagactggacgccaatttgatcgctatctggtgtctgtaagtgctagacttgaacgtgttaataaatcactatacctatatgcgtagctcatttgatcatccattgttggcaggatgaattacgtggaaatcgaagcggtgagaaagcctgtcggctatctaaacccgtgcaggataagtcagtcgaaccacacatacaggctagacgagaagaagctaccggaacacatcaaggcgatgactcccgaagagaagacagcttacataggacaaaggcatcaggaaaagctgctcgatgtcgctacttacgtagcaatagcgcttgaatctgcgcaggacaaggagtgcgttcatgccctgtatgcctttgagtaagttttaatatccattaagagtatatacatataatcacggctcaactaacaattttgtttgcagcgaccattggatagtctttcttctctatccaaagtacaatgaagtcatcgtcttagattctctcgacaaagacggcaagacatatcaggaatttctaagaattatcgatctgtaagttatatattatcgtaacgtgtttcaatcttcgaggaatgtaaattaattatatctgcaaatagtgcatttaaaaggtattaccagcaaggcggacaacacaaaaactcaagagaacgcatatggatgctgaacagtactacttaattttcataaatgcatgtgtctatccatttgataacctaatataccttataattaattgatgtcgaaagtgtcacaagcaaccggtgggaaccgtactatgcggatattacacctgcgagttcctaagggttaatgggaaatattacgtgaattacgacgaggaaagtaatacacacttgttaaattaatcgctaacttgtattatggcgaataatttccttaatttttcgtgatctgatgcagcttccaaaattcctaagtctgaaagagagctcgacgataaatccattgagaacatacagcgggacatgtgctacttcattcaccgtgagtgcgcacatcagcttgggaagtttttttgacaaggatggagttttgagcctgccggagaacaaaaccctgtctaactggagtaggagtttaatatagccagggtttctcgtgatctagatgcagctagcttgtatatgtcgtcggacggttttgtaagacattcaattacttgtatatgttatgtcgtcggtcgaattttgtcaatgtacatataggtgcttcgaaattatatatatgtatattattatgcttcatactccgtgtgtggctctaaaatacttgaaagagaacataatctatcgatagctcaattagttataacatccacgtgtgactctgaaatacgcgcacaaacaaaagtaaaaataatatatataatattgtttttaattttttttaaaaaaattacaccttcacaggcaggccacgtgtcagaagtcgggcagtccatatcttcgccatcgggccacgtgtccccttaggtcatttttcctagcgggccacatggcctaaaatactgtaagctgccagcgaagaaatatcttcgctgtcggccgtcctaaggctaccacaagcgaagatacttcttcgctggtggctggcttaattatgtccgccaccagtgaagaaatatcttcgctagcggccgtcctaagaccaccaccagcgaagatatgtcttcgctggcggcggacagaggacgggggggcgccaggggagctggtgcggccgcccgggcggaggtgcgccggccgccggcgaagaaggagcggggcttgtggtagccttaggacggccgacagcgaagatatttcttcgctggcagcttacagtattt

SEQ ID NO: 71654 - DNA, 4733 bp, Oryza sativa
tgcaaatttcgttgacgcccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataataaaaattataaataaaaaaaattcatgccacgaatgggcgcatcatgggctgggttaggtgctcttgcacaaaaggcccaagcaagcccaagtgatagggaacaaaagcttgtgcagctgaatttatgggcatcgaatagaagaaaggcattagaggctcgggagtggtgatctggttacgcatgaattgaaccttgtgaatgtctctatccctctcaactcctcatactatctcttctataatgttctagaaccttctagaatcatgtatagcttatttcttaccactttccaacaaatacatgtgattgagttgaattagagattgttgctatttaatttggtgaagaaggttgctaacatatatctgaggtataacaaagaaaaatggaaatggcagtgtagatggtatataaaacatatatactccagctcgtagttttacagacttacggttagtgaagtacaaattgacatagcccattctcgtcttttagaaagtttagacctgagtaaatataaagttgataaacataatactatactaatatattagccaatcaaaagaaataaatgcttctagataaacatggaaattatgatcataaatagtccttaaaccacagtgaatactaaatttggtactactcagattattgagaaatatatgtaatttgagccattctttctgtcatcacagtactggaataacatgtttatttttagcttggacatagaatatggtttaagaacaaaattaaaatagcaatatatatgatgccagaggtgacaggagaaaacgattaagatgtgtcttcttcatgttaactggacagcccaggcagcatatgcttgcgaccgtcgttccattcccaatacctgtaccattcttacatatttaatttatagaataaatttctgtctacttttaacttctagatacattgtaaggtttgtttcctttttttttctatcttgtcacctcaatttctggagattgaatcaggggagtggagcagaaattgttatggtaagataacgatcttgaaaggtgaagcagttttctgaacagatgccaacatgcgtatacatggatggctagctctgctctgctaggcttgaggctgtaggtgctcaccaatacttattactgtttcagacttggactacaaatttatcgcaaattaagcccgtcgcttgtaatgtactcctcgtcactgtgattctgtgagttactaacttaatattcattactacacaaatcattttttgtaaagggggccattaggttgcaggcgagccacttgtgtatggggagagctgtggagattgtgatagcaaatagctagaatggtgacatttgagagcagcaatagctggtagttgtgtatgaattccaattgtgtatggcattttggtttatatatcttttgttcattattggactcgaagacaattaggactaccattatattttgccaagacaactgtcatagtctgtttcagcctacttgccaatctacagccagaataccctcagagtgaattaccaccatcaccagttgatatagtttgcattcctaaatgatgttgctaggaaggattgctcgctcctcgaaccttatatggaacagttttatttcagagtttccattcacatatctataatacagatttgagtatactttgggtcatcttttattactcgtgtttcatattggaccacccttcaactaattttttcactttcgaccgggtaattttacctttatggtactttggatcactctcaactcttttatccatttatatccaatttgtcatatgtcaaagtaacggtcaacatatatagctgatggagtttattacgaataggagctggtgtagttgatggtcgttcatatggttaagaagcaagtcggagtgcttcaaagtgaaataattgcaagattactcggtctaaagtgaaaacattagctgaatggtggtctaaagaaaaacgccggcataaaagatagtataaggtgatcttagtactagtctaggctatagttaaacaaatagttttactcattcatcattcatcatgtcacatatccaattatccaaattaatctgatgagtcgtatcggacggcatcgacgcctccctcccgatcgcgcccctcccacgccccctccccatgcacctcctcctcccacaaccctcccagaaaccgcacctccctcccacgcctccctccgccgtctccgccgctgacgccggaaaccgccccaatctcctcccccttttcattcgcacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcatagcgcaaatcgtcatcctgcatcgtcgattccccatgcctcgatctcccgttgggcttcctgccgctcgccattgaccatcgcccatggctcctccaagagtcaccgccgaatccggttctttcatcttatgatggtttgcctgttctctgcagttcagcttggtagatcagtttagcgttgagaagcaagctgttaaaacatccacttaatgcagaagaggtcataagctccactcctgaaaattccacattttttagatatcctcacattattcaccctatatatgttttcagttgttcctgtatatttggtacactattctcgtttaagttgtatgtcagttcaaatagaatctggagcgatgctaacttatggtgccagcttcgaaatttgattgctcatggagacaggggacagattattattttgtctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcagtcaacaagagacgataaaggactatttttgcatgtgctcttttgcttggagtattgtgtgattatatagctgattgagctatgtttagaaaactgaacttcccagaactaaaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcgttgtttaaaaaatgaaatgaaaactgctatccatgttgactccatcgattcatttatcagatcagggggtttgaatgaataaggatatctatgctgttcatgaagtgcataatggatggtgtgatcctctttaatcatactgcttccttcagagttcagatacaaggtagaatcttttacgctactttcagcttaattgattgattcattttcgtatttgacttgcagggcctaaccatggtaactaatgatgcacagctgctttgctccagggtgaaccctcactctgctggttggatttcagccgtggattagcaactggttcatgttctgaaatttttataataaccatcctcactctgtagtatttgaaatcaacctttcagtttattctgaatttttatgcataatataaccatgccagtattttggaatgagtgtagaatttgatccgtcggttctgaagaaacccggttacttattagaagaagcagagaccacaacctggcagtggctggtcacttcagtggtctccaattgcatgtacgtcttaaaaaggatgtttggattacaagtatctatggtatagtagaaacctaaaattagatgtacgaaggtacgtaaaaaagcaagaaaaaattgagttgcaacttcgaaagaaatatactgtttcttcaattagggctatctacatcagctgcatttgagagatatccgaactgttgtagttcaaggaagcatttgaaataaaaattctggtaacagccttaaattaattgagagaaatatcctaattagggcacacaggatcagttggatctgttgagtttcataaagaagaggtgcttgtgcgttcatcaaatagctcggacgaagctgtattttcgctcttgtctgctagcaagccatctaaaaagtcaaagcgtatcgtcacatatttgaaaatgtgtttataaattttcagtaacttgctttgtaagggaaaaacaccaaagtttctgtgcatttgcttcgaacatttggttctgcagtactgttgactataaaatacagctcaacagaactttattttctcacatttctcataacaagttggatatggaaaaccatcgactctcataaaagactacgcgcaattattaaactcaaatctattttaaagcatgtgaataggagacag

SEQ ID NO: 71655 - DNA, 6976 bp, Oryza sativa
cccccccccccccccccccgagggggtcaggccacgtgggtgaccgcggctacccaagcctctagtcacgatacccccggccccatgtcaccgacaatatgtatatatatatatatgtatatatatgtatatacatgtatatgtatatatatgtatatacatgtatatgtatatagatgtatatacatgtatatatatatatatatacatgtatatatatatatatatatatatatatatagatatatatatgtatatatatatatatatatgtataatgtatatatacatacatatatatacatacatatatatatacacatatatacatacatatatatacatatacatacaaacatatatatacatacatatatatatggcaacatatcctatgcacacaggccctcacgtgtacacacgtgcacaccaactaaaaaatgtcaccaaaaaatctagaaaaaatcatacatatactttcaattgtattacacccagggttaaaatcttaacgtcaaattcattatattttagccgtaacaaaaaaacaaaaaaactgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcatgtgtgcataggatacgctccctatatatatatatagttagactattctatacccccctcccctcccaatttccccccaccccacgcgcctccccctccccacccgagtgctcctcgcgattcctcctcccccccacccccggagcgctcactcctcctccctccttttttgagagaaaaaaaataaaggaaaaatttgccttcaatgggaatagaactcaagaccttcaactcaaattaacacatggcactaaccaataggctatttcttagttgtgatagagttttcttagtaaaacttatcttctcatacatcacgaaatatagtagcgcgtccggttactacaaatatataggttcttattacagccaagtgactagtattgctgggttaaagcctcacatactaaccatatacttgttactgcacaaaaatagaagtgttactacatgataggtgcatgttaccactttcaagtaactatgttactgcacgacaattgtagttttactatgtcatttttacgagatgaagatcgaataggtgggctatatgtaaagtctgtaggtggctttgagcgaggtctgattgatgtatgagtgttttgaataattttatacatttggtaaaaccatgttactgcatgtatatgtccttgttattgcaaggtacacattctgttactgcatgtggaggattaaagttcaaaatgccaatttttgaaaagcaatatctcataagatatgtattattttttaaaaccgttttcacaatgatactatagttttactgcatgtggaggtttaaacttcaaaatgtatctacatactcctctcctcaagaaaccgttattcctccctcttctcaagaaaaccggttttctccctccaatatagtgttactgcatgcatgtatatgacgttactgcacttttaatagtaatattgtggtgaattgcagtaaatcaggaattgaaataaaaatatatgggttcaaagtctcagatgctaatcatatacttcttactgcacaaaagtaaaagtattactgcacagcatatacacgttaccacctgacatttacacattaccgcatgtttatgcggtaacactatccaagaactgtagtaaaacactttgttactatagaacatatagaacgttattgcacctttggcagtaacatcgtgatgaaattgtagtaaatcagaaatcaaaagaaaaatatgggttaaaagtctcacatgctaaatatacttgttaccgcacaaagtagaagtgttactacatggcaggtacacgttaccacatgtttatgcagtaacactatgatagattaattctagtaacacgctcggttactggaaaacacatagaccgttactgctctctagcactagtgtcactacacaattttaactagttgagcgttgtgtccgcataggggattgaccaagaataacctatggtagatttattctagcactatcaaagatgcaaatcaattctgttacatacggaattatagtaacatgcttggttactacaaaacacacaggttgttacgtcatgtaagaactattgttactacacaattttcacaagattaatgttacttctgcttaacgattccatagagatttacttgatggtttacctctctcccctcacccacccaacacgccctctattcgaatttttgtttattgtgaaagcatatgttactacaaaatatataggacgttattgtacttttgatagtaatatcatggtgaaattatagtaaactaggaatcgaaacaaaaatatatgggttaaaagtatacatgctaaccatatacttgttactgcacaaaagtgtaattgttactgcatggcaggtatacgttaccacaaagtttgtgtagtaacactattcaagaattacagtaagatgctttgttactgcaaaacttatagtatttaccacactttcacagtaacatcgtgatgagattgtagtaacgtacagcaggcagtagtaacacttatgatatagtattattacttgtggagagttgaatttcaaaagaccaatctttgaaggttcgttctacccttgccccacgagtaaagcgagccaattcccctctctccatgttattgtactttttttcttactatatatatcgttgcagtaacgatatcaagtaattacagtaatacactatgttattgtatattaatatatagtatagcctacttgttgactgtaaggctctttgcagccttctcttagcccgcccactcatataatagttagctgtttacaattaatacatggcccatttgtctctctcatagagtttcttggttcttatgtccaagccagctgtaagtttacagcccgcttctcctctcttctctcctccacctcagtatttagtcggcttacagcctgctattaactcttaagctaaaataaaccagtaacctgttttatttaacttatataaataagttcacaggttggccactatacccctatccccatgtacagattaggaagcaactactccctctgttcttagaaaaagcaactcatcttaggcatgtttagttctaaagttttagttctaaagtttttcttcaaacttttaactttttcatcacatcaaaaacttttctacacacacaaacttccaacttttccatcacattattccaatttcaactaaacttctaattttggtgtgaactaaacacagccttattactaggttgattttttttgacaaaaaaagtagtagtataaaacaacggaatctgctgcgttctaacctcaaggttcccaacctttctccctcgttttccgcgcgcacgcttttcgaaatgctaaacggtacgtttttttacaaaaagtttctttacgaaagttgctttaaaaaatcaaattaatctatttttttaaaaaaaatagctaatacttaattaatcacgtgctaatagactgctccgtttttcgtgcggaggggatgggttcccaacccagtagtagcctagtagctgtgcaagcactatactccatgtaaaagcatggcatcctgacgatatccggcgcttcaaacgtgagaaggttgtccttgtcacgacgacttggccagtcggtcgtgcaagtggggattctacgacgtctttgcactcccttccagtggcggatccaggatttcaacaaagggtattcaaagttgaaaaaaaattcttatagagctcaaaaggttggagtggcaaaatttaaagtacaaatactagcataacaatatagtagtaaactgataatgacatgtttaaaggtacaaacagtagcacaatggtaaaaatgtctaaattataaaatggtttgaatgaattacatgaaaactgaaacaaattacaatttaactttgcgggtagccatggcttggaagcgagaaatgatgtcatcatctgttacttgcacaaaaagatcacgctccagaaaggttactaaacaacattcaaatattgttctcccattctatttcttagcttgttcttgacataattcatggaagaaaacaccctctctacactagcagttgccacaggaagaattaagaccaatttgagaagcttgtaaacaaattcataagcggtgtgcttctttgttgcaacaagcatggtggaaagctcaaccagatttttcacatttttaaacctttcatctttacgaacaaaattgataaagagagtaagctgaaagggaagatgtaacaactctgtttctgtgaagtcctttggataaaactgagcaagctaaccaagttttccttgttataagcagcaaatgaatcgataggattgaaggatgccatgcaaagaagcaactccgtgtttagaaatcttaccacgggctagcaggcagcagcacgggtagcagtagcagaccagccgccaatgcctgaacgccatcgcgccgtcgccggctcgccgccaacgccgcaaatcggcaaatgccgtcgacgcctcgcgagttcgcgacctcggctgctcggcggcgctgcggccggcagcctcggtgtcggcgatggcgtcttggcgacctcggctcggcggcgtcacgccgaccacccaggcgcccaagcagcgagcgcccctcgcccgtcgccgtcggccgtcgcagccgcagcgtgcagaaggcagcagcgccgcccttgcgtctggtcctctggctgactgggattggggattgattttgattagggtttactcccgtttcgggccaatggacctatttgctgggccaaggtggtgagggagagggaatctacgggctggctgctactgataagtgggcttttcttcctttgggctgcacatactacacttattatgtatgattgtatatatatatatatatgcatcacatacctatatataattatttttttggaaaattctatgggtattcaggtgaatacccatgaattacattgcatccgcccctgctcccttcttctcaggcacggcagagttctagagagcggcatttcaacatcagcaacaccaacactcccgaagcttttttttttttttggttattttccccgagcgtcaaaaattctgtggtttgcagttttccacgtaagtatattccaactttccaatagatgtacgtcaaccctttgctttctctgcagctgcagagttgcaggtttgatgaatgcagcttatctacaaaattcccatcagagggaacacagttacagaagaacttggggaagtacagactgcaaatccacaaggatcttctttagaaccgtatatgtaaagggcttcatggattggccactatatgggtgttatcctcaatcgtgaatctgcaaggtcagatatcaatatatcaaatgcagattgcctcattgcagattgctgtggattgttcaggttccaggttagcccagtcaccagtcttcactgacattagcccgctgtagttacatcagatagtaacaagctgtcaagctcctccaccatttcggaactcagtcggtggtaaggcatcggaaatggcatcaaaacaactcttgctgcctacctgaatgtatcacgcagggacagataatattaattttgtggtccacttgccaattacacgaacgcctcattataagtgaaaaactcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctgtaaataaagggggacaggcggacagcattagttcaatttgaccaaaaatgaaaaccaccaagcaaatgaagaactcaaactcactttctctggtatttcagcctctgcaagattttcttctgcaactgaaattatacagacataacatgtctcaaaatggcacatcatagacataaaacagtaagtgaagatggatttgatcatttgactactgaattagcctactatcttgccttcttctgccattttacacaaaacaagattgctcattaaaagttacagatctcaagatagaatttccaccagtggtcatgtctatcaaaatagtggaattattttgacatgagaatcagcacatagttgttcattttcactgagcaaaggtaatttataaactgagtagagaacctgctagtttatatttttcaggtcgagtaaaaatatagtgagctgtctctggtgatttttctgaacaatagcctgatgaggcttctttaataacagcataactaaagataaagtcgtaataaatctgagttagcatatggaaataaatgttttatgtgaaaatatagctcaaagtcaactgcctcataaactaagtgtaaacagtggaaaagaaaaatcaataccatatgcaacaaggagttctggatcagcatatacatcaacaaggacctgcaagatttcggcaatgaatcacagaggatcactaagcatctcaattctcaaaagactaaactatgcaaacacatcagtatgcatgggcaatatcatccaaaagtaagcattagttgcatagagaaacagtcaatcgcaggctaataaaattgcatcatgaacgtcctgattataccgaacaaatccaaaagggaggagaaaaaggcaatg

SEQ ID NO: 71656 - DNA, 2370 bp, Oryza sativa
aggtctaaaggttgaaatgatggatcaattaaattgtaaacatgattggattagaggaaagggtgactataatatcaaatgtgctttttgcatatattaccctagtcaagaaaatagagtgacttgtagtatatgtctaaaacaagcttgtgctgaatgtataaaagcaaataaacaaaaatggagaaaagaaatagaattagaatcagatgaaaagactttatctagtagagtacgagtgttagaaaatagactaaataaactagaagtagaattagagaacctaaaaaataattgcgatattaaggcattaccagagaataaggacatacaaaacaccgaatttaaagagcaattgataacattaaaagacagtaatactgctaaaataattcaactaagagaggccataactaattttggaaaaaaatatatagtaagattgcctttcaaagaaatattaggtataagaatccctgttaaaataaaattgacacccaaagtatcttataaaatattagcactagtagacaccgggtgtaaaaagaatattattcatgacaaatatttcataagatgtcctgaaatagttcacacaattgacgacaataaggcagaagtttccacagacatgtccggaataaagaaaattcataatcagttagcttataatatggaggtttacattaatgcaactaaatatataatagatgagattacaataagagatttgtcaatgattaatgatgacataataattggcctaaggttccttcaacaatcagtacaaaccacagtaatacatgagcaaggaattacttttatcccatatcaaaataatgttccatatatctcagaggtacgaaagcgtggtggagtctcccccaaactcgacaacttagaagtacccaatcttgagcctaaagaaagaattaatgaatatgagcttagtgagaatatagacaactattatatatcaaattccgaatatagacaactattatatatcaaattccaacatagagtgcataggactacaagcatttgcaccaaattggtatagagatattaagtctaaaagggatatagaaaaaaatattcaaagattagaagatatccaaattataggagaaattcctatgaaatattgggagaaaaatgctattgagtgtaaaattaatataatcaacccagaatatatcattaagactagcccaatagaagcaacttcaggacggagtatatatatgtgtgtgtatatgtatatatatatatatatatatatatatgtatatgtatatgtgtatgtatatatatgtgtatatatgtgtatgtatcaatatgtatatatatgtctatgtatctatatgtatatatatgtgtatttatatatatgtgtatgtatctatatgtatctatatgtatatatatatatatatatatatgtgtgacggagcgtggggctcctcaccgggagaccgcgcaggcccccctttgccggttcggccgggggcgctaagtgaggttctttgccctcgatctgaggaacgtcagcgagagaggaagtgcacaagacacgggcgacgtagacaagttcgggccgctgagaagcgtaacaccctactcctgtgttctggtggatctgtgtgtgaaggaatacagagagccggagagcgagagagagttcaggctctagaacccatccgccagagtcccaaccccccctccctttaggcctgggcctcctttttatctggtcaggggtcaccacatggcctctagctacctaagaagggaaacatgctttttacaatgagggctagtctacagccggaagtgacctctgataagcagagcacacgcctcctgccccactcgcccgctttccccgtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggcctcctgttgccacctaacccgcgatctgaccggtctgtgaccggtcacacaccgcgaccggtcacggaccggataagcgcgcgctgcgccgcattaaatgcggcgtggcgcgctagtccaacccgctataaatgcggttaggtgagtcccgctgtgcttacctaacccacacacgtggcgccaaaaccacagggggtcggggcgccccagccctcggggccgaaacgggagcggcccgacccctcggggagacagagggaggggtggccacgtcaccctcgggcccgacgccc

SEQ ID NO: 71657 - DNA, 17794 bp, Oryza sativa
aaagccatgaatccattttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagtcatagccacctagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgtttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccatgaacggtggtgtgaccaaccaaccgtataggcgaggacaccagtcggcggcgacggaggcaggccggcgatgaagtcgtagacgcccaacagcggtggcataataggccagccgtgtaggcggaggcaccactcggcggcgacggaggcaagccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatctgccgggtgtgtattgatctgacgatcaggttgtctcctgcccctagaggggctccctgccctccttatataggttggggggcagggttacaagatagaaaccttaaccaatacggtatcggtttcctaaatctactttacaatcttatcaaaccaggactttaggccgttccataatattcagggaaacgtaatacccaagtcatgatctgttacatatttcatatatatataagttatcccctataactagtcggataaccataccgtgtgggtatggggtacccataatctccacacataggaacttatgaagattttggcaaacgtttggaacagattattctgcgaattattgtcgcagtgaagaaaaaagtttactactgtaggctgagagagatggatctgcttctaaccaccatcagtgagaattaatgtgggacacagaagaagtgactggatgtctggatcaaaggagtttttgcctttgtgactttgatctgcttgtgggctctaaattatgttacatgactctccgtagttaaatgatcttattttctttctttctttcttatttcagttttgtctactgtaatttctcttacgcaattttcgcttacgattgtaaaattatagtcacgagaaagtagttttgacataaatttgacaatatcaattttatggcaaaacataaatattacttcctccgtttcacaatgactttcacaatgtaagtcattctagcattttctatattaatattgatgttaatgaatctagatattctatattctatattcatattgatgttaatgtgggaaatgctaggatgatttacattgtgaaacggagggagtactatgtgcgttgtaaaatataataatttctggttatatatttggacaagggtttatctaaattatggtactatattttaaaacgaatatagtattaaataaatcattaactaaaatgtaaaattaaacggtcagaatacgcataatattttgagcggggagagtatagaatatagagtcactcaatttaactacaagtgtactctttatccaatttgacagtaacatagatataactcataaataacaaataaatgagtgaaatgctaaatggcattcgatagattaattattgggccaaaatcttacagattcatgctctggtattagctttttctccgggtccgccggctccaatgacaccgacaaaggtggtggagttagggatgtaggatcccgggttgggttagagattgggggaggtgggggcgaggaaagagcgggagagagccaatccagttccaacaatgcacttctcgaaccgagaaagtcaagcttagatggatagccatgggtggcggtgggcagtggatatgggcgagcgatgagccacaagcggctgcgttgaagccgtaaggatggaggagggaggtgatccagcgttggtagcagggacaaagcaagcttgtggttagaaggctagacagcgagaggaaggggatcgagcgaatgagcaatcccatagtggctgggagtgaggagggaggggtgatatggtttagattgtgttacacgaatcttacaataatcatacggtccaaaactcgcatgttttctgagggggttttatgtcaaatgcttgatggacagtccaaataaaaataaggaatattaaataaccatcctaaatgtcacccaaaatttgagattttccttgtaaagaagttttgttgccaatatcccccctcccacccctcctaattcatggtttgatattccttcccaaattaccgatgttcgcgtgttgagtgtcatgagtagggatgaaaacgatacgaaaatggacgaaaaccacctttattgtttttgttttcatattttttttggaatcaaaaacctcgaatacgaaaacgaaatcaaatattgtcgaaaccgaaaacggaccggcaatgatacagtaacgaaaatttatcgaaatacaaaaacccctcaaactaagttttaaactatgtcaaatccaattctcaagtctcaaatttcaacattacatctcaaaacacaattatgtcaagttcaattctcaagtttgaattgggtgtattgggttgggctaaattgagtgacttaggaattacgatgctgaattgggttgggctggggaggaattatagactatggtaagggccttcataattctggaaattccgagaaaatttctggaaaatttccgaccgattccgagttccgacggaaactgcccttatggtattcgattctatttctaagaaaatatttccgaattcgattccgtttccgaaaaattccgaccgacagattccgtttacatccctagtcatgagtgggaatgccatgaccgtattacgtaggcccggtgatatcaaataaaggtgaattaattaggagggagtatttacatccaatcattttatagggtggaatctcaaccttacagcgatatttacgatggtattttacaattttcccataaattaatgtaaattgcacatatgcacccacttgcatgcctaatcatgcggaagggaaaactaaaattaaacgtccacgtttttcccagtgtggtactctcttcgtccaaaagtcaagacctattttgtttttttgttttttttttcaaaagtctaagactcatttataggactaaactaaaatgattggaatccaagaagctatcttaatccttgttagttacatgcatgtgtatagtttattaattttgtcacatgattaatgatttaattttgtcaaaagaaatactccatatggagggagcgagtactaataaccagtagcgcacacgaggaagctaattaacctgacgccaccacctctctttccctctctctcttccattcaccgacaatctaactaaaaatgaatccgatggccccgatgctgccggcgccggcgcccatggcggcggggccgacggagccggtggtggtggttggcccgcagtactgcgcgccgtacgtggtgccgctgacggtgaccaagaagtccatcagcctcaccgacggcgacttcaccgtcaccgacgccaacgacaacgtcgtcctcaacgtcaagggcaccctcttcagcgtccgccaccgccgcgtcctccacgacgccgtcggccaaccactcctctccatgcaagagaaggtaattaattaagtatttctttctttttttcttttgatttgtctagacctagtagacttgatcggggattcaggaggggaatccaagaaatcaagtactcgagggaatccaagaaatccaaggagtagtattttcaagtacaccaacagctagagagaggatttcgtcttgatctgatttcgtgttttttttaatatgttaatcacatggtcaacgcgtttcatggagattgattggatgagaaggtttttatattccttgaattttttcttcttccttttgagaatgatacaaaggtggtcaaattcgctgagaagagagagctcgtggaaattaggatcgaattaattagaatttcgtgtcttcgtaaaggcgcctggattatggatcgtttggcaatcgatgccgtcttggtgaactgaatctttctttctgcctaattaatcactgtcacaatttcaattggaacgttgactattttcgtgattcttgtgatcttgacctgttctttagatgttgaaatccacacaaggcattcaattcttgcacatttttagtattttacaaaagcaaacatttcagcaagttgagaatgatccccaattgaatatccacctaagaacagcaaaattttcagatacttagcatgcacaacagatgggaagtatacagaggggacagcgcacattcgtgcgataagctcttcaccgtgaagaagtcctcaatgctccagttgatgaagacggagatggatatcttcttggccgggaataccgcggagcaagtctgcgatttcaagatcaagggcagctactgtgacagatcatctgccttctaccttggcaaatcaaacacaatcatagctcaagtaagtttactgcctatgtctctcatcacattgtggaggttcagaacaaaactttaatagatttgttatgcatgtcctaatacctgcagatgaaccgtaagcacaccgctgcaagtgtggtgctggggagggacgtattcagcatcaccgtgttcccgcaagtcgactacgtgttcatcgcggctcttgttgcgattctggatgatgttcacagggacagaaaggagtgatgaactggaagcactctcatcccaagcacccttttaaatttcactttcatatctgtcaaattacctctgttctaggtattgctatctggttgaggatgtgtgtaaatttttctttgaattatgtttattttcgctggtgttccatgatttgtaattaccttcaagattgatcgatgttgtataactgcttacagcagtgaatgttttctgtttaaagatcaggttgcagagccaagtgttgctgatcaaaattcagttgaatataggccatttgcagcatggtttctgtaggtcaatcataattaaattgtgtagaggggaaaaacaggcatatggtggcgtttcattccaaaaatttaatctgatttggggttttataatgccaaatgatcttatttcagttatctaaataatgaaatgtgtttgaaagtgacatggatattattttccccaatcagctgccctgatcaggaaaaacatgagtattgaaaagtctgacttctactttgtctttttattttgtctttccaatcatcaacaaatggaaaagcttccgacttaagctttttctttctatcacctactcctttgtcccattttaattgcaaccatgagtttccgtgctcaactttgatcatccgtcttatttgaatttttttttataattagtatttttatttttataagattataaaacatgaataatactttatgtgtgacttgtgttctcaaatttttacaaaaaaatttaaataagacggacggtcaaaattgggcacggaaaattatggctgcacttatattgggacggagggagtaaaagttttgagtgatcttccggtactttctactgatagtattatattgtcagtagaaatgatatgatctattcgttattaaagataaattagtaatttattaatatattcattaggggtaactttgtcatttatatttttcttcccggctagataactttattttagtttatttttttagctttcaagataagccaacaagcaaatgatgagaaatcctatttttttagcttgaagtttcttgtttccctgtactatacattgattggtttgataatgtacaatgacaagaagttcctaagatatactagacacataaaagaagttcaaagaatatgcccaaatgaaagcaaaaataatcatgttcaaatctcagttctgtgtaaattatgcactcgatgtttcataaacttctttgcaaaacctgcaaactttttcttttgcccctgaaatccagactgggaactgcaaaccctgcatcaccctgaccactctagcttgcctaccacaatttctctctctctctctctctctctctctctctctctctgaaataaacagcttaatttctcctggttgtgcagataaaccgcaagtttagcgatctttcagacatgatattcgttgggagcaagttcagtgtgaccgtgttcccgcatgtcgactacgttttcgtcatggcacttgttgtcatcttggatgagatcgcgagggatatacgacgaggagcagtgatccagatcagcacgagccagagaccaggccgatcgacaaggtgaaaaagaggggaaaaaaaagaactctgaagatcaaaagcttccttgcaggtgatcctgctgtaattttatctgaacatgcatggaaattttgcatctaactaagttctgcattcagatgaaattagttagatatagtagttagatgcatgaaagaatgatcaccctgctcttgtgtgtcaatgggcacaccaaatgttgcattttgctaatcctttttctgaacaaccatgtgtggaaatcgatcgaagcttctttgaagctagagattgaccagaaattctaacctgcttgtactgattcttaatgaattcccaaacatattacttttgactctttgatcaacacaacaggggaaagtttcagatttcaacaagccaaatattcttaagatctcatcgatccatgtacatcaaggttcaagtttgtcctattaaaaaaagtttatggacttctatattattaaagtctctttttttcccctgtgagagagatccactacactatgataagaattgactgcaatagtatggttatataggggaagcatcttcagtaaatcatcgagctgttgttggcactcctaattaagtgacttcatctgttcaggtatgaaacaactcgaacaaaaaataatttatggagaactataaaaacaaatcacgattctatacatgatattatggagtatttgttatccatgtggttcccagataattaattaaaaccccacagattcacaaggatgcacatccagtcatggaagacatgcatgtcctgcaaaataaacaacctgaactcatcattataatgatacctgtcgcccatgcaagatctgaactctggaaagggatatatccaacctgaaactttaaatttccaccactaaatataacataggtgagcacaatgatggatatgattagatgtgaggagctatcagaggtgcacatttattatgccatccagaataacattgtgaaaagtactttggtcatttgtttcctctattttttttccaatttggcagagtaatgttattattttcaaaggtgcacattgtttgtatctgcagttgatgatattttctaacctgctagttcctaatctagcttaagacatacttcttcagaactccagtgtggatttctttaaaacaaatgaaaacaacttgtctttaacaaccatggttctgacatatatctgaaggaaaattccagccctggacttgatgtcatgttccacaataaaacaagtattaccaaaggtcatacataaacaatccacataaatgttgcaaatagtaggtggtgttagcaaaagttaagtgtctggacctatgcgtgtgcttatcaaattgtccttttcctttttgagaaaccaccataacgctagaattctctaaatgaagggaacatattccatggagaccattgtgtgggctctaaatttgatcgttttgttcaattaacaaatattttttccttaaaacaataaatattaatgtttttattgcacatatagggagctcttttagtctttaccaaccatggatagagatttagtaataaacattatgacgcttgatagattcttgatcttcttggtttttttttttattttttaaagttagttctcaacccatgttagaacctcttaatagttactccctccgtcccataaaaagccaacctagaattggatggaatgtttcctaatccaacgaatttggataggactagaaaacatcccatccaatactaggttggtttttttttggatagagagagtatggttgtgcatatcctggatccagagatcgggaatttgtatatgacattaaaaaatatgttcttagttaatgaactatctaaatacatgaaagacctgtttggcaggacttcagcactaactgcatcaagagctgtagctcaatcaaatagttcagcttcacctaaaaaaaatgaagtggattagaatgataaaaaaagaactagaggggtgtagcacggttcaggcccatccacagtttcactctaggagtcgaagctttagcaaataggaccgaaaagtccaaacgactcttatacagaaacaattattcatcccccaaattaacaaccaaacactgcatgaaatctaccagaaactcagaagaaggaaaagactaatccaacctagaaaatatgaaaaatttccagcacaaacaccacactatactcttgtgacagctacaaaagtacacttaattaattaatcaacaaccttgatttgatgaacagtaccaattcaatttgatcaccagtgaactttgcccgctccgaagcacggcacggcgcgccgcggcggcgatcgccggacgacgacgacgtcgtcgacggccacgccgccgtcctgcccgagccagcgccggcgatacgtcgtcttccccggcgacggcggcagccaccgctgtcgccgcctgaagctcgtcagccagctcatccatcctcccgacgacgcccaagaacacgacgacgacgacgtcgacagcctcctcctgcacttcttggccttcgacggcggcggcggctgatcggagttgcacgacgaccactggtacgagtacgacggcggcggcgagatcggcggcatggcgtagccgccgtcggcggcggacgccggcacgacggtgctcttgggcgtgccgggcttggactcccagacgaacggcacggtgccggcggcgccgaggctgtagtacacccggaacgacgacgccccgcccgcggcgccgcgatccgccgccgccgacgacgacgacatgatcctcgagctcatcagcaactgcggcttccctcctcctccttctcccttaccaccactcgagctcattaagacacagattaattcagagatatgatcactgagacaaatcaaaccaaaccagagacaaattttcaagccaattaattaaagagagagagatttgcaatttgcaaagggaaaagtgtatgcgtttgctaattagaaggtacactgctcaaaatgaatttgatggagctagctgtttgtgaaattgtgattgagtgagtgagagaggtgtatatatatgggagctttgattgagatggctttttttttctttgtcaatggtggcaattagctagctacctagctagtatctagcttgaggatgaagaatggtggagcacaaaggtagctagctagctactgatgatgtgtgttggcaattaagttttgagcttaagtgataatgaccatgatgatttaattaacagtacaatgatgtagtttaagtagtactagtactagtactagctatagtgtgtacaaactgcaaagttgtgtagtaaagaagaagatggtgtgcatgcaagtactagctaggtgctgtgttaggttgaagatcaggagaaaaaaggggatgagaatgagatagaaggatgtgttggcagccttgtggaggtagcttctcttgtgttcataaccgttttctacgatatatttaactagtgattatctgctcatctcttttatgaaaatcatgttaatacggagttagaacatactccctatactccctccagtttttaatatattgtaccactgactttttaagataagtacgttttatcattcattttattaaaaattatgtaattattatttattttgttataacttgatgtatcattaaagattttttaagcattacttatattgttttatgttaaaaattggataaggcgaatgattaaatgtttgtctaaacaatggtatatattaaaaatagaaatgagtatatatttaagcacaccacaaaaaaaaaagaaaggatctcatgactgaaatatatcttgtttaattaattaacttccttcatatttggttggaataaattgaaatataaatcatcttctaaaaatacctccaaagatctccctttttccagaaatgagagcaaagatccttgaagtagataaataatccctttgtttgctagtgttactctgagatcacatcaatatctctgaattaaaatactcagcgcgattaatttgataattgcctccatgattgtgtcatctaacctagctacagaaaaggctgcaaagtactctgcaacatgaaaagaaaaattaaatacaaggactacattcacaaacgtatatctaatcataatcctatatgcttaacaaactgcctaccggtgcgtgcgtatttaattacacatgtttgtttccccacgaagaaaagaatttatgtaccctgcaacacgatagatggatgagaaaaaaggcagacaccgaattgaactcgtaaccacttatcatttcatagatcagcatcttgcacacattcattggttcatgcagatgaaataccagtacaaaaatctaaggttgctttactttatgtttctttgttcttctttaagaccttttgcaaaagcaggtctctgctgcaacagtttgattatagggcatctgaattcagaagaataatgtttggttgcttcgcatatatgctggtcacatgatcatatctaggccttttaactcaccaattaaaactgttgaaagggtagcaattcagtgattctgagagaaattgcatggtgtatgattgacagtaagttattgcagtggttacagggtcatttccctgaactttcgagcaatcgaactgtgttgaaaagttcaaagaaatgtgttgttagaaaggcatgtgcagtgcatgcatagtgctgtcaataaaatttcttttcgaaacatatctatcagtaataaatttaccaatattgaaaattgattaaaatttatcaatcaaactgatacttataaaagtatgtcgacaatgacgataactgaaactactcttggcatcacatgaaacattctattgagctaatataatgcaagaactgttttttattttttgagaacgcgaaaaactttgcacttcaacatattagaatagtgcaagaactgttgttaaaggtttcaaattgaccaggtttcattagcttcatttaagaacaaaaaagagttcagctagtccaagtttatgactctgctttttcggatcagtccagcacaaaaatcaaagctataattaagctggtgcagtgtcatccatctcatctcccctgaaactttcagacagtcatcaggtcattgatttgttcataatgtctctgctaattaagcacacacgttagccacttttgtcagtacttatctgtagccttgtacgattagaatgtgacggtgaatgtacatctgacgatggaagtgaaggtacaatgtgaggacaagagaaagtgtatggatgtaattgacccagctcatgtgatttttagtcaaacaagcacaaagattttttgtcgtggattaggttaactaacttttagtacttagcttgcaagttactgtcttcctttggattaagacttagctaagcttgctgcagattctaggaacaatactccattcgagcgatgtgtatgacgagtgtttaatttcttcaaataattaattatgcagtacaattttgcaaactctagaaaatcaataaggcattgccgttccaaatgttacaagagttgtagaacaacaactttgttcggtcataaattaatggtatcacatatagtcgtatatatggcaccattaaattatcttttttttaatcacgggaggtaaaattatgatgattatcactggcatgctttctaagctctcaaacagaacgattttcaaaaggaacacttttaaaatcaaccttttaactttctaatatttaatttatttgtttatgcccttaaataattatcacaaactcagtttcatcgatcacccatcagctttaaacaaaatatgccattaaatttctttgaaatatattgcgacttatttaatcgtttcctctgtcttggttaaatgtttggaaacaaaagaacatctgaagaaaaagaggacctcacacacaaataaaccgacctgctatctaatcatctgcagcaatcatctaatcatgctgtcacttacaaatatgtgcatgcatgaataaatccccattgacgcttggaatcaacggttgttagggcgtccttgttgtggctgttcaggaagctaagctgctgcaggcagacgataaaaagcagtttgcaggtttgatagattgccgtcgtccagccatcgctgtaccgtaaaacacgtaggcgacggccgatgcgacgcgtgaaaatgcttcgtgctgaattattcagacgtgggatagtatctatctgtcattagctctgcatatatatgcagtgaattcagacatggatatgtctgcaattataggcttttttttccgactgcggcttataaaccgacacacacgatatccaagtgaaaacgacgaaaaaaaaagtaataatttggttttaggttcagaatggattacactgtaatattcatcgtccccgaattgctaaatatatttcagtaatatgtagatccaccagtggcggatccagaaaatcgatttgttggtgtcataacgtgtctatcggtgtcatagtatgctaattatacttatatcatggtgttataacatatggattagcagttttgttacaggttttactgaaagtcgtcggtgcctaacactgtagatccgcccctgagatccactgaaaattagtcagtttggcattgccaattaagtttgcaataactaaaaattatctttctgtctttcaactgccctacacttgttctttaatgtagtgcgtttatatacaattaacatgatactatacacaatagtgttatactcttagaattaataatcaaaatttctatttcagtttagataacatagatattccattatagtactctgtatgacatatttctgttccatacatcagtggacatcgttagaaggggatagcgatttgtcccacaaaagctcgagttttttactattcatcttccctatcttaaaaaggtcaatgatatgaaccatttttactatcttaaaaaaatatgaaaatctatagttttaccctgtatatgcatatgcagtgtgaatcttaaggtctggaatattacctaccaaatatttggtgcatgtgtgaattatttccaattaataatggttgtatttttgggggcagaaataagctacagaccagctatattttgatccatcgatttggtgtgtgagtcgtcggtgtctgtcgatcgaattagatccttgtccttattattgaacaagttaacatcgttttggtaggtgtgattaaattgattaatgcatgcacctcctggggtggcaactgtgtgctgctgtttgccatttctgttgtgggggaagaacaggttgccaccaaaccactcagttctcacactgtgggtcatgtactagaagagtacacgtgtgacactggaaagtgggcccagactattaggctaattaactttgatgtcatgggagtttggtttggtaatggtactggagtactatgaaattgttgctaaaaaatacatttatgtactgcacggtagatgtggagaaattgttgcgaataaatgtggttggctatagcatactccctccatactcgtaaaggaagtcgttttggacagcgacacggtctccaaaacacaactttgacttcttgtttctataaaaatatttattaaaaagtgatatatatgtatacttttatgaaaatatttttcaagacgaatctattcatataatttttacattttcaaactcaacaacttgagagttattcatgatttatattcccaaggtttgacttaaatattgtcataaacgactttctttacgagtacggatggagtatttgtgtcatcagagacttaggtttgcgttcgtttcgtttcaacttctcagtttttttccggattatttaccgaaatattgaaaaagattatatttgatttgctctatgcttcaaaaaatacattttttaaaaaaaaatcttctactgtattgtttattaatgtttagacgaacaaattatttgttaaacctatctatcaaaatatttaatgtatctctataatcaaagtatataatccacagtagcatgtggtatctagcaatctacataaaacgggaaagggagatgggtaggaatatggcccggtttgacaccaattgttttccataaacgtgatagttaacatcattatctacttctttcctcaaacaaattaattttggtaggtgtgatgaaatttcaggcaagatgctacatgtatgtgctggcattagtcatttgtaccggcttgaattctagaagtaatgcacttggaagaatatagattcatcttaatttagagatttggacactggttgggaagtcatcagacgcgagaaaccttatatcattctttgccaagtatgtgggcagttacgaaaagccctaaatcgtacacgtgtgatatgttggctagtccatttctggcttaaatgccatttggaaattgattaatcccttatgtttgtcatggtccctttttatatttaaatatttaaccatataaaaatagtgtattatgatattatattgttatacatagctttccatcgtttaccttttagattataagttgttgctagaatttgattattaatttagggttgacttttaggatttttatttttaagtattgtcttttagatcataaggacatacatatatataaattttacccgcatgttaatttttttcgttgctgatattatattaggccaaacgatggtggtctcaagatgggtcctacacgtggccaattaatttttttcacaatgtttatgaatccactagtaaataagaaacgctcaaaataactacatcaagaccaactaatgagagtgagctgggagacaacatatatattgaaacagttttaaattaatctacaatatttgagctagctcactcacaagtcacaagtcatcttagtattatgtttatggggccggatccacattatggttgcatggtgcacacgggacttgggccatgttttattaggctgaatccgggggatcctaatggccgatcgatcgcctggagacggggtagtgatcgatcccctcccccctccctcccaccacccctccacctggttttcttttttggcaccttattacttttctactttagtaaatttgtacacctcaagtttacacatctaaagtttagacaccaaaagtttataagtcaaaagtttatatatccgattcaaatttgaatttgaatttaaatatttttctatatatagtatttctatacatctaaagtttatacacctaaagtttatagacctaaagtttatatacctaaagtttataagtcaaaagtttacatacccgttttaaatttgaatttgaatatccaattcaaatttgaatttgaattcaaatattttatatatatagtatttctatacatctaaagtttatacacctaaaatttatagacccaaagtttataagtaaaaagtttacatatttgatttaaatttgaatttgaattcaaattttttatatatagtatttctatacataaatttttctaattttttattttttaaaaaagttttgtgtggtatactatagtaggaagagaagaaggggaggaggaaggggggagaggagggaggagtgtatcgtataggggag

SEQ ID NO: 71658 - DNA, 1009 bp, Oryza sativa
cttatagacattttataaaatgtctcttcgtttgtagagacaattcaccataagacacttattagacattttttttaaaatgcctctataatattgtaaagtcatttgaaaagtgcctctacagtataaaaaaatgtctatgcaaagctttttttcttgtagtgtttgtagatatagcatgaaaggtttaaatgcaagggaggaagagaagatcatttgtagctcagaattaacaccactttctatgatacgcattcaatagcatgtgtggatattgtggtcctaaagactatgttgaaggatgcttttgaccgacaatcgtgtggaaggatattttttgataaaggacatatgtacaaaagcaacaaatgacccgatttataaacttgacgcatagatttttgttttgatatggacgagagagtgtgggaagagacaagggggattgactttgacccaacattcgtatgggagggtacttttgataaaggggtatgtacaaaaacaataaattaatggaccgatatatattgctgacgtgtagattttgttttgagatggaggacagagagcgggaaaagacaggggagattaactttcgctaagcatcgacgctatgctccaagtacgatgaagtatgcaaccttgaggaggaaccatgcgcaagaaaaaaaaacacttgcaatggaatcttagatccactgctagcgggcatgtgggaggggcaaaggggcaacatggatgatggagactatgtaaacagtcaaaggtagttaaaccatacaaggtgaaccgtggagacataggcctctttggtgaccacatgtggcgaagccgttggtgttggtggggtggagggcaggttgagtcagagtcattatggtgtaccggtagtggtgaagatactaggagagccaatgaaattcggaaatattaggtatgtgagatctctgcgaaaaagacgaagggaatgaaactatcaaataggggtaaataaatattatttaga

SEQ ID NO: 71659 - DNA, 1522 bp, Oryza sativa
taaaaagtcaacggtgtcaaacatttcgaaacggagggagtaccattgttgcagaagctgaccttctagcatcagcaaagcccctgttgaggacttgagggagagtaaagctgccttctctagctaagctcctccaccatatttgactttattttggttaaagaaacctgtaaaactttgaccatcaatagctctcaaaatatttaagctcctccgcctgttccaatgagattgagtcaaatatcgtatgtggagttccaacgggatccagtgccaatagcttctgcatcgatagtacaggtttctgtttgtctggagctaaagcattgagaaaacctttatgctcatccatgttcagaaggatgtggccaaacacttttatatacccactcagcttctataggaggcagcttccactggagttggaatttagagttgagagtttaagtttggaattctaccaaatagggcctaaggtcctgaagcctggtactgaagagtgaagacactctggttgctgacctgaattttatctatgtttttgcaagtgttttggaatttcttaaccctgaactacagaggacgagttattatctcctaattagtctttcactggataacattttttcattcgaaaaatgtttttttagttagatgcattgtccggaagaaacctcgtttttatgaaacaatcacttgtccatgtggttctcgaagtggaggaaacagaaatttactggcttcattagtataatcagaaagtcacagaatctatttatgtttgattcgtgtatgcagcatgccatcaggttcattgttctgttatgttactgcttgtgatatagagacagtaaaaagtttgtgtaaccttgaactgtatatatttcaccgaatcaaaatagaaatgaaccgcaataagaataatcaatggaaatttgtacaattgaacatttcatagagcagctaatttgcttgtaaaaggtatatgtttaagactaatgtaaaatctgtgtagatgtaaagataggctgcctccatttttttttctttttttctttattttttagaagatgctactgacactcaattaacctagagtgttatgcttacagttattagtcaaatccaactaataaaacctagagtatgaggtcaaaatctacttttgtttgattcgtgtatgcagcacgccagcatgtaatttttttcatcatgaaaaaaggagatgaggaaaaacatgctgactattgctacccaagattgttgattcccagcatgaacatatgctgcgagatgagaggcctcagtaatcgcgagatgagaggcctcagtaatcaatggttactgcttctgataaaaagacagtataaagtggggtgtaaccttgaactgtattcatttcaccattatcaacattggaatgaactgctgcaatacagaatcaaagaaaatttgagcaatagtagcaattaatttgcttgtaaaaggtgtatgtttaaagattaatgtaaaatctatggat

SEQ ID NO: 71660 - DNA, 8373 bp, Oryza sativa
gtgatggattgcacatgcatgtgtaattacaatttagagtgattactaagaatatatataatggcactatatattcactttagtgtcatacatatatatactcgtgacacactagttatatatacgacgtctcatacactaccagaaactagattacttatgacggctaaaaaccgtcaggataaaacaaatgcacgtcagaaaaattgtttgtgatgtgtcaacgtcaggaaaattccgtcaggactagcttgtcagagaaaaataaatttaggtgacggaggcgcatcaggattaattttcctgacgtgtactcacgtcagggatacttttcctgacgttgatgtgagcagtcatcgatattcatctatcgctgatggtctcccctgtcacagttttgcagtggttttttctgatggttatgacagtcaggaaaatatatttccctgacagttagacaactagccgcaaatcatcaggagaaaacctaccagaacgtaagcatgaatcaaatatacacagtacaatagcaaaagtactcattttcagtattcatcatgatcacatacacacctccagttcaagttcaatatttcgtaacttatggatcaagtgatacacatagatccctcataacagtataatgtagttccagttcaccatttgaacataacacaaaagtgtcactttgtggagtttgcatggccaagatactatgtaagaaacttagtactaattttggagtcccacattctatcgaggtttagaaccataaatacaacctatccaaaagtattagtatgacacaactccacagtcagtatatccaaaagccttagcccatcttgcatgatctgttagtgaagtgagtggtagcatcatggagaggcaatcaagatgtgctagtattacaaccaccagagttgttgttcccaccgatgttgcttccatcattggcattcaaactgctagtattattggcattgcagttgttgtcgctgatgttattgccaccattgccagaggcggtgttatatccatcgctggtgttgttcccattgtcctcaactggctgtgagactacacgggaagaacttgttccctgcagcagttcgaaatgaagtttataagaattcagtccaattaaccagtactgaaaagtgaaaacgcatgccgatgcaactagaagaaacaataagtaatacacagtggtctatcaaagttcctatgcaattcttttgtactatattgaacaaatgttggagtaactataaccttctaaaccaattttctgttttgtgcaagatgcaagtcatctcaaattaaaataatatattttgtcttaccatctcaattatttgagaatgtgactacaaggccaactgttacaacaatcaacatgagcccaatccctcactgtaagtgctgcattgtctgttctcactctgacataccaatgcaaattagtttgctatttcaatagggcaaccaaattgtactggcacaatataaatattcagctagttcatctatgagtaaccgcagcagtataggagaaaatacttaggtaaataactaaaataattgaactccgcttacctgtgcaaatggatcttcctcttctactggacagtccaattcttgtggtacttgttcacccaacttttcataaagtgcctacatttaaaaagtagccaactgggtttagaaactaaaaactaaaactgagagtaaaactgagagtaaaagtattattgtaacttcataccaataacaacttgtcagttcgttcctgttttttgcgcatgtattgattctcccggagtagttgttcattttgtcgagccatattttggaaagcaattgaattggcaggtcgaacatttgttgatttggccacagccaaaatattagccttcctaacagctccattcgctatctgtacgcgaccatgtggcaagccaccattggtgctgtacaatacattctcatctaggtctctttgttgccaatcatctggatatttagccctaagacctgttaaataatcagtctacaaaaaggttggaatttagtaccaaacaaaacattccttcaatggaaagaatagaagcagaaaccataccacatgcttttgtgctttctggcttgggattggtccaatatttccatcattatctatatttttaaagccagtcttcattgcactaaaagtgtttagtgttgtagctttctcaggtccaaattttactccctaaaacataattggtttgatgagcaataccctatgaataaaactaatgaaaaaccatgctaaaaagatatggtaccatatattgttgtgtctctgtgaatggccgggaacctcctcggttttgggcaacatcctcagaattaaggcgtgcttgttggcctctctttctttttgccttgaactcttcagtacaccaataatctgcaatgtatgaaaatccattgtctctgcaccaatcaacggggccatccttatattcatcaacttcaagttcctttgggcgtgctaatgcatcatcaatctcctccccaattttatcatggtacaccttgacagaatcgacacaaagctgatacatcatttgcctcactgatttcgctgcataattttccaaaacacggtcagcctctaccttgtccgcctcactgacacagaatgcattctgcatgtaccaagttaatatatattagatagcaatttaattgcttgtcaatgtaatttgaaggacattttaacaatgacttacccaaaattcttgcttcaccttatctgcctttgtgactcctgagtcgtcttccttttcatagtaatcaaaccatgaggttgctggacggctgctgatgattacaccattctcatccttctcttcaataatgccagggtattctcgtttaagaataattcccatatgtgtaccatatttggggtctgatttcaatagagggtatgttacgtactcaaattgcctaaagaaaacacccatgtgagaattgttccattaagaggagaaaaacatagacaacacatgtacagagcttttgtatacatacacatattagatttgaagaacttgtatgctactcaatttatcacgtcacaaacatatcggctttgaacaatataaattctacagaacagaaataaagacagcctctaatttattggagcagttaacaaagtaataagcattagtagaaaatctgtagggttctagaaatgcagatacttactcatcaccccgaggtttcagcgcgatctttcgaccccgcggaggtacttttagtgcagttcttgagcccttcttcctccctcttttatttggtggcgcactgctcatgccacttccagcaatattggtggcttgggaggcattatcagtattgctactattaccagcacaaagtctttgggaggagttagcaccggagttactactgccacctccattaatcatttccgggactctgttttttgcattagtagcactagcattgctccttgtagagatgttcctgcattgttgctgtcttgcaagccgcttccgatcaatgccgttcatttcttgcaatgttatatccatttattagttttagaagagcaccatcggtccataaaaaaagaagaataatagcatatattttcatagcatggaatcattcaaacaaataataatccatcagtgcttaatataaaacctttataaagtacaaaatgaccttaggtacttaaagcttaaaaagtcatatgaaagttggcagctgcataaataaattaacagacacaaaatacaatagatatttcaatctcaatagcttaaactaaaaatcatttggatcataagctgggggctgtggcccttcatcttcttcatcattttctttttcttcttcttcttcttcttcttcttcttcttcctcttcttcatcttcattgtcatcttcatcgtaattatcttcagcctgcatttgcttttctaggaattctaagtcttttgcattggttatctcatccaaaataggtggagtcatatttcctaagtcagccccaaggtcaataataaaagtgccttccaatccatcttcttgatagaatgatacatcttgggtttgatcatcatttgggttggaatcattatttgtgttctcagctttctggacataaccccgtggattgacatgatgtacaacccaccattatgatagatcacgtcttgtagtgcatgggtaaggcaaataatatacttgtgtaacttgactagccatcacaaatggttcaaaagttgaaagcctagacgtgtgcttaatttcaactaaacccaaattgtcagtacgtcgaacaccggtagatgttgggtcaaaccaataacagtcaaacaaaaccaattcaaggttcatgctgccttcccaactaataataccatagtactctagcacatcattgttttcgccaacacaagacacacacaccccactattggttgttgttaaccctgatttcttgctctcatacttctctgaacgaaacctatatccattgatatcataaactccataagtggaaactgtacttcaaaaaccatatgacatttgacgcaaagcattgtgtatactagatgacttcatgcactgcaaatgacagatattagtggtagttttagttgattgcacattgaaggaaagacaatgtctcaagtggttagagtcatacttcagttctgaaccaatcaaagaaattaggcccatttcataatgccacgacaagattttcatccatttaatcgcaagtctcgcaactgattgggtgttggtgaaaactcgctcttccagtgttccctatcatatttactacattaataaatttaattataattatggcataaaaatatatgaatgactcatagtagatttgaaacgtacttgaagaaatcatccatttctggtgtgtttgtcaatatgtataaggtagcagccttgtactcttctattgtgagtgcatggcagccccgtgggctaatataccggccagagtactaaaatatttctaggttggatgtactatcaaattgtgagctaccatcatcatatcgaggcatcttgtttctagcagaccgaactttaggattgaaatagagtgaaagaaaattagatgtttcctcaactaggtaggcctcaacaatggaaccctcaactcgagctttatttcgcactttctttctaagtttttggataaacctacatggcaggaccaaatgcattagggtcaataaactctacaaaaacaagttaatgttttacttcttgtcttacctctcatatggataattccaacgaaattggacaggacctccaagtcgagcttcatagggaagatgtatgatgagatgttgcattggattaaagaaaccaggtgggaatattttttccaacttgcaaataagaacagctacattctcttctaaagagcggatggtatccttgtttagttcttttgcacataactgcctataaaaaaaactgagctctgccaaacacttccaaacactctctggaataaatccacggaatgcaacaagtagcaaacgttccatgaaagcatggtagtcatgactttttaggccaaaaatttttctttgtagtaggttaaccccacgcctaatattggcagcatatccatcaggaaactttagttcttgaaaccatttgagaattgttgttttgtcatccctatcaatacaaaatgatgcctctggtttatgccattttccattaccctctgacactaattgcagtaatggacgactacaaatttcaaccaaaactttccttgccttcacattatcctttgttttatcttgtatgtcaaagcatgtgttccatatagattcagctacatttttctcattgtgcatcaaatcaatattgtgccgcagcttcagcttatcaaagtatggaagttgccaaaaacagcttatatgagtccaatggtgtgttttaccaaagttttccgtatcatccacacacgcgtacatttcttctttaatttcttctcctgtcagaatccttggtggctcatcaagcataaatgtgttctttctaaatgcatttagttgagttctgaattcatgttcgttgggtagaaagcgtctatgacaatcaaaccaacaaggctttctaccattacggagctgaaaagattgagaatcacccatacaaattggacatgccaaacgaccatgggtgctccacccagcaaacatcccataggcaggaaagtcatggattgaccatagaaatattgccttcattgtaaagttttgcttgcgtgaagcatcccaggtttctaccccctcccataacttcagaagttcatcaactaaaggttgcattagaacacttatttttttccctggatgctctggtccagggatgacaagggtaaggaatgtgtactcgggcctcatacacacaccgggagggaaatttaagggagttataaatactggccagcaatagtatggagcagcacctaaactatatggagtaaacccatcagttgctaaagcaagacgaacatttcttggatcttgtgcaaaatcttgaaagtcctcatcaaattgttgccatgcctcgccatcacatgggtgaaccatgttaccagattgtgagcgactatgggactgcaataatcttgctatctcctcatgtgcatataacctttgtaatctatctttaataggcaggtagcgcaaaactttacgtggggttttgttttggccattctcataacgagaagtaccacagaaatcacacttctctttatgctcatcttccttgtaataaagcatgcagttgttgtaacaaacatcaattttaacatatggcataccaagaccttctagcaatttttttgaacggtaaaagtccaaaaccaacttagactcaggaggtaagaattcatggattatccctaaaacatcatcataatgtgcaactgacatgttatactgtgacttcatagctagcaaacgagctacagctgagagacatgaatgtgttgtattctcatggatcaattcatcagcactagcaaccatcctatagaatgctttagcataatgtgcaggttcttcactactttctggtggctgtgcactggctaagtcaaccaacatattatccatcctatcagattcaccaaatccctcatgatctattaatgaaggcccaggatcattgtcatttatcaccgatctctcaccatgtgatgtccatattccatagttctctttatatccgtatttgcacaagtgcaactctattgtatcccttttgtgcctaaaataattccgacattgggcgcatggacacttaatagtaccatctttaacaacttcttgcatagaaaatgcacggtttaagaactgtgttgtattatcaatccattcattagtgagagctttgccacgtgtccaaccactatacatccattcacgacttgtcattctgtggttaaaaacagattcaattcttaataaattattttaacgtgcatatatgtcactcttatttatcacaccataaataacatcatctacttgattaatcacgtcacaaaggatagcacaaaaagaaattatgtacaatataatcaacatttagaatgaaaaggttcatgtgaaggttgttattgttctatcacttactgcacaaaatatattacagtgaagtaagttgaaaatcctggttacctcggatttggtattgacaatgagacgatggtaagcaataacttgtcagcacttcagatgagttcgacacaatctgtaaatattagccaacattacagttccattttgcatagtaaaggtgaaactttcaagaaaaatatgtatgtcatgcttatactaagatgcaccaggatgatggtgtatcatcctttaagagaaaatcactctttttatgaagcttaaagtttattcactgcctacaagctcaattgtgctaaaattactattctctcataggaacataaatgttgtacagtccaaacaacaacaaaattactattatcacagaataaagcattcattgacaggaggatagtgacatgcttagagtgctgaagaaattaatacttacgaatagtgagggatttattcaaactagcagccaaaatttaaagatctttaggataaattccatgctaccagtataaagcttgtaatgaaattctagagaaaaaaaaaccagcagatccatgggagtattgcctcaaatcatacgaaaatccctaagaactgcaagctttatcagagttcgttaaaaataaacaaaaaagta

SEQ ID NO: 71661 - DNA, 1689 bp, Oryza sativa
agaagataagcatctccatggtgcgagccagctcgtgaaaatacagtatctagaagataagcttgaagcacagtcgagcctcccgagctcctataaaaggaggggtttgctcagctgagaagaacaacaacgaagacaccattcagagcaaagcttccaagcgcgctctcaccctccattccaccattcttagtagtagtgactttagcctaccttgcatagtatattgaagcaaggagttgtgtaataacgctgtgtaaggtaagaacagcttgcttgtacctaccttcgggtttcccgaaaagcaaaaccgtatgtaagcttatctgtttaatatgaagtaattttccttaagtattcctgcacgtttgttctagacaagtgtttatgctaaggaccctataggagaaacctcttccgttttttctcgtttttagcctgcatcttgcataggcgtctggagaatcggtatccgtagagaagtgttcccttcgggtggaactgcctggggagacgataaactcttggctagaacaagtgtgacttggaatatctttttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtttttttttgtctgaagcataagtgtggtatcagagccagtcattatagagaaatcaaattcagaagctaatattggaaagataattactaccaaagataatttgaatataaggtgtagattaaatcacattgaagaccatagttggcactctaacaatagtcaattaaatttaattgttgatctgatatataatttttatataaattgggataaaaagcaagaagatttagagcgaaggtttgaagatttgtttaaagaacgaaagcaatctgaagaacaatatttgcttgtcagtaataaattaaattcagtgctaaaagagctagaggattataagataaggcagaataagatattacaaaacagtgactatatcaaagaattattagaaataataaattctagtaaaggaaaagagatagtcttggcttcaacaggcataattacctcgtctcaagctattaattcagaaaaatggacctatctaggagtttgtttagaagaatagcaagcagagacgataaatctttaagttgtattgataaacaaaaaggtaaaaatgaagacatagatgagcttgaagatattgcagaagtagacaaacagctcgaaagatatcaaagagatactctgagggcaataagacctcaacaaatatattgcatgggatttttgagaataaaaatgggttatacagaatatctagagaagtagagttaagcgttttaacaaagccagttgagttaaaaattgtagccaaggaatttgaaaatggattaaagtattcagggtataaatatattcactaaggtatgtatataataggaatcaaaggtatgacaagaaagaaattaggagctaaagtttt

SEQ ID NO: 71662 - DNA, 27434 bp, Oryza sativa
ctcaacgcagcagcaacagcagcatatgccagcatccacacaaatttttcgtaaccagcagaagagagatcaagaacatcaagaacaaggttacgaaaaatgccggtccatgcgtgcatgcatgacagattcgacagaaagctaatcaaactgttttgtgtgtgtgtgtgcgcgcgcgcgcagttggcttccggctcgccaccggcagccgcgcgcggtcgtacgccatgcgcgcccgcgtgcgccgcgcgcgacgccggcgaccgaacggctcgcgtgcgcgcggatggaaaacgtcgggagcgcgcccgggcgccccgcccgtgacgctgaggattgagatccatccgtggcattggaccaagtagaacatattgcatccaactccaagtacatagtacatgcgagtgtagaggaattcaacctcgatcccaagtggacaaatcttcgtgagttgtgattagctagcatgcgaaacaggacatgaatcaaccgaaaatactgatatcatcagaagttcaaagaaattactgccagttctcctgcaggtagtattttaaaatttaaggggtcgttaaaattgatgacatttcaaaccatatcactttttttaaaaaatattaaatagtgtattcatttagtttattgtcaaactctagtaaagacataagaaatcctaccaaaattttagcaatatcgctaaattgctaaaatttggtaaagtttattttggagtgaagtacatgggtggtctctaaacttgtgtaggtgtgttatctagatccctaaacttccaaaatgtatttttagatccctaaacttgtcatgtgtgtcatataggtcctaaccggttcaaaccggctccatgcgctgacgtggcattgccatggtggcacctacgtgtcattgaaatccacatgtcaagcatatataaaaaataaaattaaaaaccatattttctcctcttaggtaaacataaaaaagacaaaaaatctaatataaaaaataaaattaaaaaccatattttctcctcttaggtaaacataaaaaagacaaaaaatctaaggtagagaggagaaaatatgcttttttaattttattttttctatgtgcctgacacgtggtacgtaggtgctatcatggcatgccacatcagcgcatggagcgggttagagctcctctggacctagatgacacctcaagacaagtttgaggactcgaaaatgcattttgagattttagggacctagatgacacgcccgcacaagtttagggaccgctcatgcacttcactctttattttggctacaatcttaacatgccctaaactatatcctggtctttatttcgaagaaacttcattcacttattacaatattttcttaaagagaacaaacactcatgcaacagtataaactgaataataaaaccaataaataaggagaaaacaactactgatcatctatttgtgaatctccatccgtagttggcgaaaatctataactgtaacttctaagtttcgacatatagaatatatgagcttcttattctcttcacacttttgaagttatgcccagcaatcgagccaacgtgttaccttgaaaagtgtgtgtgtatatataatgtttatttcaagatttatttaaaactatatcatttctacttaattatagagccaaacacaaagcaaaggctccaacaaatatgagattcttagttttcgcagctagtttacacggccatagtatatatatttgctagcttcctccgttgttcgtgaggtcaagaagaggtccactaccgagccatggaagccgtctgccggcgaaagaggcggtggacaagggcaacgacaccggcgagcaggcgaggcggtgtttactagtttcgagagtgaatggaccacacattttttatcaaacgggtgagatatgtcctcactcaatttcgttaggttttcatattgccccctcattcaaatcgctctggtagacacatggatatattccgaaataaaaatactatagaactggtatatcgttccaataaaatagctaacatcattatggtaggtagcagatctagtatctactaggtattatgtttggtacaggagatactaaatccagttcctcggtattatgctaacgtcagcatgatgcctattgtaccagatctgatatctaccagatatcatgtttgctatctccgatactagatttgatatttacagtaccatgctgacacctagttataagatctcataactacgagggtatcatgtttgatatcagagatatcagatctgataactaagatatcgtgctgcaaatattagctatttcgttggaacagtattccgttaatgtcgtctcccaaattctgaaaaccccctacaacacagttttgcaaaaccgcggccaacgcaggtacgtggtctcgcttgctgcatccgctactgtcgctggccctagccgccgtgcgacaatggtgatacgccggcaagccggagctgtcgatgctgctgcgtgggctcgcggctcctctaggaggcggcaagcaatctcgacatggcgacccccttcctgaaggatcagggaatcttgactggcagaaatggacccccttcctgaagccgccaatctccgacgatcaggcaggagtcgggatcagggaatcttataccggcagaaacggagctggaacattcgatcctggcttgctgtgcgcgtaacagatgctcatgcatctccgcttggactatcaatgagtcctcctctgccttctgcttgcttagaggatttggtgtatgaggacacatgattgtttaagtcaaatttaatttaaaaactactacatgattatatgcctgaattcagagcatcaatacgaaatgtggagcatgcctgcagcttgaatatatgaagtcctaccatttaagggatgacccattgacccacacattaacgagagaaaaagtggattggattgatccaccagttaacctgaatcttagggaaatatttcctatcatggtccatctcttattctctttccacctattcccaaaccaaatatcctgaaaaaaaaagttcaacccaacccgatccatccaaaccttaaggattgatgccttatgatgatctcctaaaagttttaagtatgtatttggacagctgggaaaaatggctcagtgatgtttttttattaaggctggagtggagtacaagtgtacaacttcgcatcgccagaaaatgtcacaggaattatcttattgtcgagtgtgcaaagcaagtagacaacaacgaaattgggggaatgggggataatgaaaatgcggttgtacatacatttatacatatttacccatgatatttatatccaagtgaccaagtgcatatatacacactgcatttatacaggaacgtaacatcctaaacgaccagatcttgtgaatatgtaaaaccaagaggaaactcaactaagaacagttctataatttcttgaacttacccatcccttcctgatattgattttgccgtcggctgtttgcatgttagaggcatatttaggcatatcttgtaacttatagtcaaacttttacctgtgacttgtacaggaaaaaaagtatagtgccaaactctacaagaaggatcttagggccgtcacaaccttctctggcctgcataacatgacaagtgagatgcgttaaggatcgcacaagtatatgaattggccaaaaggtaaaggttgaaggttacacgtcaaagcaggcaagcaccgatggaactatgagtacaaattttacaggacacagatcgacagaaaatactgagctagtaaaaaaacaattaccagtcctcttgaggcatatgaccagctccttctattggctccaattttatggctgcaggattacctttctggaactcctcagctatggggagtggcaagtacttatcagaaatcccccatgcaagcaatattggtttttcccagctgcaggaaataccagagagaagtttcagaactggaaaacattagtgataactgatacctgtctaatattgcttgcttgaattcagaatgaaccttttgacactgctgtgcatgcatacatatgtttatggacatagtagtaacttgcatgttatacggcataatctatctgtttttaattatatcagaagctaataaatatgtttgtttgtttaagttatctgtttttagttagaacagaagcaataacatgcaataaatatgagtgattgtttgtttgtttaacttacctgttggatgcaaacccggctgaaattctacttaatacatctcggaagttagctttcctggcagcttcaagcaatgctaaaaaaaagaaaagcgagatgtaactaaggttgtcaaataatctcagatggtaatgacagttctaggtaaaaagtagacaaaagaatataaaaaaaaatctaaacatcatttttcttaaagtacaaggaatacaacataagttgcagaagaagtaatagttgttcgatgctattggcataaggcgtagcataaactagatgatacttcacgctttgctgcgggatatatgttagacaatggaaaaatgatgaaacgatttggattgaaatattataaaaatgatttgaaaatgatgatttagcatgtgtgtgtttagttttagaatgaaataaattgtagatataattattatatgcttgcatgttgagtttcctgtgtttaatgggttgatgtggcatgcttgcgtgtaggttttaggagtgctaataaatattatgcttgcatgttgagctttaggtatttagtgggcattagctttatataaagaatggacgaacaaaacaacagtttttatatagatgatgtaatacttaatagcttaaacagatgccttcaacaagtataatccttccctccgaagtccaaggttcaaccaatataattgtcatggtagcctggcaggtacaacattaaccatgcaggctaaggtacagatacaaattgttggcccaaacatgcaagcaaatatcctataataaactaaacatggtacttttcagtaatcatcatatgtgtaactagtagggttctaaaaattgcagttttgctttatgaaggctaaagcaatataatcaagatcctttgctgaaaacacttatgtggacccagtgccatttcttcataagataacttccaaaatagctaggcattgagtgaaaatatgtaaacataaacttcgagtatttcccatggacagtaattaggattagctagaaggaaatagtttcccctgtggaattttcgtttcctttattatgaatatagcccagccccaagcccaggcaaaggaggaggttgtgacaagcttggcaagccaatgtgaaaaacccaatcattgcgatggagggtaagctagatggaaatggctgtgcaagcagaatttgcatttccttcattaggagagatggattctataaattgataaaacatagtcatatagctgacaatttatttaggtacgtttcatggctgagaacaatacaactttaatgtaaagacatgttgggggcatgtgattcaggtgtacagactaaccaaatccaggtgcaccacttgatagatatggtaatctgtatacatcagccttctccgactttagcacatagctgtgaagcaagtggacacaatataagcaaatatgagaataaacaacatgccacagatatggacaggactgatatagaacaacataatatgaagaataaaccaaactttttccttattttgagcatatcagtaagaagaataatgataacatatctgaagaggagaatgaagaatttctgtgacaatgatagatacgtacgggctacctgcttcaatgaatctctcagccaaaacagcattttggcaggtaaattcaccaaaaagtggcaacctgcattgaaatgtgacttgaatttacttccatgatacaaatattaagggcaaaaaaggcaagatggcatcaactgcagcattagtgaaaaatattgagcagtaagcaggttaaagataaattctatttgcacatgtatcaaatactcatactctttttaggaccagcttgtataaagtccaaataaaagttaatagcgaaaaaccatactacgctattaaggcggatgaaagcattaacataccaccctcaaggcattttctatataataagtccacaataacatccgataaaactgaagaaggaaaacaatgtgaaaaagaatatgcacaatgttcatttttcgggtagatctggacgtcaaattgctcatgcataaatttatgtcacactttcaggtcaagctttgcgctttcagacttctgctcaggctgggttcgggcgggcctgagaaattgtagaaatgccaaggaaatggagctggaacattcagatgtgcagtgactagtaaagcagtgactgatgcatctttgctcagattcttgcattatcaatgtatagcggatttggttgatatgttggtgtacgcagacatatggcttgtttttaagttaaattttgttgaaaagctaaagaactatatgcctgaacttgtagcacaatgtaaaatgctgagcatgcacttcaattaagatgcaaagcaagagaaacagaaagactgaccttagctggttaaacaatccaggcactggagaagaaacagtgagtggactgttaagaattgctaccttcagaactttgcttgagttctttagtgcccatgttagcccatatgaacctacaagaaatccctagaatgaaaatgaaagaaacgattcagaaaatatatatgagaattattatgaaaatgcaggttcctaatgttttgggcatgtacctggacaactaagaagaatggctcagtgatatttaaagtactaagaagctcatcgagtgacttgtggaactcctcttctgcacatgatacaatataaatgagagtttagtaagattcattaattttgtcaacatttgccacacggccacacctgtgtagtcgaatccatatccgggctgtggcatatcactgaacccaaatcctatccaatcaggagcaaagcagtggtagccagcatctgccatctagtagcaatttcaatagctgcttagtgggtaaaatgatcgatagaaacaaatcgttagtacgatttataaatttatatttaacatgaggatccctatttattaagcttccagtataatgtcataaatatgctccatattcaaactatgtttttcttttaaattttaatagtctctggaaggtcacccatctgtctcggaatcataatcaacaggacatacacatgctgcagctgttagatgtctaaagtcaccacttaaatggtgcatggagctaaactttgcagcgaaagaaaacatattttagaaagaaccacatactaatttaagccagaaccactgatattttctgtctggtaatgcaaatcaagaacaacaaattgtttcataaattaagtttagtccaacaagctgcaagataaatgagtctgacctgagacataaccatacgatagctaaatgactgagatggagcaccgtgaataaacacgacagtcccacgtcgtgcaccagcggaacctacaattgtatcaccatatttatgaagcaattacatggggctttttatttgacagagacaattgcaagatggctctgtttgcaagaacacctggtgagcccttcttttcatggttcagcaatgacaactatacaaggacaaggtacaagacaaacaaacaaaaaaaggtacattttccttaagttttatagaggcagaattatagcaaattgggacaggttttgtttcctttaaaagctttgcagaaggagatgaacttatgtactactgtaggagaaatcaatattactgaaatacacaaaggtctgacaaaatccactatcttagtgaaagtatcattcgtttttattcttaaatactaaatttgtattcacaatgcaatactgcttcgtcgtcagtacacaccccatttcactggatcaacgtgcatacaacgttttactaacgttcagtgatcactgcaataagatcatctttcatctaaccaacacagaaatgaagaaacagtacctgtttccctcacaaaccaccgcagctttcctgatttcactcttgagccgaactccctccccttgtcctcgatcctctgcacgcgtcgagattactttacagcatactagaaatggtcaacaatgatacgagttcggaatcaaggaggtgtggcgaagtgggcattacgtagagcatctggccgacattgccgtcctgggcgggcgactccggcagctggatggcgccgcggctcgacgggttgtccgtcacgaacccgaacgggttgaactccgactcctcctcctgctttttcccctccgccgtctcatccttgctgccgctcgccgcgactaccaaactccgcttcgctcctcctccacgcgccctccaagcggcggcgttggcgctgctgccgccgccgccggaccacctgcctctgcaagcggggcgtggcagggagagaggagacgaggtggtggtggtgcaggggcagcaggacatggcggcggcgttcgggtgggtgtgcgcgcgcgcgctccggcgagacgtggcggcgcggcgagacgctttcggttggcgcagccgcgtcgaacggtcgggaagaaagaagattctccgcgaattgcggtggggccgacaagatcacttctcatgtggctcccgtgcacaaccgcaggtgagccactctctcactctactctagtctagtggccacaattgaatcactctggaaatccatgaattttctaacaacaaaacttcacaattcagcaacacaagatggctatgtactgtacaacttattggtaaattcgccataaaggcaacatcatctagagaaagtttgaggagctctttgttgtccaccaaatggaggagttgttctatgtttttttttctctagttgttcagaatgcaattgggaatgggtataatctgtgcaaccaatcatgcagaatgttatccttgagcttggtgttgtggcctgcaacctcctggtccatttccatagctggggttatggtagcctggtttgttgccagagcctgatggaccatttgatcttccaggatgtccgtagtgatggtgatggtgttcttgccctggatgcagaactggacgccaagggccagggggagcaaaattgctaggtggcctcacgtgtcctgaagttgcaggaagattggccattaaatcaaatgttgttcatcaggaaaagtaccatttttgtttccatggtttcacggggaatgaaaattacctggagtaaatggaggacaaggatgtggaggagcatgacgaggaaatgggccttgatttgcatggaacggaggacgccaaggatataagtcttgacctgcaaatggaggacaacgccgaggaaagaagccttgatttggtagtacaggtggaggatgccgaggaacgaagccttgaccagctaatgcaggaggaggacaccgaggagcaaggccttgatcttctagtacaggaggaggaagccgaggaacataaccttgatctgctagtacaggaggatgccgagctgctaaccgttgatccccttgtgcaggtggaggatgccgaggaaacgagacttgatctcttggtatgttcagacatccagatggcatatttggatcatgaccagaagagatgtcttctacttcaagtggagtataagatttctgagtaattggaggaaacacttgtgatggtgctttagaccctgtggagttcttcaaagatggtgatgtatgtttacttgaaccgctttgatgcagtttctcattatccaacccctggaagtgacactctggcatgtcttcagcatcaatgtcatctttgctcttgaagttctctatttctgccttgcgatgagatacttgattcgttatctcccttgaaatcatgtctgtgacattttctttcacctcaaccttttcatgattcttgatgccttcaacttgaaatgatggttgcgatgattgctggaatggactgtttgacttcttatcagataacctagggcaaatcagcacatcagaagttattgtagtttccctgttgattggatgcacatcaaatttcaactcaactaatatggagattagcgaagtcaacttttggaaggtcatctagatcattagctctatgagctccataagtatcaggctgcagcaaaaatggattagtctcctgttgttttgaagactcaacagcatttgatgcatattcttgagttatgctgcctgagaaggcctccgccatatgattctacacaatttacaggataataccattcaacagattaacacttgcaaccaaatagaactgattgcacaagtaactagatgagcaggttaccttttgtgcagctaaatcatagtgggtagttctctgctgaacatgcaaggatttcagagacaatccttgagaatgtgaagtaggatgccacactccaaaagatccagaatgagaatctatgatggactgaacatgttgctgaatttctgggacttcatgcgatgccaattcgaacggtgaaacctgtgacaactggcatcctattagtgatggtgctttgaacggtggctgcggggttagctttgatgcaagtttgaatagagaatggggcactactttttctgtaggatctctttcaccagtactcttagcatgcccacactgagatagcaaacctggataagaagtaaacgtaaataattcagtaatcaccatgtacatgcgctaatcagtgaaagaagtttaccagttgccacaggatgcgttttcacagaattgctctgaatttcttgcatttgatcaatatcattctgaatattgcctgtgtttgttctagagtccatgccaggattgttggagcatgatgttgcctgatgtccatctgaaaatggcaacgaagttggatgccttgctccaacatgaggcacacaaggagatccctttccaatagtttcagacctgctatgatccacaatttttgacagtggatttcggcgccacacaatgcaccctatcaacgagtcttggtttgtatcagctgctgacatgcctttaaagaaaccacatttcgctaggattgtaattacagcatcacttctggggcagacatagagattggaaccatcacatacatctgcaaaaccaaccttctggctcgcttcaaagttctcggcaacctataccagtgtctcaaatgagttagatccaatgtccagaaaagtccgtagctgttatctcaaatgagttagatccaatgtccagaaaagtccatagctgttacagatcaaaatgtaattaagtgcttgtaatacctctttcattcccagtaagccagcttttgatgtcccaaacttccaacaaagagaaattacctatacatacaggtgttggaatattattagcaatgttacattaactggtacagttaccgtagaagacaaaatttacaaactctttctccattggttttaaattcataagcacacaaatgtaattaagcctaaaagaaagaacctcaaagcataattaagtgggatgaaccttttttagcgcaaaaggtagctaactgtgcatttgattagcaatgaacatagtggatatttacttcaagaatgaaaggaagataaattatcaaaggtttattaatatatcagcaaggattgatgagaaaacaagaaataatcttaccatcaaagatcgggtttgacatcgacggagttcctggacaaacttttcaaacacatctaatttcactctccctttgatttctatgattttcggccaagtaatgtcgtgatttttttctccgctaccaagaaaacaagcaaagacgtatttaacatgaaacaatgtataccctgtgaaaatattcatcattcacaaagataacttcgactcaagctaaatagagaaatataagaatgattattcataaaagtcagtcaactcagcacaagaactagcaacgtagttgaacaaaagtagcaactataatttctctagcaaaaaaatgatttatcaaccgcatagcatcagactagttgtgcttccaagcggcacaaacttagctctggcgtggttatcaagttttgtacaaaaacaatgagatacacaatttatatgcttccagaatccaataaaacttgttgaatatggtatttcagatttgtaaaaaatggatactcttactaactcctcaaagaggcacataagtcacagctaaataggaatttggtgaagttttctacctttttagtataaagtagcaagcaataatcaaatgtagattgtaaaaacgttcatggcttttgccaaggtaggatcagaaatcctatatttattagccttactatttgtctgaagctaagaataaaactaaatacgatcttactagggatgggatgatgtaataaaatgcaccatagagcacaaatatggacactatagaattatcattcttagtagacacgaaagtcaccttttgaagaaggcgatcacagacaccttgacagtgctactcaactggattgtaccatcacataggctttcataagcagaaggagatagcaggccaacaactgacatgatttcatcatccaaagaatgaggagacaatatactagaactatcatctgcttttgtagaaccttgtacatcatgtttagcttcatagcttgatatcccttgcttctgttgaattttttcaagggaactctgagaagggtgaaccatagctacaatactctgatcacccttttcacagctgaaaagtaacttatgagccacagctgtctggctctgatctgttgaatctgcatacttagcacaactattactagactctattttagtgtgcattagttgaaaagtaatatgtggatgcataggtttgcttggtgttgtatgatttgtacactccatcaatagagagaacgattgagtagtatcctgacagtttgatgtgccattatttgttgaaatggtgtgcagtatggtttcatttggtttgcatgaactagttgtacatctaatgccactcagttctgtggttcctgacagaatatcttgaggagcaaaaccctgtgagttactcaaaatagagctcaacccagctggaccatttagaaatgattcttcaccttgatgactatctttagcactagtgactaacccagatccatgagaaacggccctattagattcactgtagtgaacagagttcaaaaattttctttttcttggcgtataaacctgaaaaatcatgtcgggggaattactttggcccgacatcctttcctctggaacagaaatattatatggttgtttgttccacgctgttgcgaaggcagaattaaaggaatgaaatcaactgtagattgcagcactgcttccaacaatagcagaatgccagaatatgaagcctgccaaaaacacagtgaataggaaggcccagtcactgaaattggtataagagtgtgagaaaaagtgacatctttacaagcaagctaatctacatgtaaaccattccctcgcagttgctctggaaattcagatggttctatagggaacatcagttcactactgacaatccatgcagtgacagaagagcgcaaacactgcaaaactccacaaaattgatctcctttgcgtgtaagctgccacccaaacaagtaactaaaaattgcccatccgcaaggcagcattaactgaaggaactactagcgcaccactgatttgcagcatccaccacaaaaaccgcagttagccaatgaattccaacatgactactgagccagcatgcagccccttttttacactccatcctatgatcgtccaattttggagggatcaaaggggaaaaaatcgggataagactgaacattgggggggggggagaggaatggtatctcgattgatggaaaaggttcctgcgccaagattacaccctaccagcggcgaaaagaggccgctgccaccgccgcctccggtggctaaggggatccacaagctgaagcatgtccgagaaaaactcgcggcggagggatttgtggaggaggaggaggaggaggaggaagcacgagttcacctgggagagatgaagttgcgagggttttgggcgtcggaactcggaactgtccgatcgacgcggcgtcgagcaggcgagcggccgcagcctacaggaagcaaccgtcggagtcggacgacgaaaacactagcgcacgcgttagttttcacggaggatgcacacggaacattcggaagggtaaagggcagaagaactgcaggtgggaccacccaactttcctctttttcctttggactaacacaagtcacaagggacacaatgtatcccaccttcctaggaggagccaccaaccaccagtgtcatcttttatttatgtgtgctatattaaaacccatatgtatccaagtgtaaagtgtctatcacatttacacacacataagtatggtttctcatctatttaagcaaataagggatagagatctcaaattaaaaatctaggatcgtgaatcagaagtatttagtatgaatttaggtttgagagctaacaacatcataccctatcgaaaacaccaaaatcaacatacatagtacaaagcaaaccacaaatcaaacggtgttaataacaaatctaaagtaaatcgcaaatcaagtggtattaacaaaagatgtaaaaggagataaagggatttgcttaaacggcgacaagaaaaagtgagcaacaattgagtgatgagatagggttggcgtgaccgtggagggggcacgacggtaagaagattgcagggatcgtgtataactagatctacataccttgggaaggaaacatatgaggcgcttagctctccacaagactaccatccatgggaagcggcggagaccggagatagaagggataagatgcaagagtgagtgagtgagcaaagccaataaatagggaaaagggaagcactgaaggtgtaccctagccgactagccctatgccacctaatacaatgtttgcctatatgggccttagtgcataacaagtaggttgggcttatgagagaagatcaaatcgattgtttcttctaggcccaactatagtcatagtcaaatgaaacttgtggattgggcatacattgtgtactattattgccatagaaagttacgacactactttaaaagaggcttcatagctagcccatcacgatcagttcataatggattctcgcctaaatcattatgaattggcaatgttattgagtatcaccaccgatatgctctagctttgaaactacagtcgtgcaactgattcccgaaccattgccaattcgtcggaacttcgaatacttaacgactcagctctagttgctaggccacccgaatattgcaatgggcctgatgatatgggccaccaacggtaagactatccagatcgtcaatgattcacccctacggccaccgctagagcaccatcaaaactctaccagtaactaaaaaagggtgagctaaaaacctgtcatgaaagtgtctcactatttcttttttctctcatccttttttatgaaactggagagctcctatgttagatttaatttggcactggcccatttaaatcaactaaatcaaataaatctcaagactcatggaatgctaggagttatggtgtttaattcatcatggataattaggaggaaggtgtaccttttctgagaattattccaagaaatgattaacaaattggcaacatacgtcaattgtatctaattgatggttagttgatggtggtgtagtggaggatggttgatgacaataagttactctattccttttcctatcacatgagtctctttctcttcattttccttctatcctataaaaggagaatggatctgatttcccatgcgcgatagagaacatatactttcatccattttcactttcgttgctgataaggtgatcccattctgacaagtgcgtacacatgcgtgggagagcatgcctctgaaacccccatctcctgatcttgcacaggaggaggcgaattaggtttttggtgagcacatcgcgtgactcctcgccggtgttcatgaatgactacatcgactagactacttccttttcatcatggctagtggcgagaatgtaaacggctacggttatccttccgctacaactattgttgaagcaccgcatgttattttcctcttctattcttttctgttagttccgtttatatgcgcaaacgagttagatatgtttgtttcgatggtctacactaatagcatgcctatttcgtgtattcttcttgttgagagtagttcatctatggataacgatttcattgtttacatttacatcgctatggtttactctgtttatttctaaattaagtattacgatgtctgacatcctgtattggaagctagtaaattaacgtgcaattacattctcatggctattagccatgcaattgtttgattttctagatccatattcaattgagttagactctcaaggataaaattagcctatgtatctgttaacagtaaaatttggtaatcggcaaagacgtcatcggcttagaatcattatcggctgcagcatctcggaatcagccgatgggagttatcaagtcgtcaatagtcgggttcctgctatatttgattaaggaaatcaatctactaaaggaagcttatccctaagtgactgagtttaaagaggatgcggcatggcaatttatctattaattaggaatagtttgttagtttccttttatctttaggttagtttctttcttatccgacaaggacttgtatcaacccatgggtataaatatgtacacccggggtctatgtaatctatcctcacaatcaatacaattcggcgcatcgccaccttttaccttttctactttattttatcgtccggcgagacttggcatctgacgcggtgctgcatcggtgttcgatctccggcgaaagggtaagtccaatgttccgtcggcccaggcaattgtatcgtttacgtcggcgtcgttcaaggctgcatcagtacattcaacctcttggatcgctctggtttggatgatatatttgcctacctatttatcatatgtctctattaatctagtcttagcatatcaatttagctctatcggctgcttctcgttttagggtttctgccgatatcggctaaatcgcgttgctagattagattagctcagacatctaccaccctaaaaatcagtcaacggcttgattgtctagatattatgtttcttttcatacttggtgctgcatcagttaagtttgatctactaagtcatgcttaaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagcttcagctctatcaaacggttatgcttcacttaaaaaggaagtggatgaactgattagagttctatcacaaaataaattaaagaaatgaagtaaagtttaagctacttcatagctctattctatactcaactcctgaagttaattaaatttataagagatggagttttaccgaacatgcagtactctcttagctagaaatatgtggcgtatccgcatagactgggctgggatagagaacaaggcctagttggttttgggctagaattttgacgagcctttttcacaaaaaagagaacttttgatggaccatcaggcatcagcccgagccccaaactgggccaggcaccatcagtcatcatctctctcggtctcggatagcggggatgcgctttgcgtaaccacgtaacgcgcgcacgtacacggcacggtacccccactccctggccaccactgcttcgcctcgacgagatccatacctcccgggctcccggacgcgcgcgtgctagctcgctcgccgatcgatccatcgtctccacgtacggccgcgcgaaggcacgtagtgaggtacgtgaggcagcagcagcagcaagcatggcgggtgcggcgtcgccggaccacctgttcggccttcgcaacagcttctacgtcggcgcgtaccaggccgtcatcaccggcgtccaggccatccccgcgcgcgctgccctctcccccgacgccctcgccgagcgcgactccctcctctaccgctcctacatcgccatcggctcccaccaggtacgtacgcatcgcgtgcacgtgtccatcgatcgattgatcacgccctgtgtgttggatgagaaaattggcgtaatatcatcgtcaaacagggtttcgctcaaatactactaagcagttggaattcgtcgctgaaacaccattttcttccaattctctctttcctcttattttttctgaccaaaatacccctagttgaattaattaattttactaggggtattttttttaagtaattatgagaggaaagagagaattcgaagaaaatgacatgagcgaagcccctcaattgataatggtatttcggcgaatctcaactgcatagtggtatttgggcgaaaatcctttttgacaatggtaaaatgacaattttctcgtgttggatgacctagctgatcgactcgtcgagcggttggtttctcgtgtgaaatgcagctggtgatcgacgagatcgggccgggcgcggccacgccgctccaggccgtcaggttgctcacggtgtatctctccggcggcgccggcggcaaggttactcctgttgttgtttcatccgcgcgtgcatttcaatttggatccaattaattaccgcgctatatatctcattgtgcgttttgtaatcaatctctgtgtaattaaggaatccgcgatcaggaagctgaacgagctcctggcagatgatgcggtggggagcaacccgattctccggctggttgcagggacggttctcatgcacgagcgggactatgccggagcactgaagcacacaaattctggtgggactatggaattgtaaggatcatccaaccttccatgtaacttttgatccattctgcacagtatcttatttttaccccatgtgttgttccatgattgatacgattgcctgctcgcataagaattatatatagctgaagatttccatgccatcagagaattactgcatgttatgttttaccattgggaagactgaagtcactgaaccgattcacgtctggtgtttttcaggcttgcgatgaatgttcagatatgcctccagatgcacaggtctgatcacgcagagaaacagctgaggataatgcagcaattggacgaagaccacacactgacgcagctcgcaaacgcatgggtagaccttgtcatggtaggaatactatgggttgttacttgagagttgtttatgatgataaatcaaagaggcaggagagaaatctgagttctactgcttcccattgcttctgattctataccagggcgggtccaagatccaagaagcgcacctcatcttccaggacttgtcagagaagtacccagcaacttgcttaattcttaatggtaaagcactgtgcctgatgcacatgggtaactttgaagatgcagagggattgctgctggaatcactgaacaaggtcagttctaatgatgtttttagatcaaaagttctaatgatgttaacctgtccatctgagcatttgctctagataatctacttctcaaacagagtgttagtgcttaacaaaaaatggtcaaactgttcaggatgccaaggatgcagaaactctagccaacctcgttgtgtgcagtctgaacctaggaaagtctgcatcccgctacctgaagtaagtgggttctacactgttatattttcattttgaaggccatttcctaatgccttgtcttatttctgcctgataagtcaagatgtcaaggctctaataattgttatatttctgtacaatttgagcgcttaatctgaactgtaattctgataaccgttgcagccaactgaagctggcacacccagaccatatgctggttaagcgaatgtcctctgctgaagacagtttcgacagagcctgccaagcgatatcatgatttctgcagtgctgttacttactttgctgttagataaaccaaaagcaatgcaacactctgatcttgtcatgacctagacaagctaatttttgttcattagcagttcatgaacaatcaacagaagtactacactttgtcaataaattggtacgagtacatcagtatctttactgaataaaattacggagtacggagtactatctcttgatgcattggcagctgttgttaaactaaatgaattggcagctgttgttaaacaacaatttcggaaataaatgcagacgtagtacaaatacatgctgttttccggacaagacagcatgtgagctctgaatctaacatgtgagagtgccaccataccaacaaaccacgattattatataggactaggagtactaaatttaatttcttagcaagagtcagatgtatctgccagcaaaacaatggataagaggagtacgaaatctagtgacgtgttacttaaaaggacacctaatcataaggatcaacgacagagacagaggttagtggtggaagaaagaatccgagagaggaagagacaagagtccagcttacactccatcgaccaccgtagctcagatctattccaaacagcgatcgacacagtcagtgcaaaacttttgctaaacttaaaaaaaaagagaatattttaaaaaaattgagagagaaaatttgctaacgctggaggaagttcttgtcaagaggcgtttcagttcagctcttcttcggagcggcgtgctgccatctccctaccgtttctgaactcaacttcccaaacggcccagcgcctgctatcgcagtcacatacatgtggggcccattttcgcttgggcccagtggcagtgacccgcagataaaaatctcgcgatccattccacccggaattttatgacgttaaaccccacgtccccaccaaaccaccaccactctcctcggcttgtgtcgcgtgtgtggcgcggcggcggcggcggcggcggagctgagcggccgcggcgatggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagtacggcgcccccctcacttttcccttcccaattcgaggcgcgcgattcgctcgctcggttttccatttgcgatttgactccatggaaaacgcggtgttcgtgggggtgctgcaggttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcaggtaagcagcggttgcagagtggtttctacttcagagttcagactaggttggattcagtttgagtaactgatggactttacttctcgtgttgtctgtgttgactcaaaattgatttgatcagatacgggacagcgtttgcggtgttcctggtttcgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaaggtagactactgttatatctctttcattcaagttatttcatcacagagtactggtaattcttgacacttattagttgtccctgtgatttttttttccaagaagaagttgtctctgtgattgatttgtggcaaacatatatctagtcttttgttccattctgtttttgttcaacatcattggagacgatttaaataagttgaaaatgttggtctgttagacatgatcaggtttgtatgggctaagaaatcatgtatatataactacgaataatatgcatggaagagttaggaaatacacattgtttggtctctggcaggacatcagtgtctgtgtctgtggtacaacttgtttgttattcattttggagcagctctattgactgttggacatgtatatatagtttgcgatgtaactctatgttcacttcaaaagcagaatttagaacctggcaattagtattgagttctgtgtcatctggagattttccccgttccttctctcttgaccaattgtcatctcggtgaagcatgactctttgtttgctttctttagttttccatctcagacaaatgcagggcaatctttttcattttaatttctgatgtttttaagggaaacaaagaatgcatttagaagaattggggtatgaaaccttttagtttttggattagttctgatgtattgacataacctttgcataagaaagatcatgcctatcttattctgcttgaatgtcggggttcaatttggagatgctaaaacgattctgaatgattggttttactcaaagtgaacatgactgcccaaccactctagggcaatggtagctagaaaatatgttctctgacttatacataagtgataaattgttatgcaagaaaaacaccattgttcccttccgttgatatatctggatttcatatatactgttttttggacagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatggtaacaactttgaatatgcatgtgaaaactccttgttcttttctgttactaattaaaatgtgaaccacacaatttctgcaagacgataccattcatatacagtgttttgtttacaataccattagctccttttttgctttctttgcaggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaattttattaacgagtatgtactgctgttggcttaatgttaatgatcttcacttctgtaattttaaactgcaggcgtttcatatttccatttcccaaagctttagctgacatgcacacattacttccctgtactttattaaaactgtttttaaaaaatggcaaagtacacctactggcatattgcagttatctgttagacttgcgcatcctttttgaagtgaaatatatccctaaaataacttgccatgtaacctcttcagcttactttcaggaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaaggttagtgatactattcacaaatatatttttttgtcggattcttcttcattctactttttatttcctttgctttgtctagataggtctagctattttgcaatcgtcagtgtctattaccttttagaaatgcctttttagaaccaaagggtgataggctgatagcattggcacccctgtttcacttttatattggcaaatgttgcttccaagttccaaccatgaccgttgctaagacaaaccaagatgattagtggcaaaaatctctaaatagccatacatattcttcttggttactagcagcattatcgctttcattgctcatgacagtatttgaaattataaaactttctaataattaacagtgataaatctttgactggttaattcctatcaatgcagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctgacgctcgctagtaactgatgagtttgctcaaggatgcactgctgctgtaaattccatcttgatgctgggagctgcacagtataatcttatatgatgaagaccacaaaaaaatgtagtagattctccagcctgggaatctagcagctaattgtactgcattttcttttcttttctttttttgttacgattgtaccgagtggtaccatattcagaatgttcaagctacaatggacagtgcaagtaggaaatctttttttgtaaatgtaaatcttgtttggaacgtacaaattttgttagtcgaaatgagtttaatcgaaactataaagatgcatgatatataagaataatcatcattccataacttctcgtaactgcatcacaaactttcgttttggcgttgggctatcgctgggtggggtcgacgagtccgaaaaggctaggggcgtcgggaagaggcggcggcgtcgggcccatgaccgaatgggccagctgaaatttataccgggcttttttgttgggctttcgggccggctattcacatcggcccacaagcagccgcggcgtcggtgggagcctacaagtactccctcctaacatgtgaattcgtctaggacagtgacacggtctccaaaatataattttaacttcttatttctataaaaatatttattgaaaagtgatatatgtatacttttatgaaagtatttttcaagacaaatatattcatataatttttacattttcaaactcaataacttgagagttatttatgatttatattctcaaggtttgacttaaatattattctaaacgactttttttttttttgagtatagagggagtacaagcctactgtatgaccatgtccagttgattacgcgaaattaattactcgtatttcaccggcgtgtttgtaaagtgattacggcagcttttatgagaaaaaccagcatttgcaattagatataacgaatacgtattaaaataagttcacaaaaacaaaacaaaaaattccactcaccggccgaatcgtgtggtataggtgcagccaacgtgtgcccggagcataaaacgcacggctcgaatgggaaccgattcg

SEQ ID NO: 71663 - DNA, 19884 bp, Oryza sativa
ctggcggtatataaccgctagcgaagttctacattttcactggtctttcctttgtggcagctgcgatttctgctagcggaaacccaaaatggccgccataaaagatggtttccgtagtagattcccatccatgtactaactccgttcaaaaaagaatcaacctaggatagaatgtgacctatccttagataataaatctggataagtctttgtccagatttattatcccaggatatgtcacatcctatctttatccagatttattatcttaggttgattctttttgagacagagggattatacatttattatcgtagattgattctttttgagatggagaaagtatacatataaacttgagtacgtttattaatcatcttgagggcccgaaccaatataaatccttgttacttgttctctggatgcgatctcgcgtacaccatggtcccaacaatccccatactctacaaattaataccgttcacgggtatagcccgttgaaaaaaacctacgaacaggtcagcgactgtgacattagaagctttatgatagattttcctttttagctttatagcggttgaagaatgtaattttatttccttcatgttgaaatttctaatcaagtgtttcctctacgaagatgtaagtaatagaatctctacataaatgtattaattttggaagtaattaactcgcaatttctgattttttttattgactgcatttaaattaaatcgtctcaaatgatttacggataacgaacttactgttattaccgtcccggttttctggtggtcagcaagcttatacaagtggtattcactttcatcagggtttgagttatacatggaagtgatagaactaagatacgtccctatcaacaaattaaatagttgcatatatatatactagagctgatgctagcgcgctaaggtttcacggccgtttgagtcgtacagttcgtacacctagactatttttttcttctccggtacgtatagttgccaccggtttaacagtcgatttcagatggcacatatatatatatatatatatatatatatatatatatatatatatatatatatatatatatatatatatatagtctataccatggatcacaattccgaaggtatatgttaagattataggcatataatgatttaatctattccataaataaatcataatattacagatgaaaaactagcatgaacgcaccattagatctacacatgtaaactacacagtataacatgaacagatcaaatatgcgcaacatattgaacacgtaccgaggtggcggaaagaccggctgctcggtcgaaacttttcgtaggcgtctacgaaggcacgcagcacgcgagcgaagaggaagacgagccgtcgcggacgaacagggagcagtcgtgcaaagcgcttcccaaaaaccttattgctgccttctcccggtgcaggacgtcgaaggcacaagttctggagacttgctttcccgatcgcaggtgcacgccggcgagcaggatggagtaatctatgagcgacggcgcagcacagagtaggaggcaaaccctagattgatttcgcgtgtgttgcgtgaagacggcgggtcagtttatatagagaagggtcgcttgatcagggcgcccgcacgatttccattacgcgtaaccgaaccggataagtcgcgcgtaacttatccggactccacgccgtttgcacgcaccggatttttcggaacgtttccaaaacaaaaacgaaaccggataagtcacgcgtaacttatccggactccacgccgtttgcacgcaccggatttttcggaacgtttccaaaacaaaaacgaatctgaatttgcagcaaaacaaaactgcaaaaagaaactgcatctgcgcaaggtgaggaaccaattttggtggaccattcgacgcgtacatcgtgcacgtgcgccgcctgccctgccaggcgaggcgagcgagcgtgcttgttccccctcttctctccaccacacatgcttcaagtggctaggagggcatcctcccttttaaggaggtccccctatgctagaataagcaaggtggtactaaactccacatgcatgccatctcatgaggtgggcttttgttattttctaaagaattaatcttcgagtgggctaaggcccatttattaattccaacagggaactgcatatctgtttgtcgacagatttttggggcaaaatcacccacatttttccagcctttagatctagatccaatgcatagaaaaaaatgactacaaacaaactttttaccgtctgggccttaggaaacaaaaataaacaacaattaggctgaaaaacaagcccaaaacacagagcccaatagaaattagacacgaaattatcattcaaaactttgacacaatacaaatggtcggaaccatacaaaaacaaaccaaaaaaaaactctatactagtgtagaaaacagattcaacagtaatattttcactgcagagaaaacatgtatcaatcagtgatattttctctaatacctttaacaaccgatttgatcaaatgagcacatctcatatgttgagcttgaaatgccaccatgaaactcagcttctgcctgaacagcacatgtcacgattgtagaaaacagtgcatcagtaaacagctaggatatacaacgagatatctgcaaaaatggggattttctttgtgcacgaaattttctttgtgaaccaaagaactgaaatcatataatcctttatgccaaaattaactctgaactaaaaattcataataactataaaaatgcccatctagcagggcatcagcctccccagattcaacatagacattccaccgtgacaagttcaattacaagaaaaaatgaatatctagctaccaatagctaagttagttacaagaaaaaaataataagaattacatatgtaactaaggtatatttccactgtaactagactgtaagtggtgatgagttgaactgtaagtatgatctaagttatactagtgatgaatggtgctgcatgaaacacaaggcaacacagataatagaaaataacggtacaaaacttagcctacattactaactagcaaaaacaagtttgtgcctagggttcctcaaactacaagtttgtgcctaagaaaatgaagatgcctagggttcctcaaactacaagtccctcagttttcacacaattcattgataaaaccaatataaaaaaagttacaatctaattaccaacagttagttacagtgagagataacataaattacaactgtaagtgaggtatatttccactgtaactgcactataagtgatgatgagttgtactgtaagtgtgttttaagactacatgaaacctaaagtattgacttcatctgataaacaaaattcataactaaaaataccatttgaaaacttaactaaatcaccagatgtaagaagagggcattaaatacagatttagatcagccattcaaatgcctcaagagatatttttttctggggtattttcctaagagaaaacatctaaacgttacaaaagaaataaaaaaacactaataaaccataaaaggcacaagttctccttttctgtttgaatgaaaggaattaatagacacataagagttatgtccaggcgacacttgttatgcaaaaatcaagcagaatctacgcaaagacaaagaaaagaaagttaatgttggttgcatacactaacaggcaacataaatgaagtggcctcacacttgcaatgacgcaagaagcctagctaatttcagtaaaaacatataactaattcaaaaatggatgatgaccctacacatcattgattggaaaaaaacctacaacacaaggggaagcagcgcaaactcacacatattctaacttttgcatgcacaactgacaaaaggagtccctagggttcccaaacaacaagtgtcctagttttcacacaaatcagtaataaaccaatgtcaatcaattacaaaatctaactaccaacagtcagttacagtgaggtataacagaaattacaactgtaagtgaggtatatttcgactgtaactgcactgtaaatggtgatgagttacactgtaagtatgttttaagttagaattactataatttcatactacataaaacacaaaatatttaagttaggtagtctacaacatgattctaatgctttcaattacatacaccaaccatacttgtgttaaattacatgtaggggttgatagaacaaaggctcaagtaacaaggacagttgaaggttagaatatcatgcttacctattattatgcatcatatctgatcttcgtagaaaatttcatctagcacaaatttatatataaaaaattagtcatgacacatgtagtaaataaaaataatctaactacctacattcagttacagtgagaaactacaaaagttacaaccgtaactatagtgcatatggactttttacaactgtaacttttgctatattaattttccatgagaaagtatatgggtgtggggctagcaaaatggcaagcttcacgtaactagtgtatacaactatcaatctttaccaagtaagtacaatattgcaatggttcattcataataaagaataaaaaatatgcaagcatgcatgctgctgatgttctgaatgatgaaggaaagtacatctaaactttatatagaacaataacagaagggaattgtaacagaagcacatggaaatcatacatcaccttgttttgcaaattgaacacaacatatatctttaatcaacgcacagtttagatgtaagcttgctgcagcctgcacagggttgctcaatcaagattgtattgtagaagggatcttcattggttctatcgtataggacacaatgaatggagctctaaaggtgcttgcaacttaaccaggtgatccattcaaacaagatttaggtgtataattgacactgctttgtttcataaaacaaagaacatgataaaagcttttgttattctaaggtggacacatttacaatttattgttaacaaacacagaaggagacgtgcatgttaagaacagagggaaaaaacaaaatccccagtacaggacagaacaaaacagagggggaaaaagatgctagcaaacctgtaaatctgccaaaagcatgtccaatttactccgaaaaatgcaaatcacacaaaaaaaaatccccatctaccagacacaaaatcgagctcagtgacaagaccaaaaaaaaaatccagccatcgtttccaccgatggctagttcggtggttacaatttattctattcccaaatcacacaaagcagatgtacttaaaaaacagatcagacctagaaaatttcaaatagtgtgtagctttacctataaataaacagatcagagcactactcacctggaacttaacaaaataaaaaatcaacagctaggcaatctcatcggcatgacatagaaatcaacggatcaggggactaatcaaaacaagggcaggacggaagtgctccgcgtgttcaggttccatgacatagaaatcaacagatcaggggactaaaccaaaactaccgattccaaaatctaaaacagttaaacaagcatcagatccaaacattaagagctacctaaagcatcaaaacctagccggaataagattgaaaaaaaaatcaactaatgatgcaaacaaataggagacaaggagagaaaaatcagcagaaaactctccggcgagctgaatcaccatggcgacctacctctctctcgcgcgccggcaagccctctctctcgcccgcgccggcaagccagctctcactcaccggcgagatgactctctctctctctctccggagaaaacaatgaagagaaaagaaaaaaagagagaaggaaagagagcgagaagagagctgaggaaaaacaacggctacggagtacagacagaaaagcgtggagcccgacatttgagagggatggcccacatttgactataggcgcggtctgattacacgtgacgcagctgcatccccacccccgcatgcgcacgaatcatagcgcaaatcctacggtcagaaaaacgacaaatattaggagagaaatttaatgacaaatatctagcaaaatcgttccaacagtatatatatgtgatagtcgttgttggcatatagctagctagctagctatagtatatgccaattgagtgagctagagtgaccatcgatcgatcgatggggtcatcaacgacaagatttcctcacctcctggtgcttctttgcctcatcttgcgtttgttgtccctccatgcttggttgatcgatttcgacttcgatttctctgacccgtcgaccttcaacgtagacgacctgcggctgcaaagcgacgcggcgctgaaggagggatcatctgggatgatgatcgagatgaccaagaacagcacgttcagcacggggcgggtgacgtaccgcctgccgctgcggctcatctgggatgatcgctgccggacctcggtctcgtggggaagatgaccgcggacatcgagttcgacggcgccacgaacgcgctcgccctcacgctgcgcttcgacgacaacgccaccctcgcgcccgcgcacatcatcagcacgcgcgcggacgtgaagaggttgctgacgcaggaggtggccttcggcttctccgcgaccactggttcttggatcgagcgccaccgcatcctgtcctggtccttcaactcaacaacagttgctgtcgaggatcagcctcgcgagcagtcgacctctactagcttctggtaacttgcacgccccctgtactctccctcagtgaacaaaacaaattctagcggttaagtgtgacatcctgatctaattagaatttaacctgtgtgatccaagagagatagggtgtacgtttagcaccatcttgctagtttagtaagggtgaaaccaacttataatgacatgtctcaacatatcactcccgggctagtttagcaattgtaaaaccaacttataaagacttgtccctctaaccatattactccgggttaatcattttacacgaaataaatcaattcctattctttctgaccttttctttttacaaacctatactttcttgccatttgtttgcaaattgaaattttttttgtcatcttcagtgcctcttacttaccattggtttataaatcgaaaaattttatcttcaatgcctcttatttattaattttttatcaataagaaatattttggttaatgagagatatatatttcagtcttttgtcttccttcttaatttactgcttgggatgctacgaattgtattttttatgagggaatagctagattactctcttaaagttgctacttccggtaaaaaaaaaagttacttttaccattcaaaatttatctaaaatatagctacatttcctcctctcatccatagaatacacaatcatctctcgttaaatttctctccaattactttctcatcttaaacaatgataaatttttccatttagttttacccctctgtttagttgctttgaaaaaaaatataaattaaagatagttatattttgtggaaaaaaataggacaaaagaataccgtaggttcataagacataaccacttatatttttagacaactaacatacagacaagtaacatacagttaaatccatataatattatcagaagtttttgttttaacaacattagctactccactttgatatgcccaaaacatacattctacaatggcatattctttcattactggagtgagcaaataatagtattatcatatcacactcaaatagtataaactagctgcataatttgtgaaattatttagagctagtttaaattagaattaaatttgacacaatcttatttgtctgctttattaagtttgtttgttattaatcatctgatattttagttatcttactttgcacaacattaaagattgtaactttgctataacggaattatggttttcaggtgactgaagtcaccttcaaccttacactggtttgggaagggaataaggatggagaagctaagaaggggaggaacacaccagtgatggcgactctgcagcagtggcagcgcaacaaagagatcttcctctggcgatggtgggacagtagtggtcatagagtttagaatttgggggtatcaggggggggttgttccttacaacttagagggatggccttggatgtcgacaggaccagcgatgggctgtggcaatgggtggaccgcgaggcagcatgggcactgctggagccatgaggatggaagctatggtgggtggggttggctgcttggggtgggcatttggttagaccaaaacatttagtcttggtctcagccatgatcgaaatttcatgacatccatgagaatcacacaattgccaacaaatttcatgtccaaaaaatcatacatatgaaaacatacacacatacataaatgacatatcggctcttcgatcctaggtctaagtaggaggaatagttatcagggtggaggatggcagcgtgtggtcaggggcagacccagagggtagtccaggtaggcacagaactaccctagaatttggcccagaaaagaccaggtattcatttttcgtggcccatcaaagaaagcctgacccaacagaaaaaaaaccctaactctcttctctcccctctccactcactctcccggcctcccactcccgacgggcgatggtgctccagcgagccacgactccggcggccggcgctcccgtgactcgcaccgccgcgcctcccgcctccggccggcggcgcctcccgcgtacgcgcctcccactgccttcgcgcgccgcgccagcgcccgcgcgcccgcgccctctccgcccctcgccgacgcggggggcctggccgcgccctctccatcccgcgtcggcgcgtccggccggcgcccgacggcctcctggctcccgcggtcctgcccgacgcgcgccaggggccagatggaggtcctgctccggccagcctctgacggtcaagcagtaggttgtcgccggtgccggtgctggtgttgccgtctccttcctagcttgcccaactgagctcatcaagtgtaggtaattaattagcttttactcaccattgcgtgctaaatcctttcatctggtggttactgcactattcactctgagggtgcctgagctctgcatcatcgtctgtacataagcttctgtgaaattgcccttttctgcacatatcattcttcacccatcagccatgttacctactcgttcaagtgcatttcacatttcacactgatccttgtgctttataggtttttaagtgttcttacgttttgtcatatctccttagaagggagatataagacaactaattgaagaatttaacagtcaaaaacatgccttttactcctattcgatcttgtgtatgtccttggaagggatatatgagttttgagtgtcaattctctagacaaatgacatcagactgcgttttctgaacaactgtcctttttatcacaagcaaacttctacatatgttaaacaccatagatggttgctctatcaaatcaatattgtgagctgttgcaacataatagtacttactatttcgattgtattgtatttggattttttttttggctaggcctaccctgggttcaaatcctgggtccgccactgcgtgtggtaggtggctaggggctggggactccagtggtgctggtggcggcgtcgggcggtagagcagtaggaggtggtggtcggtgctggcgttggctaatgaggatagtgactccatgctggtagaggactaaggaggaggaggaggagttgaggaagtggctgcgcggaagaagaggtggtggtgaacaactcaggaggcatgcgatgcggagtcgcggaaaggcagcatgcgatgcaaagtgggacgatgtggtgtgcgagtgcgatgctgaatcaggacgggagaggttgcgtgggatgcagagctgagtgatgactgctataggttaggattaggatcttagtcgacctattggactgaaattcggtgtattcagctaaccaagcgtactaactgaattgaccaaacaaaatttggtcttttaacccccgagaccgaattggtgacaagatttctcagtctcgatcccgaccattttggtttaggctttttcttcctacccctattggctgtagggacaacgaagggtcgtgaggttaggagttagcagcgatgaatttgacaacaataggcaatggtgtcgccgccggacacgggagaaagagagaaggggaagtaggaggcggttggtctggtgggcctcgctagcgtcgttgacggccactagctagccgacgtggctaggagtgatgtggtcggtcggaggcaggaggttggcaacgagagagcacactgagccactgaggattgtgcatacggatgcgtgcggaggggacgtgaaaacggggagaagagaataaggttcactgttcacacacgaatcgagatgcaatcttggttgtctgatggattgtccaaaattttgggtattttcagtcacatgtaaactagacagttccttaatataagtatactgcaaaagatccatttttatttcctgaactgtgtgctaaaactcaattgatgtcacccctaaatttcaaattcaaataaataacgccataaccatgtttgaaggtggtttttgtttgacatgattctttttctttaatttgctggtttaggcttctgtataagtttctatatttctttaatttgctggtttagacttctgtacaagtttcaatatcatattgatgccgacgtacgtagatagatctaccttcgacaaacttctgttttatatatgcgagtatggagctagtattctttgtttgataaaaaaataggcttctcagttgttcaattttcgttccagtggcaagttatatctatctatctatctatcttctattatctactccttccgatactagcatatatcccatccgatactaagttgatatattctgatacagagggagtatctattatctattatctatctattatattaaaagtccattagacttcctagaacgctcataagctgccatgtggtatcctacaaacactcataaatcgtcacgtgtcactccaataaaatagaaaaaaatcgaatgaaaatctggaaaaacaaataggtggattttaggtcgttagatctatatatcttggaaaaaagaatatctcaaaccaccctttcacctgcccctatgctatatgtacgtactcatgcctccgttccttaatttgctttttttgtttatctccatgacaattaaacctgaattatctgtggtggcaagaaaataaccccacaaatcaacctccacctaccaggtttaaccggttcttgctctattccattttttttaactttctcctctagctggcacttaagaacaataatagacttcaaatattcataactttttaaatcatatattaaatttatgatcagtttgagcaattgtatttttaattaaaccaataattcaatatccatattgactatatttcagtgctaagagaagcatttttttccagaaccacatccatcttggggccttcactaaataaaagaaaaatactagaatttctaaataaaagtgaaaatacccccaccttaagttatttaataaaattggtggacctattgctcaccgttagacatctcacaactttctacgaatttagttactttctccaacatacatataagggctatttacctatacaaattatattgatgcttgtctaaaataaattatctttttagtagataaataaatgcctttctaaataaatgatcttcttaagataatcatagaatctaaattgtatatataacatataaagtcactaataaattagaaaaaaaattaaatgatatcatctttttacgtcataatgtgtacccatatagcctatttttatagaaaagtgattgaatataaaaaacatgatcaattgaacatcatattgaatcgtatcaagcgtgtgggttgtaccaggaatcttagcagtgaaacaaccctcaacaatgtaccaagtcaattccatattggagttagagaccatgttatttatttatttttggtaaacttgctatattatattataaattcatgtcatctattgtagaacactctagaaatgtgtttcaagcggtatatgatatccagtgcaaatgcaaatgatatatagtttcattgaaaccaaatccattgttgcgatataatatttttgttataaattcaaaactacacggtttcaagacattttagtttagaatttatatgctgcaagaagaatagaagaaaatcataacaatagttgagagcaaacccaaacaaattattgacaagaaatatgtttacaatagagtaaaggaaagttttaataaaaattcacccgcacataaacattcacaacaaaatttcaaacatagtaaataaggtgtccgcgcatgtacgcgggcttctttcctagttagaaaaaaaagatcgatttttgatgtgaaaaaaaaacagtcacacgacaaataattggcccatatagttgagattaattatgtacatgcatgcttgatcgtgacaaatacaggtcatcacaccaagctggcagtaatcgttggagctacgactgggtcgtctcttgcgatcatggcgctatgattcattctctcgcggtttagatggaaatacggagacggagcatttcaaatcgacggaaaaaaaaactactggacctagacagttccagtacgccgatttggttgctgccacaaacaactttacgatggaaatagggagaggtggatatgggatagtctacaagggaagaatgaggtgcttagaggggcaaccagaagtggccgtaaaggaaatgcagaaaactggagcagtcaaggagacaaggacgacttctataatgaactcaacaccattagtgaagcaaggcacaagaacctagtcaagctagaaggttggtgctgccatataaatgcctggaatttgtgtgatttcttgtgttggtaccgccagaagcacaacatcacattcttccttgtctacgaattggtacgtaatggcaatctcgacgaccacctatatggaaagaagggcacactacagtggccaaagaggtactatacacacacacattaatataggattgatttattcatcaagtggcagattttttctattatgtgccaatcacatttacaacggtaattcgacataaaacaaattacaatcataaccattttcttctggaatacaacaaaagagtactctaacttgaaatttaaaatatacactatatataggctatgtgtcgtacaaatttaagtcactaacaaataaaaatatttaggtgactaacacatactccctctgtccatattatatgtcattttggcattttcatttatctagattcacaatttgaacacttatataaatctatgcattaatctattcaaaatgtagaacatcttataaaacgaaagagaggaagtagcaaaactgaagtatacaatctatatctttagggagcatttactagtctcagtcgtttaagttttattgccaatcaatcagttttgcaactaacatcgagcaacttacttctcttttttaagtcaaataaggaatattaattctagcttaaaataaaaggttacactttggtatggatcctaccaatataaaacaaacaaatataatctatatatgcataaaaatgcatgattttaaacaaatattgatcgagtttttcagcagtggtacgtaccatttttataatgtataaaataaaaaaaatgagagaaacaagaagttgcagtattaagtatatatactaaagatatcttaccttgcaagtctaacctattcattgtgcagtttttgttcactgaaaaatatataacaaaaaaaacagacaattgacaaatagccaaaccagaaaaagaaacatactagagtacattaagcacaaaaacacatctagcttaatccctaaaataaaccaaaccgaactaattaaaagctgcggtgtgctagctgttgtactaagttaaaacttttagctggtaaataagtaaaaaaagaaaaggtgatacataactaagaaatgtgttattgacaaattgtctatgcatggaaggtttcagatagtgatagacattacttcagctctagtttacctctatcatgagtgccatacctgcatctcctgcatagagacatcaaaccaagtaacatactcctggacgaaggtttgaacgccaagcttgccgacttcgggctggcgaggatcacggaaaacgccaagggcaaactgctgatagtggccatggggtcaattgatcagtacatagctccagagtacaagatacacggcgagcttgaattaatatccagcaccgacgtctacagcttcggactcgtcctcctagagatcgcttgtaccaggaaagacagggagcagatctggaacgatatgtacatgaaccacgccggcgtggctgccgtcgccgatcccaacaagctgaagggcgagttcgacaagaggcagatggagcgtgtgatcatcctggggcactggtgctctatgaaagacccaataaagcggcctaccatgagtgatgctatggatgtcctgcagcagtacgactacaggaatctgccagatttcaactcgctcagatgagatctgatcagtgtcaagtcgaatgtggtcaggtgtgtctagagcaccctgcaggcaaccggtaatatatcccttaatcgctagcatcctcagccacgcattcacaagatagtcaactgtgtgaagatctcctggtgtttgatcgatcacttgtggttaacgcaacattattgttttactttttgtatatataggtacggatatggcgcatcatcggattgcaatattatttcagttttcatattgaattcgatttgtttttcagtttactggaggtaatatcattcattaatacttcctctatctacttttcataggcatatatattttcaaatctgaaaaatttatttttgataggcatatttcaatccaacaacctatcatcttaataactttctcggatttaatgcgtattaatgaatcctttgtttacaaggaatgactagtagcatgtttaaatagatgataagtagaattatttattcttggtctgtatatcaagaatgaaatatgactatcaaaaatagatagagagagtataattttgtgttcagttatgggttatctaaatcgttagtttgatttaacggtttttaagacatttcagaagttacttgttaaataattattattttacattgaaaatatatagtttctcgttacaaagcgtgatatttcgttaccgagatatcttttctttctcggaggattctttttttttgggtaatcagctgtgtcgaggacacccagcctgtacattatactagaatagaaaaaatgtccctgtgttgcaacgggtaagatgtttttgaatcagtatacgtgaaaattctttaaatcgggcgcccgtgcgtcccgcgcctcgccgaaaaatcgggcgccgcgcgccgcgcctctgtaacaccccaggtaaccacgtacctagagtgccacaccagaaaacactcaaaccactaacttccaaaattattagaaatttcggcagagtctctcctgtaaatacggacatccacgacaggcaattataagttaaactaataacaatatcattcccataatacgatccatccttataatctatggggaagaaactattagaaatctaaaagattattacaagaccaaaccaggatataatttaagtgtgattatggacctaagcaatatagtttgatagtgtgcaagtagatgtgtatataagggtgctacttcccgcccatgcatgccggtctcaatgcgtacctaaaactaaataaaacacaagagtgagtataaaaatactcagcaagtacaatatgaatctagaaaatacatatacacatcattgacaataaagcatgaacagaaggctttctttctttgataggaaacacatttccaaacaccaagtcaaagaagatagtagttcccatcctgggcaggcatgaattgaaatagtagtttccatcccggacaatagtgaatacatcctagcatttgccggcgaagccgagtaagcgtgatcacgttgaaatatattagaaataaatagatagagtaaacaatgcatgaatcacacaattagttcgtcatgcacttgcctccaataaagaattggtatcatgcatgatctgatggaccaccacctaatcacaaacaaaaccttagcaaacatattcaaacatgcgtataaaactatgaaaaaggtgaacctactgccccatcccatcaaaactcaataacaaggaacgccgcttggactatacacaggactgctgcttcaaacctttatatcttgaaatatgaaaaggctatgactgaaaatgtatacattttgaaaatctacagaacaatacatacaactttcgtgtcgaaagcatatttttattctgccatttaaatggtctaatttgcgcttgaaagcaggcttcagaatctgttcagaatttcagacagtccacactgaaacaaccataactggagttctactcagcccaatcagggtgtactttaccaatatggaaagctaagaaaaacctctacaactttgtctataggcggcctggctgattccactgtttaacccctccaaaaacagttcaatctactactatccagattatgacacaaaaacaacagtcatactaaaataattatatctcctaaaccatttgagatagaatcacaccctttggtcagaagatatatccaaacattatctacaacttcctagttatacacttttgcagaaaataacatttagagccccgaaacatcgaaacactgaagcactgcaaatctgcccacatgcagaactacaataaaccgaaccgcaactacccaaactccttctctagctttccctaaccacaaattaatgcactaaagccatgctagaacaactgatacaacaaggagataagcctcacctagggtttctttagagaacttgtgaggagacaataggggagactccggtctaacccctcctactcctctcctcctcctcgttccgttttctaattcgcttcttgatccaacctatgaaggtggagatctagggagagcaatttgctgtagatgggagagatgcgaacacaggaggaggggaggaaagggcgctggccagggagaggggtggcggcactatgaggggaggtgagattcggttcccctctctctaggttttaggggagaactaatgggctgggtttatgggccttctcatgttggcccacttctaaagatatttttcttttatttatttctgttaacatctttattttaacaagtcaacccaaactaaaaaaacctaaatatcttttaatatatagggtattacagcctcatccttgggttcatcattattagctttatcacctttagccttgccatctttagatgtgcctgattccgaatcatcattgggaaccatctttagtttatacctttggatgaccgttcctgagcgagtttgcttgaatgaatgtaagcactgactcttcaagttgttcatcatctgctcatactctaacatctgttctggtgttagcttatccagtgttattggaatgatgttgtcagggccaatgtcagatggtggtttagaagtctgcttgttgtccaccatgatgaaaaatgtcacaactcgcatcccaccgagcgtgccaaaagcgtgttgatgcgaaaaacacacactgacctgggagatctgcttaactccaatacaagtcctaaatcttgctcttgggttcaaaggcgtgccagttgatttgatcctacaatcaacaagaaagaaacataaagaaaccgcggttaaatccataaacgatagccggtcggctaggagctgatgacatatcgtcaatcattaagccgattttattggcaatagatcggcgatgaggaataaagcaatataaagttatatttactcgatcggctgtagatatcaacgatatataatccttctcttggaatatatttaaattaagtgattgggatagatcgagcagcaagtcgagacagtataaatcacttatatttaaagatactttaagataacgattatacatacgtttatagcatagccgaacaaatagatctaacatgtatcggctaatactccgataccactctatattaagatattaaaacagacaaaatatattaaatagccagcctaatatactttaatgcaataagatcttaatataaagggcagatttagcatgtcaagcaagcatatagggtataaaatagctaaatcaggtaagatcggttgaaactccgatactatttctatcggtgatcagaaaacaaactagatattgcagttatgaatattatttaatagatcgaactcaatcatgcagcattaagtataagaataaatataagatctagacaagatgatgaaacctctaaaatatggtggatatgttatataatctagattaataacgaaatctaactcgatcggccactctccaatgatagatatcagccgattgcaggttagattgggaaactaataaggattataaaacatatatgataactcgatgatttacataaacaagattagagtgtcataaagatgaaagcactaatcccaagaacgcaagacgccataacaagtttaccttttgttgaagatcgaaatcgatgtagctcaacccaaaagcaagaactcgtcgaaataaaagtagaaaaagggtggtgatgcgccgaaagtattattgaactgttgttgtaaattacatggggtccagtcatatttatacccgagatacatgataggtccttgccggacacgactcttatctctaacaaactctaagatacaaacgaatctttatggcagattcttgccgaaacatatctctaaagaaattattcaaaatatcctaattaatagatacaattgcctatctgtgagcttatctctatcgcggtaatccttgtgtagtccgttgatcgatcccaaagacggttttacagccatctcaacgaaatcggctatatcggctgtatcggctatcttctgtccgacccatctcagccgatgcagtcctcagccgatgcccttgcagccgatgcgtactatattctttgtatacgattctccgccgtgtcacgtcccgtttttcgtgtcttctattttgctcgatttgaaaattaacgttcatgtttattcgcctaaaatagcttaatgaaaatttcataaatgaaaaagggtttaatttgactaaataatttaattatgccgcccttttattttacggtttgttaattggagttatttaatttttatttgagttttggaagtggagctcaatttgatgaattctcccaaattcttaaaaaaaaatcccaagtccaagaaaaatctcaacattttccttttccttttccttccttttcttttcctttttctttttcctccctgatctaggtagatgcctcttctcttttttttttctctgtaatgatctccatgtctctatctccctctgatgttctgtctctctctctctcccattagtttcacctttttcaatccccaatcaatatcctccactaatatta

SEQ ID NO: 71664 - DNA, 530 bp, Oryza sativa
tacatcggctcttagcgtttagaaaaggaaactttgctgcatcaggatggggaaaatgaaagaatggtaataaaaattttctcggtgcattaattgcactaagagcatgtaccagacccttggaaggtaagaccagtaaaaaatcttatccattgatcaacagtaaaatacgccatgtatatattatgagatttactccggtccaacaaaaagtacctcgaggtaccggtacctcacggtatcaaattgtttccgatcgttggatctagctgggtgggttgggcattgttagatcatgtgaagcaataccttttccattcccttgataagaaaatatccaccaaaatcatactcgcattcgctttcctgaagtttatgcagccagcacaaatttgacttcaccatgacaggtaacttgccaatagtgacccatttagtctctttcattatatcttttctttgtatatatgggtcctcgccagttttagctttgtcgcttttgtggagtgaatagacctgatacagcaaaa

SEQ ID NO: 71665 - DNA, 8678 bp, Oryza sativa
agaaggttgcttcgcttgccttgcattagcctttcccccatcagaagcttcttttgacttcgatttcttgggagcacgattttcccgacgatcaagaggttcctgcagatcagttgcttgactgctttcggtttcagaaggttgtgtgatttgcgtcgccgtagggctaccttcttcatcagatgcttccctggactttcttttcttgaaaacaaaacggtctaaatcatcattctgctcatcagaaacttcatcaccacactcagcctgagactgacttgcacatacatcattctcaatgctgccctcccgaacatcagattctcttggctcaatgactgattgcggatccttggaagttgacctgtttgaagaattaccattggttgcatccaacagagaatctaactgtgttctaacaaaaattgctacggcaactgcatggtcactaatcaaagtgtcactgggtgggcaatgaacaacattagccagtgcctggtaatagcgaaacagtgccaaggatggtggtgccagccccctttggcggaagactttagttgacttaatggcatgtttgcaaatgtttcccttcctggaccagctacaatcacacaatgcaagatcagaacctggattcactatgacatgggacctctccttgtttttctggcaaaccactctggcgcaattgccttcgacaacaacatcagaatctgggatttgcaatccctgctgccatggatttgggccacttttccactcactcctccagtaacgagaaaagttgtccttaccagaatattcatccaaccagtagtaggaatgaaccttcgtacccagcttatgaaccaaccaatctgcacgctggtatactctttcatttgcctcattcaatagcctgagttttagcaggtgatggtagctctcgattgctgaagcaacctcagtagtagccaacggggtggttcttaacatagttatccatgaccctggaatacattcggcagtcagcactagcagattaaatagtgatagaaaacttcatcaaataccagtagactcaaacaacggaaactgaaattcagatgtgggctaagcaaatgtgatacaggaaagagacatggaccaaccaagtcttggaaaccatagagctctgaagtagtctagaaaaccagcacaatcaacaaaatcttccagaaaggcttcaaataattccatgccaccatttcctctgcagatattgcagattaactccccaagtcgtttagccatcatcggacgcttctcaatatctgggcacttcttcattaaatttttatgccaagcatgccttatgcgccatgggctaatcagcacagggcactggaatacttccctgttcagcatgctattacactcaggaactgcaaccccagaaagcgtatagtaatgcactagattaaaatagaaaagcatcatttaccttatcgtgcgcacatctgcaaagggatcatcaataataaagccacccaactgccatgttggatcttttgtacgaactcgatcataaagggcacccatccatctatatgcttcaccatgtgaaaaattcggagttatgatccaagcaacaggaattgcatttttctgcttgtcgaaaacaaggaggctatgtacaggatactgcaaaatggtaaatagaaatgctaccatgaaatcaagcaaaccttaaagcactactggaacaaaaatgaaacaactgtcattgacaaacctttaatttgtttgttccaaactttgaatcagaagccaataaactacggttgccatactgaatcatctgctggagctgccaatctgtctggatgcccacgataaaggtgtccttatctgaaaagtcctcatacaaaaatatatggttttggtgattttcaacccatatgttaatgcttatagcatcatcgtcatcaagttcgtaaacagaacgacgaattttcctttccaacctcctaacatatctgtgagtaagaagaccatctcggtttgatggtcctccttgcttttcgatcatttctgtatgtctctgcattatggtctccactggaataccaacacagagcaaagacataatctgaagacgaagttcatctgatatgtaaggcgcaaacatggccttcgtcccaatagccatattgtccatgggaccatggcagggcttccctatcttatctacatgcttatcatggttatatatcacaagagcgacagatggttcagcaatcaaacgcttcacaataaaatggcaaatacagcccctctttgtatgaggacgaccagcaggtgttttcctctttgttgaagagttcctgctagggcggacagagccaccctttctataatcatctggaccaaaagaacaccaatacctgaaattaatggtatcatgaggttcaaaagcttaatgtaaattataacctatttaacagagcatatctaatgttaagagacataaatagaaggagcattatcagccatttaaaagataagatcgatttaacaaatagcaataataaatttgttctagtttacaagatgaataagaagcccaggttcacattccagtttaaaaattagtcggacagaaatgcataatgcttacatttacttacagaatatactcgagtatcccatcaacttttggtttgcagttcattgttggtggacgccttcgccgtgcttctacatgaaatcttgttgggcactctttgttgtttgattctcctctaacaaaatcattcacccttgaaaatggaataagcgcaagcctgtccattgagtccttccatccctccaccctggaccacatgatatctgatgccgaaaactctggcgtgggtggattctgaactggaagagtcaaaatttcatcccacctagccatctgcatttgcataggaatcatcacaaataatcaacgaaatcaaagccaaagtagcatatatttttttaagaaaaaaaaaagctatggtctgtgcaaagaggacagcatagacaaacaaaaaaaagagcatatatttgtaagacagttacacctaaaccaagtgtcatgttatgccttcgaaaatttaaacattagtgttgttcacatcacatgattaaaaacaaatacttgcagttgaatcgaaaagagcatatccacaatctcagtaggtgattcaagcaccccaagacaaggggaagttcgcattagattttgtggtatgctaagactgttagacatgaatcagcggtatcctttccacgttcatccttttctaagaacccataagtaaaccttcttttttctcaagccgggcattcgataacttgcattctggttgcaagagtgctgtaacagcattactacctctgaatgaatcaactcgctagcaaaccagacatttctaagcaatcccctcacccaagaacctgcaccgttggctacacttgttcaagtcctaaccctcctcaaactcccccatattggcctacgcacgccttaacccttctccaaaactcaccaatcgcgcaagtcaatggtgacgacgcacgcaagccaactaaaacctagtatatgctctacgatattgcagcggaaatattccaattccactggaatggattctttttgggaagctgacacagaagcccccagatctacaagagaagctagttctatgggtagagggaggggatagtgtggaggtaggtatgggtgctcaccggtggcggcggcggcggcggcggcggtggcgctgctcccttcgctggatggaggcggtggagacgggaaggccgtggggacggggagatcgactggctagggcgcacgcacgctgaggctcgaggcccaatcacatgtgtatgggcttttcctgtttccaagggaggctaaatagacttattcattgctgatggaccatgggaccaggctgaaaaatagactgccggtccttagagttagagcgtggtgtcacttagttccatggtcttgtaaaatcgacgttaagacccatgaacttgtttaagtgaatcattgcggttcaaagcagtctgaccagaatttccgtcttgcgtggttctccatcgtggccgcatatttgcaattaggtccctccacgcccgttccacccctcctccccaaatcttaagggctggcgccaccgcctgcagcagcctacgattgccgacgcccaattgccgtgttggagagctggccaccgctagctcaagtgcttgtagacgagatagccatatggctaccaagctcatccccaaccatcgtcaacgagctagccctgcccgcgggccgctgggtatgaggtcgacgaggtggccgtcgggagctcgatagtgaatcaggagtcgtgtccacggcgtggcatcagacgagccggccaagagccagaacggtgagggaggcagcagcgaccgacgacttagaggtggagaagcggaatccccagcgcgaactcgccgctcgtggccatggctcgccatcattgaggccaccacctggcagatgacagcgacggacggatcaggcgagggagagggatgcagatgagatgtgcagtgcggaggccctccccttccccttgtgccatctcccatctcatccgccaaattggctagctcagctccaggccccagctgtcgtcgtcgaggccctccgctttacaccatctcctccaccactccggctagctccaccccagccatcatcgtcgaggccctctattttccatctcctctgccgctccggctagctcctccctagcagccttcgtcgacctccttcactttcccccatctcatctgttgttcctgctagcttcgtcgttgtcgtcttcatcggcgagccaaggtcgtgaagcgagcacctcgtgcggtagcaattagcagacacaatgagaagaagaaaggaaaataaaaaggggaagacttgggggaggagggatggattggccgcagaggggcttaaatgcaaatatagggccacactagacagccacgtaggacgatcaacccggtcaaacgtgttttggattgtaatgattcacttaaacaacccgatcagacaaggtttacgtcaattttacaagatcgttgacctaagtgacaccatgtttcaactttaaggatcggcggtgtattttactaagaaaacaagtaacggtaagttggtaaacggacttgcccaaaatagtctaatgggaaattcactttatcgaaggctttacttctggtccattcactttatcccatttggacatgtcatcgcaggccagatattaaatttgtattctctagaagatgcctctaaaatgtaacatattggaagaaccgactgagcagatattctctcactcctgaagcatgatatatacaacggatgctcgtgagatcccccatcttttgcagtcacaatttttagcattaatgtcaaacaatgtacttagaattcatatgttctacctaaaaatagtacctttttctagctagcaaagcataacatgtgttcaccatatctgtattcttcaacaccttcttcctcatcttggggcatataggctattgctattgctttgccatttctttatgcttattgtattacctactcatcagttgacctttgattctttctagcattttgaggattggtaagtctctagcctctgagatgtacttgctgaatgcttcacaattattgttcagtaagatgtcacacatagggaactcaccgaaacacactctgaccttgcggaggcgaaatcgaagtattcataaatctcccatggcacaccacaagtccacaacctcctgagcgctcaccgctgactcttagccatataggatactttctccaagagtaacaaacacagtcgattatttgcttactataaactctcaagtgctcaaatggatggagtgtatctctcttgttctcaatccaactctttcctcttctcaaatccttctcatagaaagctactccaaggtaaggggatgaggaaatactatttagttttggatataactcacttttgcaaacccccccccccaaccagtagaaaagaaaggatgagggatttaaacaacatatccagatttttgccattgggataaaaagattacaacatcataaattctgatgtggacatcagaacttccggtcatttcaaaaagaaaaacctaacagtaacaacacacatgctttgacctaggattttacacataagaaattctgatgcacaaattaaaacttccgataatttgaagccatccaaactgagagcaagaactttggagatatcaaacattttaatactcaaaaatctagatattcacattgaaaaatctattcataaaccttgaacacaacccaaaagcttaactttgaagaaaaaagggacattccattaaactgccacataagagcttctagtattactcaaaccataatgacttgctttgaagtctgtttttaatgatcgtgaactttatagaaagctcactcagagggttacccggccaaactaaaacacaaggtctaaaatcacttgaacgatacggcaatacttgagtttctctcaacaagcacttcgatagatcattttgagtaccaagacatatacaaacacatcaatgattgcacccctcttaataggtattcatatattcaaatgtaaatagaaaaaaaaaatataccaatagaaatacattaatgtttatttgtcaataccaaaaccatttcttctttcatacttaaaatgattgatgtggagtactcatagattcaaaatttcaaatggctttatacggtccatcatgacaaaatcatcccttgcccttcaagatcgtttggtccatcgcagctgagtattgcattccctttacctgtctcgccatagatattcactttgttcttcgcatttccaatattttcactttgtaattttgttcatcaatttgaattttccatttcactttgtttttgttgattgatagtttgaaatccatcttctagatcttcatctattctcttgacagcaagcttgatcatgaattgagaaaattttatctttcacaccattttcttcttgatcatgcttctcttctcatgaagtaacttgaaaaccaatggctgatgtctaccttgaagttcttcgtagagcatcttaattgtcatcaacttcacatatggtatttgttggcagttgttaaacaccattttgaccccaagcttcggcaatagaatgggtgaaacaatgttcaattcatccatttactttagattaatgaatcaccatgagctttattgttcgttacttcgttagttattttgtaggtactatccaaataaagatgaaatgtggaatttcaaatgtttgaccaaatcttgtcctaaatgacgtatgtttagtgacaattttgttcgttggggtcactcttcaacagtgagatcttattaaccttgcctttaagactttggtccagcttttaatttttttttgatacaaagtataatataaattattaatattggtttgaataaagtatattgtatagctaagtgataatttcacggaaacataaccctagcatctaagtgcaataaatacaatcaattaaattcagttgtaacatgttacaaccttaacaatcgaaccgcctctaacaccacgatataatcggtccaatcgtaagattcaataacaacattactaataaaaaaaagttaacgcgtgtagttacaatacaaatagatagcaaaaaaatccatgcagtaaagaagtaaacatcaatcgtcactaacaccacaaaaccacaatacaaccagttcgatcatagaattaaataacgacatcactacttttaaaaagaatataagaagtaatatgtttaaatagataccactaaaaattatagtatgtaaataaagagctaagcaccaaaattaacagctattgttgcctccaatccattaaccacttgccatctatagatggctgtctccagccacaccagtgaccagccaagcaaaacacagcttttgcttgattacttccttccagaaacggcagcccaggcttcgttcaaactcactcacagctaagcctttccttaaccccgtttgaatttccgagcttgcgtcgaatattccggatgcccatccccaccaccaagggcaccctcgtcatttccccatcccccaccccgaccgaatatgccccgcgcggcggtcgccccgccacgtggacgcgcccccacccgacgaacgagattcctcgcgggtgcccccggccgcgtaattaccaaactacccattctactattccgcttttataatatagctgcctcttcgtcttcttcttccccaatttccccttctcctctccttctcttcccgctttgcttcccaatttctccacgccaccgagcaattcgtgagagggagaagggatcggaaaccctaaccctagcggtgggagccgccatggatgcgcggatgcggtgagcgggggtggttttcttggtgggtgaggcgaggtggttgggggtatgggtggggggaggaggaggaggagcgcggcgatggcgatggagggggaggtggagggtggtgggaggaggcgggtggtgcggatcatctttcg

SEQ ID NO: 71666 - DNA, 13758 bp, Oryza sativa
agtagtccatcagcccttcttcacataacatcttgcctgtaatggttaggatgaagcctggtattcatctaaccagggctaacgtgtcatctctaagaggtaacacgctagctccggctggagacgcgtgcctagaggctctcgtcttgacgggacggggcgtggcgtgcgtcagaccgccagtcgccacctaaccgttgatctgaccggtctgtgactggtcacagaccggataaaagagcgcgctgcattgcgctgcatgcagcgtgacacgcttgaccaaaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacatattccatgttaaccgagcagacacaatcaattgtgtggagcaataagtcctccatgtagtttttgggaatggactagaaagataataatgcaattttcacgtaacaagcgaaaggtgattcttttaaaagatctttagtttccacgtgtgcctatatccaacacctattttattattatagtagcgtctactccacacataaatttacaactattcattatactattatacagatatcttttattccatatacaaatatatagctcttcattactatagaaatcgtatgctccatacacaaatataaaggacaagtgatagtatcgttatcaatatccttgtatttaacaacaaaaatagattattcaatcttacttctctcactcagttactaacttttacaaagttgtaattattgaactgctgctaatgttataaatcaatgatcatacagagtcgtgtactcatgtaaaaagacacctgactttgtctcaagcttaaaaatttgaagttgtagcccatatgttcatctatatctccttgaaaaaaataattcagcaatattattccttatagacaacaacaatataagtttcacatataaacaacaatataaattttataggtctataagtacttatcaatttctccctcgtcaattcgttaatcatatttctactaacctaaggtcctatttgattcagcttagaattattataatctggattattagaaataagctgaaacaaacatatagctatttgattcagcttatgattattataatctaaattattagaaataagttgaaacaaacagatagcttattatgatagattattataatttataagtaagattactataatatagtaatacactttaaagatgtttattttagattattgggtactaccagctaacaaacagcttataagtggacacatcctctttccatcccctacttctacagcacgcatcgcgtttacacgtaggtagccgtcggatccaatattttatccctaatcttcttatagcctgtatattctacatatgtatctgaccacaaacatttgttttgcacgaaacgtggcattaagaaatgaagatttttttctctctggaaagtcccagtaaacaggaccgacgacgattaacgctggaccctgaagaagaaggaagacgtgccatcgtcgtcacacgcgtacggcgtaccggcaccttcgatggcggccaccaagcccccgagctgctccacccgcctcagatctccggccaccaccgccgcctgcttcctcccggcgtccctccttctcttcctcctcctcctcctcctccgccgccctcccatgggctccttccctcccacaattccaggtataacactcaatcaatctcacatcacctcccttttttcttttcccaattcgtcatcttcttgccccttcgattctacctcttgtcgatttttgtttgagtcaaacaagtttgttcttttatttgtggatttttttttatctgttatgtttttttttttgtttcacttcaggtggctccgtgtcgtcgcggcgggcggagctgtacgggaggatggcgagggacctcgacgagcgcggcgcggcgttcttggacggcggcgagacgtcgcagtcgctcacgctgtcggagctcttcgacaccagggacggcgccgtcgtgcccatgctcaaggttattttctgcaaaatagctatagttatttgctctccactgtagtgattggcattgctgaaatgtcacaatcttttcttctttttttttcttgtcaggctgccaacccgccggtgcgcgcgaatgtgctctacctggatcctgagtttgcttccgtgatatcgtatgtattgaagttttatccgagctcctgttgtgtgaattgaattgttgctgaaatcgattttaatttagctgtagtagcaggacagagctggtagtgtagttttcttgttatgttttgggaagtgaggacagaatattggtgtattgattattcttgtgattgcaggaaggctgtgaaggaagtgtttcttccttattttaatcaaggtgaggttttgcttactagctctgcaacataatattattgaattacatgagtgactgcagtcgtcctaatctatgttcagtgtattcagttaaactatccgctggtattactcatgtgtctaaagaagaactatcggttcaattgcttgctgctatagattgcttggttaatctttcgtatctaaagctgcatctttgctgaagaacttgaccatttctgttgcttcttcgtttatctgaaagactgtaacccaaagctgtgctttttaaaagcctgaatttatacccttgctgaattgtccaatattaaagaaagcttgatcatgcatttgtgatgtgaagctgttctgtttctgaattgcctgctttttcttgatttctcggtttcttaacacttgaaactgtgcttggattatcatggtgaggttttatatatcttggttgatctcttttgccagctatctggttccaaaatatgagcatctaccacttcagtatgtttcacacgtcgcatcacctggaaccaattgtagcaactgaagatgaggtaaaaacatgccctggatgagtatgatgttcatgaaaatgcaatacaagtttttactgatgtatctgtgtgtaatactgttgagattgaagctgaagtggatgctgtaaaaagagtcaccgacgatgtttgtccacttaaaattatcttggatcaagtggttttgacatcaactggagtgcttcttggcctgtggcaggtgtgggcctttaaaaacaccttattctattgtacgctaatttcagcgaacatcctctagtatgcagagtttcagactgaactggtatttttcctttttgctgtttttaggttgaatctggtactgatcccgctgatatccgctcaagattgagagaagctcttcctcgtgcaccccaaaagcagcttgtaagagcaactcaaataaattatttgaaatttcactttctggaccaaatagagaattcctttctgcactaaatttaatgttcagagtctaggaagttcgaaattcaggacctactggctactgcagaatacaattattgattgctggttgttattgacctatcctacattttctatgaatctgttagtaaggtgttctttttcacttttggcagtatgatcctgttatgcttcacacctctttggcacgtattctgggacatccaaagctcccacaagaggtagcccgcatggaaatctgagttctaatttgttacttttaatattaatttcccttttagacactagaaagttgtcttctcttttcattcaaactgttgcctatcttgtgcaagatgcccataaaaagcggatataatatcttgctgcattatgcattacagtggatataatactttgagtttcaactgattatcaaccacttcaagaatattttgtttactgaaaacatacatggccaactactttccaaaaagcaaggcagccataagctgatgtttaaactcaaacaagatttatacttattgtaaacatgttttctgcatttacacttgtttggtatctcaaaaattgtctgctactctagtgtattatgttctttgttttttaattattcattctatctcatgtggcattgcttggtatgtttgctattctttgttgtagggtaatgcacagtctcttgatcatgtcaagttcttccatgacctggttgcacaggttaattcaaaaatccgtggcttccaggtaagagttcctgatttgtttaccaagcactatatttgcaactacctttatgcatgaactaaatatgtatatgtcaaccgctattcaggccacggtaaaagagctatggtttgtagaagagtatgatgtacttgcgctggcattgaacggaaagatgaaggtacggaggctccaattcggttgcaaagaaggtcaaggcaatggaaaaatatagagagaattaccgacgggaacagtgcaatatacttggagcacccaagggtaatgttgttcgaatggctcacctaaaacatcatccacgccgtcatttgatctgccgagctatacaatagatgtgttgggcgactgggaatgcgacaaagtgatgacagattgcaacacatacttgtgcagaaaatcgtatgcaaccatatgtatgtaatttctttcgctgtgaaggtatgccacattgtgttgtacctgtgatgttctctaattttttgtgtctatttatgctccattttctagcatatggagacagtgtaccaatagaaactccaaaatttgctgtacatttttaggggaagaaaggccattcaggaagacgagtcttcactttatatacagaattgttattcttcaggtgtaggaatacacaaatttctccataccattgggacctactaccacgaattacagcctcttaggatttgaacttttagttgagattatgcattctcaaatgcagcattcacaaaatcttgaatacgtaaatccgtgtcaacctggactcacaatggtagttaaaaaacgaactttcacaattgttggatctcaaaaacaacatgacgcccatgatctcaatcaggttaacaagacttgatatgagaactgaacttctcctttgtctgcgaaattcctacatttcaatgtagcatcgtagacatcggacatgaggcagcaccagcaggcagcagctgtgctaaacctatatagcaaacacagagaaggtaacaagcctagctatcattatgccaaagagtaatatcaaccgaacacccccaacatcacatggtcctatctctggagctggtaaacaccagcatgacaacacggcagataagaatatctcgaaaaacacatacaagcgcgggaaaactaaaaagggccaacttggtgttaaaaagaaaataaataaaacaaaaaacaatttacaagttgtattcttttatctatcgtccagcgagcttcgcagccttcgatggaccctctagtagctttggaacctctgatgaggcttctaattttttcaaaccatcttcacagtagttactaatatcaaagttggtcacagcatgggcaccacgaagctcgatggcagctaggtcataagcttcagctgcctctatctccgtttctgcaaattaagctcagtgactgatttgcttcaaacaagttcactttccacaatatttcaagtcacaaaagataaatgaggacaaatttaggtcactcaccaaaggtaccaagatagatgtctttggtgtctctactttctccaatcctaccaatccgtgcttgccatctaccatcctttcgcctgtttagtccaagggattaagttgcaaaattgaaatagaatattcagaatactttgtttaacatgattcacaaatcgttttctttcaactggagcaaaagggataagtaaataatgatttaattcatttgaccagataattatgggcttattctagcaatgcagagaatagcaccttgttacacccctatatgatgaagttcctcttgagaaacagctgctctgcctgtaataaacacgcagaacagttaaaagttaaaacaatcataacacaacggtgtcatatagtaatcactcaaatttatcactgaccttcttatgtacaccacaaattcatcttgggacatggtcttcatcctctcgatttctttctcataatcagaaacctggtatagaaataaaagctcttaatgccaaaaaataacaggtcccagaatatcacaaagaaacagacagttcttacattgaagttaagtttggtgtttggccctgcaccccaatatttaagggctgcaaggtcatgtgcccttgcagcattctcttcagtaacatagcttcctgtaatgccaaatatgaagttaattaaattataagtaagctaaatttatgcttcaaatgaattcattctgcaattaccacttgcctaggtacactgaatcaccagtagccaaaggtgccagattccccatgcacaaaatccaaagaagaatcaggtaagaaagaaattatgaagggaaagtgaagcataaggaagtgatagtctttcatagcaatgactatctctgtattgttcccttatccttgacctattctcaccatggtcatttaacaaattcaatgcccagagcttataggatgagccatggtcatctaacaaattcaatgcccagagcttggaggaagaagctaatgattgaatgtagctgtccaatgctatccctacctcctaagaagaaaaacagatatacttccttacataaataattaatcaacaatcctctaaatccaagggctacatgctccttactttccatatcgaaatacacatttcacaaattcaagcatcacattaatccttaaagtaaattaaaattacgaaaccacattttacaagtcgcttcattgaattcaactattaaatatatccatatgtgcaccctgcaacaaataaattgcatacggctatcaacaaccacctgttgtcaagcctctagctaaaaatctgtgatgatacgaaatgtaattggaataactcacagctgtttcgcatagctaccaagcgagcgtgtaccatctcggcactttccaaactaaactaaactaaactaaaccagtgctaatttcatggctacacagtgacaccaacaaggatgagagattttgcttgcagtgagcttagctaggatcatcaggcgtgcaccatctcggcactttccaaactaaactaaactaaaccagagctaatttcaatggctacatagtgataccaacaaggatgagagatcttgcttgcagcgagcttagctaggatcatcaggcgcatcacataccatgcttccccttgcgcttgcggccctcgacctggctgctgttgtcccagaggtgcgcctcgaacttgccgctccacttcaacctgcagccaatccaaaaattccaaacccaatcaagccaaaaaacagaaaaaaaattgagggagctaggattccgaagagagagctcccaaaacctcgtgacgccgtggtaccgcgacgaccgcggcgcggcgtacttgcgcatggtctccgccaccagcttccctcctcctcctcctcctcctccctccgccgccgcagccgctttcccatcatccccgccgccgtccgcgacggccagctgctcgtcgagcgccgcgatctcctcgccccccgccgcggccggctgctcctccgtctccggaggaggaggaggcgcggggtccgaggcggcgggttgcacggtggccatcgccgcgaggtgaatcttcttcttcttggatttctcctcggcgaaatcttcgagagctcgtcgcggcgcaaaccctagaagacggagcttggagaggactcggatgcgacgagctgcatgggcctaatttggatcagcccacacgggcccgcacgttcgcgagagctctgggccaaccttgtgggctccatctccatatgggccgtgtattgggcctagtttgggagaaaaggcctagggtttgggggctccttgtgtgcgccgtcgtgggagctttcgtcgccggcgagagtccttcctcccgcatttcatcgcctcaacgccggtcggcgagatctgagtctgaggtaaggccatctcaccccctgcagcttcattctttgacccttttttcagtatttttgttcttcccttttttggtttttagatcctgtttggttgaagggagtttttaggagggattgggagtttagagggatgaggctattaactgttttgtttggttgggagatgagaattttggtgggatggggatggggaattgaggaatgaacttcttcctttttaatacctgggtaggggcaggtaattgggagggaattcctcctttacttcgcctaaacaaatctcagccattcgttttcattaatgacctaatctctaactaaactccctcttaatttccaccacctctaccaaacaagagactggcatgaaaaatcaaattcctatcttaatctcactatcaattccctcgtgtaaactcccaatccccttcttatatgtctgatttaggtggagtaatgcatgttaattgtccagatctgatagagaaaatgatgttgttttagttgggtggtttggtctcctgtggatgtttttcttgcttcatgtttgttcagtaggagtatattattatgtgattatatattttgcaagatcttgttctttttcaagtttgtaggtctgagtatgtgttggatctgtcgtctcttgtggttggatgtatggtatatgtttgtgcttgttgcattccatgttttgatgcattataaatttgcaattcggatcctctgcattagaggtactaatgcagaggatgaacagtaccacgcattagaatcactgtggaccgtcggatcaagagtgaaaggaccagatttttgaatccacgccgaggtcgtggcggccgttgccgacgaacacgcgcgggagcggtggtggcccggcgaagccgtcgccgaggaggccgcggagctccgcccggaaggcggcgtgcatggacacgtcgcgctcgtcgacgcgcacgcggtggccgcgcaggatggcgcgcacggcgcggccgtcctcgaacgtccggcggacgccgcggaggctggtgaagtacaccaccaccacggcggatgccttcgtcacgcgctccggccgccgcgggggcggcggcgcgacgtcgagggcttcttcatcggccgccttggccgccttcttcttcttctctatcttctcgtggaactcgtcgacgcgcgcgcgcacgaagcccgtcacctccgggatgtcgcgagccgccggtgtgcccatgtcgtcgaacgccgccgccgccgccgccgcctcctcctcgctcgccttcggcgtcgtcggattctcccgctccggcgaccgcgagggctccgccgccacgatgccccggaggccggacatgattccctggtcaaaaccaggtaaagcccgcacctctgcctccttcgccgccgccggcggcgaggacgcgttgaaagacgcgcaccgtcgcgccggcgcggcgtcctcgagggcagccttgagcccacgcttagcatcctcttctccggggagcgcgcggaagtcgaagtcgacggagacatgggcgcccttcgccggcggctcttccagcggcaggctggagtacgcgtgcacggcgtcgtcgcggcggccgcggcagaaggcgagggaggtgagaaccaaggcggtgcgcgacggccgcaggctatgccgccggctctccgccgccggagccgccaccgccggtggcttcgccgcgccgccgcgcacgtccctcgagctcgagcaacccatcgccggagtcggagaagaagatgatgcacgtgcgcatgcgcttgccacgtgcgcacgcgtggttggctattatatagagcttggaagccattggatgtggagcgcttggtatttaaatatatttttttgtgaaatgaaactgaaattgaaatggaataaaagacaaatatggaaaatgagctggtaaatattatggagttgggtgaatgggttcagttttaattgctcaattagtcactagcaaatggataagtgtagtagtgtctatctatacagtggtacgggatgacgtggaaaattttgagaaaaaaaacaatttataatttgatgactatgagtttttcaggagcgggaaaaataagatgtcaaattgcttacagaaagtaaattagtatggctttatgtatatagctacagtattaaaactcacatttaaagcttttaatggtaataaagataactatgcgcagcaagagtctgtatgaggagaatttcatgatatatttttgcatgattccattgtagagaaatgaaaagaactgcatgttgtttagcgaagttattaaatgttagtgagagtatttactacacaaagtgaataaaacttgtaaaaaacactctaaaatttgatctgttctaaaccactgaaataaaatgttctgtaaacaaactaaaaaccttgaccaaaacaatgggggaaaacattttttgaaagaaaaataacaaggaaaaaaattaaaatagaataaaaggcagatatagaaaatgaactgtcaataacatggaatggatatgtattggttcatgtttatttgctcaattactactacaacgtccaaaaaaatgaatttctagctacgaatctggacacataggattggtcttttgttgggacggagggggtaagtggcatttaagaacaattaaattcccacgtaggtgtggtgagaggggatgtgatggaaatttatgaagaaattaatttatgattagatgactatgagttatttggaaggattagggatggcaattttgcctatgggtttggatatccacgaatacctagcccgatgggtacgggcgcgggtgcaattttttacatgtgggtacgtttgctcaagacctgaagatgtagtgggcagcaaccgggttttatttgttgtccatgggtaaatcagaaaaatatgtagtgcgaaccatatatgtagtgaaaaacttagaaactactgttggatctaaaatccacgtcaaccagagtaaaaattttactcccagatttaaccatgagtaaaaagtttactaggagtaaaatttttactcttagtgacgtagacaaatctcaagcgtccatttttaaatgcaacgatagcttgcaggtttccacttcatatgcacatattttcctggtaactcgtgcctgatgcaatacatatgtattagctgattttgggcatctcttaattctcacgccccttccccttgaccaatttgtgatgctagttggtgataacttgtgatgcaatttaaattaacgttgctaattgataatttggcaaattattgattttatttttctttgttaaattacctatctattgagatattattcatatgagacccaccgggaacccatcggacatgcctgtgcatatcaagtatgggtacatgcacggagttttgcccgctaaccctggtgggcaggtttgagtgggtgatgtcgggcattggatcgggcatggttttgccatctcttcttaggatggggaattcatgagaaataattggttaattttgtcttagaaaataaaatctcaagtagttaactagcaagctagaaagaccttctgcaagtagtgcttaaactttacaacagcatgctctgatttaaatatttaaggaaaatgtagatgattatatatgcagcaaaaaattgtatatatatgaggatatttgtatgagaaaaatattgcatgagttctttgtagaaaataaaaaaaaatccgtcaagagggaggttggacatttgaggttacatggctaggccacatgatctcaagcgacgatgaactcatatttgatataaaatatttttcagtctcaattataaccaaatgaaattatagtttttaaggtacatagctaacgtagcgaggtttatatggcatatctttaagagaaatatgggatatatatgtattcttagtattaaaattgtattactcatttgaaaaaaataaacggatggatatttaagttagagtgctacaaaatctcttccactatcttgcatactcctttgatttgcaaaggtgattttcagttagtttctaaccttttctggatacattttgaaattcacactgacggagcccgtggctcctcaccgggagaccgcgcaggcccccctttgccagttcggccgggggcttagggtgagatctcaagctctcgctgtgtgtggaaagatcgctcgcccggaagaaacacgagacacggcgatgtatacaggttcgggccgccgcgaagcgtaataccctactcctgtgtttttgtggatttgtgtatgaatgagctacaaagtgtctgcccacttctcccccgctctaggctctaaatctggcaagaatcaaccaatcccttctctatgggcaaggtcctccttttatatttcaaggggataccacatgcccccttccctttccaaactggacttttcttcttttcataaatggacggagatttgcacggtcgtcctccgatgggacggcacatacctacctccacttctgcctgaggcgggcacgtcgtgggaaggtggctgtgtgctgacgacatgagcagtgtcagaccggtcacaaatcggtcattcttgtcctccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagagcactgcactgcacttcgtgcggcgtgacacgcttagccgaggcgcaataaatgcggttaggtgagccctgctgtgctcacctaacccatacacgtggagtacaaaacgcgaggggtcggggcgcctcggccctcgggggcgaggctggagtcacccgacccctccctcggggaaatcaggaggagggcggtcacctcaccctcgggcccgacgtccccgaaggtgccaggccacgtgggcggttgtgtctgcctcaagcctctagtcacgatactcccggtcccatatcaccgacacacacacttggctaaaactttattacagataatccttttctttaccaacatactacaaatattcctatcctatcatctgttgtggtgtaggggctcaatacctcgtttccaacattggtctcaaatgatggataagatgataacgaatcggggttgtgtatttatccatcaactggttatatatgttcatttctttactgtcattatcattattattgttccaagatatgtataacacttataaaccctgaactccctccctgtcctcccccccccctctctatctccttgtaatccattcatccctgaca

SEQ ID NO: 71667 - DNA, 46254 bp, Oryza sativa
gcattagttcgatttttcttttgcgtcaatttgggcaaagaagatgatgttaaccaataaaatttggggaagtcgttgatatatgactctaccggtaagagttcaattcttggcgaagtcgttgttatatgactctaccaataataatttaaattttgatacgtacatataaaggacgtaactacacagctaccactaagtttgtctaaaccagctaccactctatctatagagacaccatccacatgtacttcaaatacaattttctcttaaactactcatccgatctacgatccgactacaccgttgtgtttgtaacaattaaatctttacaacaagatcttacatgattatattttgatgaaaaatcataaattacttttataatatgtctaaattacttttagattttactaagttacttcttagatatataaaagtaaattcagtaaagcctaaaagtaatttacatatattatataagtaacttagaacaaaacgaaggtaactttgccatgtcatttaaagtaaatctgttggagagataaaaacatgactctatctagaaattgaattaatcagcacaaattatggaattaactaaaaacaataataaaagtaatcacctcagagcattatgaatatataggaagtattttaatcaaaagtaacctatatatatgataattatatatatgataatttgttcaatgaaaaaaggaattaattaaagttactttctttttgttataagttagttctataatatatgtaaattacgtttaggctttactgaatttacttttatatttctaagaagtaacttagtgaaatctaaatgtaatttagacaaatcataaaattaatttgtgatttttcatcaaaatataatcatgtgagatcttgttgtaaagattttaattattacgaacataatggtgtaatcggatgagtaatttaagagaaaattttatttgaagcttagatgataggaatattttctcaacttacttcatggattagtgctatagtaaagtaagattcttcaagttagcacatatctaaataggggtcactcgttatgactaaatcgagagtgctctcgatttagattttgcgacataaaaatattactccgtacgtgaatttgccatttagtaactaataacaacaattgggctgggccatcttgggccagagggaaaggccgagaggtagaccaaagcccatcaatcatagaggaggccacaaaaacatagccatgagatcgaatggtgtcacgcatggtgtacgtaaccctaagcgccggcgcggtcgcggacaatgtcgcggccgatccttcgccggcctgcgcagccctctcctctcccatctccggcgccccgtccgccgccacgacgccaccgacgtcccagcatttcttcgtccccgccacctgatcataggcccacgatcaggcaactcctcggatgccacaaacggcgccgccggcgagatcgcggcgaagaagcacctgtacctggcgatcgatgaccggaagaacgcgtacaacaggacatctctacgacggcggcgacgccgtcgacccatggtgttggcggagctcagagccgaacacgcagatgtcatggagtcccgtgcgagaaaagcacgccgtacgtgcaccccgggggacgcgcctagcttcttcctctccgcgatgaaccagtttcggtcgggcggcgtcgacgtcgaggtcaccttcttctacagcaaggacagcgacgtctgctggacgcgccgcggcgactggctgctgccgttcagaggccacggccactacgacggcgagctcggctcgtgggtcggcctccacactactccgacaccaacaggctacgcaccgacgggcgcctctgcgcctgccacgtcgtgtccgcctccgccgaagcgagcggcgagccggcgccagaggtgaaggtcgggaaggataaggtgttcgtccaggtccctgcaggctgggtgcacgaagaggccgagctcgtgtacatgggtaagcgagtactgcctcgttgcgtggctgcgccccgagggcgacgacgaggaaaagtgcctgtgcgacggggacaagtgcgtgctccacctgaccagggttaaacatatcggtttagccgatttgatcggtgctcacaaaaatgctgaaatttaaaacaaaatttagttgaatttgaaataatattaccaaaattcaaacaaaaaaaatatggccaaaataatatcgtaacggagggatccgaaatgaccgaaatttctaaaattttgttctggaatttgcaatcctacgcctgaccacgttgcaggtggcgtacgacggcgacggcgagctcaccgccactgatcgccggctcgctggctgctacaaattctccaagtatgagatgaactcccatacgagcgttctggatataacggacagctacgagcctacgacagttcactaaagaatttagtagctcatggtgaatctgagggttcaaaattccgaaacgaaatttcggtctattggatccctgatatgatattataatggacaaaaaaatattttttttaatttggcgatatttattcaaatttaactaatttttttataaaaaatcaaacaatttctgatcaaaatttttgaaatttcacgatatcggcacccacaatacatatgccgaaaaccagagattgaaccctaatggccatacgtgtatgccttatttgaagagtcattttagtgtcaattaatttgtagcagtgatccagtcaaaaggaacaaaaatttgcatagaaaaacaccattatggatccttattcctcagatcaaaattgctctcaggggcccaccattttagcaccctgctgcctgctggacctaggccacccaggctaatgttgcttgagttgcttgcttcctcgttagcttccctggagtttgtgtttttcctcagtagctctcttcgtcttcgcacgcagccacgcaccgtgtgtattcgttcctctttttttttttagccggcagctggctggttgtaaactagtactccctctgtttcaaaatgtttgacaccgttgactttttagcacatatttgaccattcgtcttgttaaaaaaaatggtacatgaaagtatatatttaacaatgaatcaaatgatatgaaaagaataaataattacttaaattttttgaataagacgaatcgtcaaacacgtactaaaaagttaacggtgtcaaacattttgaaacagagggagtatttgcttccttctaatatgtcgacacgcaagctttttgcacgttaaaaaaatcaaagttactctagaacaattaatttatatttcatcatttgttactaatatttattgacaaaacaatgagtgccagcctcctaccatttaggtgattcctaaacgcattctacagctctttccggctcctctccactgaattgccccctattgtccttctaggttcccacatgcctctctttcatcgaatggcatagccaggaatatagaggccctagcaatagatgggtgcatatgtctctcctttgtttagtggcaaagcctacgcatagagcccccgactagagagggacacctagagagggagtactccttccgtcccaaatataacaaattttggtcggatgtgacatattctagtattacaaatctagacatgacgcatatccagattcgtagtactaggaattgttacctccaatcaaaatcccttatattttagaacggggaaagtataacggaaggtgatacctgctcatatatgttagtgcctcaaagacaccttatcattatgacaaaggacgtgctcctacaagcacaaccaaaacccataaaagctagccgccaaaagcgaattcctattggttatcaatacttttcactgcaattgtaatgcataaccatttgggtggccaaattctttaaacgaatgaaggaaattttataaattttaggctcctaaaataactttgagcgtaccgtggccatggcactaaagttaaaagtaagttgtagatgtgaaataaaatcttaattataaagatttgatttgaaggataaaagtaaaccataaatagacaaagaatcccccggagatcaaaatacatagaagaactgatctccaaaaataagaaaattgagattatgccaacgtaaaaaataggctttgccaaaatgccatcctgcaaataggattggataaaatgttgtgaacagggtgatttcaccaccattccaccatttcatacaaattaataaaatgattttgctttttttttacatgagaactgacaaaagtgcccctctctccctatctattgtttactctcattgtggccgagaaataagctagactattgacgccacgtagcagcgccaatgctgagtcgccgccaccactcagcaactagctcgtgcagaatgtagacgagcacatcatcctgcagtaggttgagcttgtcaatccgtcactcctcggcttcttccatatgaggcttaaaatcatcagatgacaagtctgataaggagctagggttagggtttgcgactacaaattaagtagtgtcagcattaaggttgttggggttaccggtacggtggtggtgaagctgaaggagaatgtgatcaacggtcacgtccgatgagcttgttggtacaaggcagaggtacgcggttcctagcttcactacgtacaaggtcttgcggtctcagttgatgtcattgcgtcacaaacctagaaaatgatctgcttggaggtcccataaaaaaattgaccatgatgaaggggcaataggaatgggacggcccacgtttatgtggcatcctcacaagatttccacatgttttgaccttgatgacaatgatataagcccatggcgagctcatgcctccctcccgaagctcatactcaagctctgccggggagcttagacctagttgaaaaaccattttaattggaaagaaatggctttctagcgtagatgtctagccgtttaggttgttaatactaacattttatccaactctatttatggaatgatatttacgtgaaactcaatttttctaggcaaaatttgccacagggcatccaaaaaaccctgtaattagctggtggacaccacaaaaacacgaaattgctgtcgggcaaaaaaaactggtaattagctctcggacacttatggccttattttattattttcggggaaaacggagagagaaactgaggtgagagtacgattctgcccctgtgctacttcgctgaagctggtcgtcacaatccatcgccgccctcaccgaagctggtcggcagtccctccgtggcggcggaggtggcagcaccgaggccgtgagcgcgaggatggtgtggcggtgagcggcgccgcgggtgggaaggccttggtggcggcgcaccggaaggcctgcggagctcgtcggcgaggtgcggcatctccctctctttctccagctcctcctgcgcccctctgggcctcccgcctcacctcctcctcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgccttctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagttttttttcgtgcctgacagcaaattcgtgtttttccggtgtccactagctaattacaagttttttttggatgccccgtagcaaattttgccattttttatgtggcgtaattctaaataggattatcttaaaaaaactgctgcaagtttttttaaggaaaaaccttttcaatctaactatagtattatagtataattgtaatataattccactataattgtaatatgacttatatataagtgttataataatatatacaactttatatctaacttatataaagataacaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatggagatggccgcccccgtctcccccgcgccgcgcaccgtcgaggacatcttcaaggacttctccggccgccgcgccggcctcgtccgcgccctcaccgtcggtaagtaataacgacgaacacctcgcccgcctctctctctatctctcttcggttgtctcctcttctggatctaacgagctcgccgcccgtgcggggggtttttgtttgtgccgcgcagatgtggatgagttctacggattctgcgacccaggtaagaccgaaccggatcggatctgatgagggtagagagagttcgggtggtggttttgtgtgtggggtttgatttggggttttggggatgtgagcagagaaggagaatttgtgcctgtacgggcacccgaacgggcggtgggaggtggcgctgccggcggaggaggtgccgccggagctgccggagccggcgctcgggatcaacttcgccagggacgggatgcaccgccgcgactggctctcgctcgtcgccgtccactccgactcgtggctgctctccgtcgccttcttcttcggcgcgcgcctcaacggcaacgagaggtaccagccacacgcttttcctccattagatctcgtgaaaattgaccatctatgaagaagaaaagatcacttacttggagcgtataattcgatgggtgcaagtgcaatcgaactctgttcttgccttgtgggttgtgggtgcagtgtaatgccgttcttgtgcttgccccgtgggggtttatggatttgcatattttatttcagctcaactggtccatgtgtgcgcttgtgctgtgttgcacatgtttattgtgctttatttcaccattcttttttctctttgctgtgaatgggggccatgtttctcactgtgtttgctttattttctctctttcttttcttcgtttgctgaattgattttattttttgccataaaattgcaaaacagtgctgtgtgtacttggtgatgattattactcctaccagtagtaattgcctttgaaataagttcccgggctgtctgaaaatttgatctttcacttggaacatgttttgacagatttcttttcagttttcacatccttgtcagaagttggggggctgacggtgataggctctgtgtacttcacagtacattgaaactttgaaaggtctcagtgtctgcacaaatttttgtttcgtgttacaattcgagtgttgtgctatatggatgacctttcatcataatgctttttagtcatttgggttttggataccttaattcatgtttttcaagagtacctattttatggaccatggcagtaaaagtgttcgcaaattaggatacaactaataaacaatcaaatgggcaagtaccattcttattcaacttaacatgccataaattgaattctttctttctattgagcttcagttgtgtttgctctgttccttcgttcttccttaagaaactttgggattacaatttgctttgtgtccttaattttcaagttctgcaaatactcgttgaatatttttctcgctacattttaattcctaaaatgcaatgtgtcatatggagtcttttgatggataaccaaagggtagatgaagttttatgtgcctaaattattagtactgttaggttgaatcattaattggcctctggtccttttttaatgttttatgcaggaagttttgtgttttttgctttggtctacttgagtacttgactgccatgcaaaccataagtcgtaattctgtgatattgcaatttttttcttagcaaaagttatcttgtttattctgtttttcagtttgattttttttttggttcagttaatcttgctagtttcctggttgaactttgcatttctattccagccatttttctcttctcttttctccctgagatgaggctttgacgctttgtgagcttaagtttctatcattttggcatagtaattctgcctgctttcattgtactctagtatctattttcctgcacactttccacttctatttgaatttatttttcttctgtttcatcttactatctgttactgtatcagggcagtagagtgctaaactgtgaagtgctgccatctgttctttcatgtgcttcgtttgtgttgcacaaggagctaaatcagtcacaaaatttgtattatcattatgtaatgggaagcattatctgttccttatctgtttgtttatgttgctttcatgtttgtttatagtgtttcgttgcttatctgttgtctttcgaaggattcatattgtacgctggattattttttaactcccaaggaaatattgggtcatgcctcacaagtgttttctttctttatgtacaaattctattttatttgttgcattacttcatggatatcttgtttccatatttttgtctatcctgcccagggctaacctgttgaaacataaaacttgtgccatgtgtattggtgtcttggattcatattctgatttgaacatccctttgcatcaaccattatctctgttaagaacccaaagtatcatatcatggttaacaaaatccttttcctggatccaatgtgttgctctcttgattgtcaggaagcgcttattcagcttgatcaatgaccatccaaccgtgcttgaagcactgtctgataggaagcatggaagggataataaatctggtgccgacaatggcagcaaatccaggcactcaggaaaggtgccgtaccagtgctcttagtttttattttcatcatgaaccatttctgaactgtgcccatttgagtttttacgaactgaaagctggctttgttatgcagcgagcaaatgacgtgcagacaaaaacctcgaggccagcagttgttgacgatgggtacgatgaagaagaacacagtgaaaccctatgtggaacctgcggtggccgctacaacgccaacgagttttggattgggtgcgacatttgcgagcggtggttccacggcaaatgcgttaggataacaccagcgaaagcggaacacataaagcactacaagtgccctgattgcagcagctccaagaagagtaggcaataaaaaccatggagctgctgctgtggctctctactgctgactaagctgatcaatcaaatgatacttgccatccctcttccagtcccaagttggcggcagatgtgaagaatttgctctagaacattgcgcactgttgtggtagatgctggaaaacaaaaaagaagaaactttacaggatagtttgtttcataaactggtcggttactgttgtggttgttcatttgagatatggatactgttacattgtagcctttagaggaaatttgttcatgccttgtttctaatttggtatgtccttcccttgctgcatgacattgatttctctctacaagtttctgtctgtcactgtgcatatatactgtggtttgtctcggtgtgtactgtggaacagtcctgtctgctgggatatttggtccttggttcgtctactctgtggtgcatcagggagggattcagggtttctagtttttggagggaatctgcaggcagggatatgctcgttttcagagcagaagcaattatcaagatcacgggaatgctattcccaatctgatactccctcctgataatctcataataagttcacttttagcttttccatttgttataagttcatttttagagcaatattatatcggagtttatgaacgttgggaatataattgtattgaaatataattgtatcgagagtagttaaattgaagaatagttacattagcatttgataaagtaggggtatagtctttttagttttgtattatatattagtattagtatgtgtgggatggatgaaaaatgaatgggagtgcctagcaatcattcgaatgattttttcattcatctcactcggatttttcaacatatggatgtgcgccacgttgcagagggaaacaggctagcttaatagtaagttcgtaacaacagacccaatatgacagttataagtccaaagatgtttaataaaaaaaaataaaaatgtcatcaacatatgcatcagcaagcgtcaagcgaatacatataatctttcccaaaaaaatgtttttggtttcctaaactgaaaatatgaagcaaagtaactgaacgtataatctttcccaaaaatttgttttggttttctaaactgaaaatatgaagcaaaataacttattaaaagcctaaattttatcctcaaaaattaaaagtggaccattatgttaaactaccaacatgatttccgttttcctccgtcagcgcactacctcctagcactccccctaagggcatctacaatcactaactgagggtactctaggtgtactcacatctacaatgcaggccatgtctggtagcccaatgagtgtcccaacccaaaatagcccatttctctcatcctcctctctttcctattctacccctctcttccctctctctctctccctccgcacgaccgcatgcgcattcctctctccctccacccgttgttccactcacagcctgcttccctctctcccgccgctgctcccgccgccgcctgccacctccgctcgtctccctctccctttctctctctctctctctctcactaccaccaccgtctcccgccgccgcccccgaatcgagctcatgggacggaggcggcagtcatcatcgtcatcgtctggtagctggagcagcagatccggggcggaggcgaccgacggcgagcggcgcacggggcggaggtggcagtcgtcatcgtccggtggccggaggcggcagatctggccgctctctccctctctctctctcccgtggaaggtggcggcggcgaccccggaggcggcagatccggcgccgccgtggccggatctggccccccggcggatggagtggcgccggccgcgccgcatcgagacggtggtggtgccggtggtggccgcatcgacgatggcaccgtcattcttcaccgcactcgccgacgccgccccctcctcaccctcccttcttctctctgacagcgagcagccgcatcgagcagacggtggtggcatcagcggtggctgcatcgatgatggcgccgtcgccttcttcaccgcgctcgccacctcgctcctcgccctcccttcttctctccggcggcaagcggcaccttcgcctcgcccttgacgcgcgggccggtgacataggggagaagggtggaagaggaaatcaaagctctggggtgcgtcgcctcaagaacctacctacgcaatgggtttcttcgccccgtccccctggaaaaagcgagcgagcgacgcgtcccccagctagggcgcgcgtttcatcccaggggacgacgcagacgaaaagcctaatggacagcgctagggagacggaccgaagcactacattggtgattgcctaaagccgcgccgatctcccacgtgcgggaaaagcgctcccccctaaagccatgccgttcgcccacacgtgggaaggagaggaggaagtacaaggtgggagcgacgatattgggagtgggcaagggcgccgttttctctgacatatcaacataactccaaaaatcatgtaggggagtaggggatctgttggagtgctttttttttcactaaaatacctgaaaattggttttggagatgaaataggaggaccattagtgatgctgtaagaactttaaaaaaattacgatggtcaaggaaaatatagtttatcttaaatatagtttatcttatggcaataaaatatttaaattaagttgagttgtctctacgtatagcttaaaatgatactccctccattcttaaatatttgacgtcgttgacttttttaaacatgtttgaccgttcatcttattcaaaaaaacttatgtgaatattattcaaaaacttgagtagtagtagtataatatttaacaatgaatcaaatgataggaaaagaattagtaattacttaattcttttgataagacgaacggtcaaacatgtttaaaaaagtcaactgcgtcaaatatctagagacggaatgtgtacataggaatagtatttttgcatatcccaccaaaataaaatgaccaaatgacccaatttgtcgggggtacctttagcgcatgttgctagattgtgcaaatttatcccctttttttcaaataatgaaataatggattaattcgtacgctccctgaatttataaacagtgtttaaaaaactttctatacattaatttctaagaatattgttttaaatctattttctatcttcataacgtttaattcatttatatcctcaaataattataataaatcattcgactattcggtcattcagcataaaagaatagagccgtggacatgcgaacccacatgctgacatgcatgaacaataatctttcatcaatttgtgttatttgcgaaatcaattaaattttatccataagatgactagtggcagctgtagatacgtggtatggtctactctcttgcagattgcgaatagtttatcattaggtattaagcttaataaagggctgtttagattatagccaaaataaagtttaccaaattttgtcattaccaaaagtttgataatattactaagttttggcaggatttcttacgtgtttaccaaagtttggtaaaaaaaataaatagttgcatatttttggtaactttattacaaattgatatagttaatctgaacaacctctaagtcaatgcttgcttcacgtgttttacctgcaagttcacacacacacacaaaatgcatatttgtatctcaagttcagtaggcatgcaagtcaaaactgaatccctccatggtttaaactttaaaatggcatttataattttactgctgtaggttggcatttgttatttgcaatcgctttcatacggtcagagatgcttgtcatattctaccctttggcctccatctgtttctcgttttgctttcgttacggataatatgggaatattttagaggacaaagtggccatccggtgagccaagtttcataattgtttaacccgttttatggtgtggagtgtacccttagcattgcgacatgaatggctgaaaaatcatagttagatttttctaaaatgcagtttagtcatattttaagcaaacagccaacagaaaagacatgtgaaaatggaaattttaatatccactcttcgaaaaataacatgtaaatagcatgggggttgagctgtcaacagcagagagagcactcccctgttacacccataaaaaattctatgaaaaaaagtaaatattattgttacatccgtcccataataattataactgtaagattcaaattaattctaaaatagttattacaatagagtagtaattatcccatcaatcactctcattcaaaattttcactattttaccatcattcatcctcccagtcctacctatatatattattaaaccttaatatatattaaacaacctagaattaaaattattttgggatggagataatattatacgcgtgtaaaacctcaaatttaaatttaacaattttaagagtataaatctatcataattttatcttttttctttctattacgataaatttcaagatgagacttagatgcatgttacttgtaaaaacaaatataatttttattgatatctgttaattggtgtaaagtttgtgcattcatgatacattccaattttgtaaaagcttactattttactcatgaactttaagcagcatatatgaagggtgtgtttagttcacgttaaaattagaagtttggttgaaattggaacaatgtgacagaaaagttaaaagtttgtgtgtttaggaaagttttgatgtgataaaaaagttggaagtttgttgaaaaaagtttggaactaaactcagccgaattttagggaacatttggtttggtatgaactttggaattcatgatccgacccgtttgttgccaattcaggtgaccaaatttcagtacgccaaccatttgcagttgtttttgacgaacctaacttcaaacaaatgcaatttggagcaacaatactattattatagccactatcagagcaaaaacaactactaccttagatgaggaattaataaataatccaaactggtcccctactgctaggttgctgattaagatgagtgattaagcatcaattaaatcaagacgactagctccccactcactgccaggtgggcccaccttgtcggattagaggaaagtccctcactgccatacacaaccattgccggattagctgtccatcgattacaaaaatcccaaatcttttggcgccgccgtcgctgtcgccgacgacaccaccgccgccgccgtcctcgtcatctccagatcgccctctccttgatccccacttgcatcgccccggaggcgcggtggacgagacgacggcgatggccggaaaggatgaggcggaagggctcgaggcgaggctgctgctgctgccgcctgaggcggcggcggaggagccgacgaggtgtggcggcggcgacggcggcggcggcgggaggaagcggaagaagacgtaccttgatgtccttggcgtgtgctgctccgcggaggtcgcgctggtggagcggctgctcgcgccgctcgacggcgtccgcgtggtgtccgtcgtcgtggcgtcccgcaccgtcgtcgtcgagcacgaccccgccgccgccccggagtccgccatcggtaagccaccgcgcgcgcgcgcgccattaatcctccacgcgattctcgcgcgagattctcactgaatcgagtcgtcgtcgtcgtctttgtcttggagtgcagtgaaggcgctgaacaaggccggcctcgaggcgtcggtgcgagcctacggcagcagcggcgtggtcagccggtggccgagcccgtacatcgtcgcctccggcgtcctcctcacggcgtccttcttcgagtggctcttccctcccctgcagtgcctggccgtggcggccgtcgtcgccggcgcgccgccgatggtgcgccgtgggttcgccgcggcgagccggctgtcgctcgacatcaacgtcctcatgctcatcgccgtcgccggcgcgctctgcctcggcgactacacggaggccggcgccatcgtcttcctcttcaccaccgcagaatggctcgagacgctggcctgcacaaaggtaggagtacatgtcaatgtcctcttcaccaaatccatggcgatcttggcacgaacccggacgaacactcacgttgcgaggtgtgcaggcgagcgccgggatgtcgtcgttgatgggcatgctgccggtgaaggcggtcatcgcgacgacgggcgaggttgtcagcgtgcgcgacgtccgcgtgggcgacgtcgtcgcggtcagggccggcgagatcgtccccgtcgacggcgtggtggtcgacggccagagcgaggtcgacgagaggagcctcaccggcgagtccttcccggtgccgaagcagccgcactccgaggtctgggccggcacaatgaactttgacggtaaacaaacaaacaatcaaaaaaatctctcatctcttagtttcagagttcccaaatgtacggaactctgaaacgtccgtgtcgttgaattgtccgtcttttctcatcagcttaagttctggtaaactgattgacgcatccaactcaatagtcacaatagcacacatttgttcatgtcatgatcaatgggattgagaggctgtcacgtttcaggttacattgctgtgagaactacggctctcgccgagaactcgacggtggcgaagatggagaggctggtggaggcggcgcagaacagcaggtcgaagacgcagcggctgatcgattcgtgcgcaaagtactacacgccgggtgcgcaatcggcatcgcctaaactctcaacatctccaattttacaacacaaaattcatcagtaacaaagacatttctgttcttggtgcgttgcagccgtggtggttgttgcagcaggagtggccctgatcccggctctgctcggagcagatggccttgagcaatggtggaagctggctctggtgatgcttgtgagcgcgtgcccctgcgcattagtgctgtcgacaccggtggcatccttctgcgcaatgctgcgcgctgcgaggatggggatcttcatcaagggtggagatgttcttgaatcacttggggagatcagggccgtcgcgttcgacaagaccgggacgatcaccagaggagagttcagcatcgactcgttccatctggttggggatcacaaggttgagatggatcatcttctttactggtaagactgagaaagaagatttcatttcagctcttggaatgcagctgctacactgaacaaatttgacagattttcaactgttgtcggtttacgacttgtcgaaaaatccttagtacttgtgatggtttgaattgacttgaacagtgaaatgcttggcacaaattatgtctttggttattgcaggattgcaagcattgagagcaagtcaagccacccaatggcagctgcacttgtggagtatgctcaatccaaatccatccaaccaaacccggaaaatgtgggcgattttcggatatatcccggggaggggatctatggagagatccatggaaagcacatctacattgggaacagaaggacattggcaagagcgtcatcacctcagtcaagtgagcaaaacacatcatttgtagtagtagtacagttcctgacaattaagcttcagaattagctgatcagctgaagctgagctgactgaactgaaatctgtgacgtttacagctcaagaaatgggtgagatgatcaagggcgtgtcgatcggctacgtgatctgcgacggcgagctcgccggcgtcttctcgctctccgacgactgccggaccggcgcggcggaggcgatccgggagcttggatcgctgggcatcaagtcggttatgctgaccggggacagcagcgcggcggcgacgcacgcgcagggccagctcggcggcgtcatggaggagctccactccgagctcctcccggaggacaaggtccggctcgtcagcggcctcaaggcgaggttcggcccgacgatgatggtcggggacgggatgaacgacgcggcggcgctggcggcggcggacgtgggcgtgtccatgggcatctccgggtcggcggcggcgatggagaccagccacgcgacgctcatgtcgagcgacgtgctcagggtccccgaggccgtcaggctcggccggtgcgcccgccggaccatcgccgtcaacgtggccggctcggtggccgtgaaggccgccgtgctcgcgctggccgcggcgtggcgccccgtgctctgggccgccgtgctcgccgacgtcgggacgtgcctcctcgtcgtgctcaacagcatgacgctgctcagggaggagtggaagggcggcgccaaggaggacggcgcgtgccgcgccacggcgaggtcgctggtgatgaggtcccagctcgccgccgactcccaagcacccaacgccgcagacgctggcgccgccggccgtgagcaaacgaacggctgccgttgctgtccgaagccgggcatgtcgcccgagcactcggttgtcatcgacatccgagccgacggcgagcgtcaagaagagcggccggccgaggcggccgtcgttgccaaatgttgcggcggaggcggcggcgagggcatccgctgcggagcctccaagaagccaactgcaacggtcgttgttgccaaatgttgcgggggcggcggcggcggcgagggcaccaggtgcggcgcgtccaagaatccggcaacggcggccgtcgttgccaaatgttgcagcggaggcggcggcgagggcatcggctgcggagcctccaagaagccaactgcaacggccgttgttgccaaatgttgcggcggcggcggcgagggcaccaggtgcgccgcgtccaagaagccggcaacggcggccgtcgttgccaaatgttgcggtggcgatggcggcgagggcaccggatgtggtgcctccaagaggtcgccgccggctgagggaagctgcagcggcggtgaaggcggtaccaatggtgttggtcgttgctgcacgagcgtgaagaggccaacctgttgcgacatgggagcggcggaggtgtccgattcttcgccggagacggcgaaagactgcagaaatgggaggtgttgcgcgaagacgatgaactccggtgaagtgaaaggatgatgttgcaagattgaccagtaattcactctacgaaatgttaagttttaactgatcattattgtgtcattttccttgggctgaaatcatcttgtaatgcatcaatgattgttgtacagtactagtatcattgaaaactgccaaataacatgtaacattcgaaatcctttttttcaatgttgatacgtagttcacgattgcataccaaccctcgtacatgtacatcgcactcaatagccacaagcgtgtcccatttgagatagattattgacagaattattggtttggagtatctaatttactagatgatgtcccgcgtcttgctacgggatatatgttagatatctattatctatctattctattctattctattatatactaaaagtccattaaacttcctacaaacgctcctaagccaccacgtggcactcctacaaacgctcctaagtcgccacgtggcacaatctaatctcaccgtcgatttttactaaagttggtggacccattattttacaccattagattagatctattattgacaaatacttcctccattttttattagatgacgccgttgactttttctcacatgtttgaccattcgtcttattaaaaaattttatgcaaatgcataagatataaattacacttaaagtaatatgagtgataaaacaactcataacaaaatatattataattacgtaaatttttttaataagacaaatggtcaagcatatgagaaaaagttgacggcgtcattgttaacagtgaaatttggtaagcccggagtaatcatcggcttagagtcaacatcggcttcgaagtcctgagattagccgatgagagttgtcaagatgtcagttgtcggattcttgctatattcggttaagggaattgattaaggaagcttgtccagaagagaccaagttcaaataggatacggcatggcaagttatctattaattaggaatagtttgttagtttccttttatctttaggaaagtgtgtttagtgtcctataaggactttatcttttccttttatctttaggaaagtttctgtcttgtccgacaaggacttgtatcaacccatgggtataaatatgtacacccggggtctatgtaatctatcctcacgattaatacaattcggcgcatcgccaccttttaccttttctactttattttatcgtccggcgggacttggcacctgacgcagggctgcatcagtgttcgatctccggcgaagggataagtccaatgttccgtcggttcaggcaattgtatcgtctacgtcggcgtcgttcaaggctgcatcagtacattcaacctcttggattgctctggtttgaatgatatatttgcctacccatttatcatatgtctctgttaatctagtcttagcatatcaatttagctctatcggttgcttctcgttttagggtttctaccgatatcggctaaatcgcgttgctagattagattagcttagacatctaccaccctgaaaatcagtcaacggtttgattgtctggatattgtgtttcttttcatacttagtgctgcatcagttaagtttgatctactaagtcgtgcttagaaccgtaatctctagcatgctttttgactgccaataagggtttcatcgaggtttcagccggtgagttatctggacgttgtgtatgttcccccgccctcttctagactttatacatttgtaaaaatatgttcggctcataaggattgcatatacatataagttggatttagctgatgacaacaaaggtttcactgtttaatctaatctcgtggatttcatgacatcggaccaccagccgatgtgtgctttaatcttcggatcaatgcttattctatcatatcaatgctagccgattggtttatactagactatattattgttatattttattatcagtagccgattgcctatatatcattatttactaaagtgttagaatctacattggatgtatagccgattgcttaaactctatcgttatcggctggtatcggcatcggctattatcggctatcggctggaactactccatcggcttgtcagccgatcagctgttttatctgctgtttacatattttgtcagttgcaggatcaaactgactggcacgcccgcatctcatcaagatttggacctgcacaggagctaagcagatctcccaggccgatgtgttcgattttttcgtcaacagtcatctattaaaaaacggaggtagtaactacctcgtgtttataacgtacaagcgctactactgtccgtacatatttgtacgatgcaaatgttactgttgttctttccatacgtacaaacgtacatgattgtgaaaacaaaacgataaagctttcctaatcttcacttgaagaaaaaaaaatacacatgtacattaaagacaggaaaaacatacattcataaaaatcaatggtctttaaaatatgattttctacaatataaagataaaatatattacttcataaatataaatatgtttagttaaattaacatgtataataaatattcaatgaattttcttccaaatctatatattatatactaaaagtatattaaactttgtacacacgcctttacaccgctacgtggctcttacataaattacagaaatcttagaaatctattatatactaaaaatctgttaaatgtcctgtaaacgctcctacattgtcacgtgacgctctaataatgatagagaaatcctagaaatttagagtaaaaaaagaaaagcatccaacctttaattttctattaaattagtggatccgttattttaaacattggattagagctcttagaattcccatgctgctaatatctatccaaaaaaaaacataacttgcttacgtcgtacgatcgtctcccacctgaaaaaaaaacttaaatacctacaccatatacgatcgagaaaaagataaagccaaaaaataaaaaaaaacatgcacacatatataggggtgaaaacgggtcgggttcgatcgaatgtcacccttcccacatcctaacccatattttataattggaatcgggtcggacacggatagtgccgaatacggatagaaactcggataatgtcgggcaaaaatacggaacttatacataccaaaatagatatgtacactatcggttacggatatttattccgatatcaagtcgaagcaacaatcttatatatcatataggcaatcactatttaacaatttcatatatcatataataagattatattaggtcattaggaccttaggaaataaatagggtacaatacatcatagtataaccaatacatagtaccaaaaagtacctcacaaaaacgtaatacgtgtaatatccgtataattatccgggtaacacccggattttttaccggataatctgtatccgtcggatactatattcccgaacccgatctcatatccgccaaaaaagtctcaggtacttgaatttgtcccgaaagtaatgtgaccgggcgggtgagtgggacatacccacgccattttcacccctacacgtatataatagaatgggaaaaaaatactaataaggaaaaatcatcagtgccagcactgatttgtggtcaacaacctttaatctatgattttattaaaaataatactatatagatatgcatagttaaacttaatcgtaaacttattgtagtgataaatatatcatgacaaatgacgccaacatgtaatagcaaatgagatcataatgtttcaaataatttcatatcaaattttatggtgtcaaatatcacttgacaaatatacaccgttaatttgaatctacatatgtaaaaatcaaaataacaaaacctagcattgttttttaagtacatcgatctattcaggtttatttaattttgggagagaatgagattctcaaagtatttggaattttcaaaatttttcttatttgagctgtgagaagcacaattaatagatttatgagaaaataaattaaagtttatccagtgataataaaataacagaatttagatttggttaatttttaagtggatctttttaagtttattttgggtgagattgagattctaaaagtatctgaaatttttcaaaacttttttattgctatttgaggagtgagatgcatacatgatagatagatatttcttatatgccactaaaagttcaccggtttccttatatgccatcgtaaattagctattcccgtatatgccatcaaacgaaattttcgctcacctatatgccatccacgtcacccaagagtagaaatagtgttagtttttttgaaaaatgacaaaattgcccctggactccctttcctgctatgtaaagaacaaatcaggatgtgttgcagttaaaactatgactataactttagcaatcattattgattcaacacacaaccaatttaccaaacaaatcaggatgtgttgcatttaaaactatgactataactttagcaatcattattgattcaacacacaaccaatttaccaatgactggatgcaaagttttatttctcttccatttttatagtttatttatagattatagaaagaaatagtttgtattcttttttaaatggcactaagaacaataatttaattagtcctaatttaatgtatctaactggatgtaagcattcagtttagaaaaaaaaatctctcggcttagcaaactgattgtgtgcctaatttgttcacaaaaatagttatgctcaactaaaaaggttaagtgcttaatttagtctcaccatggaagtaagtaacttcatgataccgacatcagttgaataacatcaaaatatgcatcaccttttttaattcgtggtaagaaaactaagacaaaagaaaggaaaagaaagctaagggtaatttcttactttcaatgccacctaaaatagtcagatgacgtggataacatatgaggaattgaaaaaaaaatcatttagtgggatatacgggaatagcaaattttcaatggaatatgaggaaactggtgaacattcaatggcatataaggatttttttaataaataaataagattttagatagttattttgctacaatacaacccttaattcatcacgagaattacgtatttgccaagtagcattggcaaaacatgaataatacaataaaataagcataaaactacttatgttatattttttatggttgataaaaattctaatataccgggtataattgatggacaaatgctatacaccactaaacctaactgtaagtgcactctagagaattagttggtgtaaataagtttgtgaaaataagtacattcttagaattagtaaatgagtctcatatagttgaaaacaacatatgatggaaacaaatctaccgctaaagtataaatctttatcgaaatataattaatgataaggtgttttgcagattttcatggtctctttagctatagtttttattaagtactgttgaatgattaaccccactcatttgaaaaacataatattgtatgtattctattataatttaagaagtacttattactaacttcatatacacattttgcctattctctaccacaaatcgactcaaaacttaaaaaaaaaccatttttatcacctcctttatgtccctctttatccttcaatgcagggtgcagtacttgctataccattgtaaatattgcatgggcatgtacatggttgtgttaaggtggtgtccatgaaaggccaccataggcaatgtaactaaagtgacataattaccatataatcatttgtgattgtaccgatattgaactaagtgttaaaattgtactctaggatggtttttaggggtatggctacatcgacgcgggacccatatgtttcaaggcattacatacgaaagcgttggttggcagatacagtcgacttcatccattaaagaggcattcatgtttattttaacggtgttatcgcattattcggtagatatataaggtatatttagactatttatacatagatgtgaaaataagttatgaacaccgggttatgtaggtagatgaatttttttagtatattaataatgtgtcatttgttttagtgatactaatacagtttcatttattaaaaagtgcacctaactcgatcttaaaacaataacaatgatagtaagtagtggtgacaaacgatcggtttatatattaccaggacaaagggacttttttttttaaatgtaagagatattcttatcacattagtagtatactaaaatctatcatctattttacggtaaatatatttctttttctattgtaggataatctaaattctcttacagtatatacatatatagtgatgtataattccttttagcattttttaataacaaataagatgcccgtgcatctgtacgaaattcctttccgatttatgttttggaaacacaaactataatacatgcccgcgcattcgcgggggctaccttcctagttggagaaatgatacaatgatttggtttgaaatattatgaatatgatttagcatgtttatgtttagtttaagaatgaaataaattatagatataattactatatgcttgcatgttgtgttttgtgtgtttaatgggttgatgtggcagcttgcatgtatgttttagaagtgtcaataaatactaagtttgcatgttgaactttagatgtttagtggatattaactttatagaaagaagggataatatgaatagattaaatattttaaaaataagccaagcaaataacttataagcggtctaaataatagagtgatttttttagtaaaacatattttagataaatagagaaaataatcaataataataggccccgaaaagaacaaggcatatgacaagtacatgacacagcaaagacacatattagaaaagtacaagtcatatgacaaatgcatgacacacgattaatgcaaacacatagagtacaaagggaaagggtaaaaaggtgctatatttataacatatatttttcaccaaaacaattatattttttaactccataaattacctacacttacattaactatattgtaaatttaaaaacttacattacaagtttcaatttttacattgtaattttctaatacatagagtaaaaagaataggattaaaaataatttattatgtacttaaaagagtacatagaaaatatagacatatacttattatgtagaagagaaaatcacatagaaaaaaaggactcaaattaagtgaaaaataagtgaatcaaattttagggcttgtccactttgatgtcattttcaaccttaccaaattttagtaaagttgccaaaaaagtggctacatttagtttgctaccaaattttggtaactatataggagatcctgccaaaattttgataagttgtcaaaatttggtaaggatttttttacatcaaagtggacatgcccatagttttagcaatcccgaaggggaaaacaaacaagatttcattgtgggaataggttccatgtttatttacaacggattttcggcatgtcatcagttgatttaccggttatgagattctccttgggatccatgctcaaaatggatattgaactgaaattccaaacaatcccacgtggatgggctgttattcaggcccatccaaacaataccttaatgggctcattagcaaaccccaacaggccaacactgctacatcaactcagcccagatacgaaaacaaagtccagaacagaaggcccaacaaggctctgcactctgaatcttacacatctcctttggtcagagtcaagctctgaatcttagcagccatgtcgtccatgaatttctcatcactgtcctgttgcaggatcttccatctttctgttgcttcctggacgggtcaaaagatatacatctccatcagattcagcaggcgcggatctcgtggactgcaaagcatggcgacacaatgtcgacattgcttgataaccatgcacacattcttcagactttcagagttccagattcaacagagtctgctatctcgtttcaaacccacaaaggtaggcaggtgcaccctcgatcacaatcagtacccccagttttagtcacacaacaacaaaaaaagaaaaaaaaaactacacacacctctacacattaacaatatataagttcaattagaatgctacaaatactacaaaattgcgacggcgagtacattcacttccattttttcttctcgacctataatttaatttcctctacattagtccctgagtgacgcttgtctaggcccatttggcgagcatggacatgaggccggcgccggcgagcatggcgaggttgatgccgagctggagcttgcctttgctctgcaccctggggttcatgaagtcctcggcgaggaggtcgacgagggccatgtagatgaggatccccgccgcgacggagttgaggatgccctccaccaccagcgccgtcgggctgctctcgttgtacaccgacgagatgcccacgccgacggcgatccccaccggcgtcgtcaggcagaagaagaggaccatcgtcacgatcgacctcaccttgaacttcgcctgcatacattttcaggagaattaaattaactcatgctgtgttattaaatacatttttcaggagtagtatgcaaaaggttgatattgccggaactaggcaacttgtaaattaagccattccatttgtatacttcttcgggccgttctaaacagaggttggaaaccgctgattagccgcattgtatatataattaagtattaattattaaaaattttaaaaaataaatttatttgattgcataagcacattctatataaaaagttttcgtacgaaacatatcgtttgtagtttaaaaaatgtgataacagaaatcgagaagtaactaattaattaaccgatctctgatttgaaacaggcccttaagccctattcatcaggttacatttcagcttttctgttctttgtcttatacatataccagtccgaaatactatcaaatcatgtaaagtttcaatgctttagatgatcactactttgactcaatctcgagccagttagtcacatagccttccttggtcaaatcatcaaagtaatatagctcccttttccctctttacatatatattgtttttcaagaataaagtgccctatcttttccatagaatcaagcaagtggattagtagcttagtcttttttttgcctcttttgatggagaccatacaatacaagaccaaatttccagcttccagtgcgcgaaacataaaagattagcacgaaaacactaaatcatgctacgacaagtttagtgtaaataagtttcattcatcggattatctactttatagtacaaataaattaaatattttaaaatataaaaaaataaatacttctaaaaacaagtggtgtaaataatatagtactagaagattttttttagaaaaaacatattttgaagacgctgaggaaataatttatgacaataatccggtgaaacagctgaactacatgaatgatttgagccaacaaggctatatcttttaagatgccgtgcaagataccatttttacatatatgaattttgggtaaaaaaaaaacaccatgtagtaaaagaaaaagagagtagaaatatacctgcacgatgcagccaccgagtcccatgccctcgaacatttggtggaagctgagggcgaccaccagcggcttgatggtttccggattctgtgacgcgccgagggagatgccaatgatcaccgagtgcaccacgatccctagctctagaacctaattaaaatcaatcaattgtataagtcaataatgatacacaatatatattattctgaatattgcactcgtttgttaaattctgcacgcatttttctttgcattttacatcaccgaaaatgatatatgtacgacacacattgaatttgaaacctttgggcgcatgtgccctcgtttttccgcgattcggctctttcttctatcactccataatacgccgaaaatttgatctttggtataaatgctattttcgagaacgccaatttataatatatggtgggatctcttataaaaaaaatatatgtgcaaaagaaatgaatacacttaaattccattttaattctgcaatatttatttgaaacgtacatactactccctctatccctaaatataagggattttgattagatgtgacttatcctagtacaatgaacttggacatgatttatatctagattcgctgtcttagaatgtatcacattcaaccaaaatctcttatatttaaggacggagagagagagtagtaatgaaagtgtggaaaatgacagtaaaaaaaacagaaggttactgagactgctgtttcttacctatgggttaattaaaccaggctggcgtcatgaatgaatgcatggtaattagctaggtgttacgttaattaaaggaggtggcctctcacctgagagatgacacgatgccggagagttgtctccttgtcgtcctcgccgacggccgcgacgagcgccgacgagccgtgcgcgtggccgtgcgtcgcgtgggtgtgcacgtgcacctgtccctcgtgctcctcgccgccgccgccgccatcgccgacgacgtggtgattgtggtggtggttgtgctgctgcgtcgcggcggcgctctgcttctcctcgtccgcgacggcggcggcggtggcggcgtccttcttggacagcgcacgcgtgaagtagccggtggcgagggtgtcgacgacgagcgtgccgatggcgccgaccatggcgccgaagccggcgaaggggaactccttccacggcccgccggcggggaggcagtcgtcggtgaggttgtcgaacgcgtcggggaggatgtggatgaaccccgtggcgaggatgacgcccgccgcgaacgccttgacgaggaagaacacgtcgccgtcggggcgcagcgcagggacgtggcgccccagcgaggggaggccgcaccccagcgcgccgcacaccaggatggagaagaaggccgcgatcttgagccccctcgcccgcgcccggtcccgccccgccgccgcatcctccttcccgcacccgccgtcgccgccgtcgccgcgcgccgccgtggcgagcagcagcgccacggccgcggcgaggagcacggtggcggtggtgttcgtcctcatggccgctcttctgctcctgctgctatcgcggattcgcgggttttatagattcggatggtgaaggtgaagggagtaattagggttttaatcaccttggattagtcgctcggtttaaatggggggattaaaaggtgaatggtagtagtaacacagagtgacgacacttgacagtaactcggggtgaaatttttggttgagggagatattttagtttttgttttggcaagtaattacggcgtagaattactaattacgcaaggatgacgacactatttgtcacgaagtgttgacatgctgagtaggagagagaagtgtagcattcgagggtacgcgtgtgagaatttcaggccatgaaacgcgtaacgaccggaagtgtagcattccaccgccgtcgccgtcttctcccattccacatggatgaaggtactcgatctattcaatgacaaatgggttcgaggagtcttatgtatcgttaagtactcccctccatttttatttttttttttacgcttcccacaggcccgattaaactaaggaagctgtgaattaacttgtttgcccttcactcttgcccctttgcactaatgcgtttcgtccatacaggggtgaaaagggcaagggtggaaattctcgtatgggaggagggcgtctgaactgcaagcgtcaaaaaaaaaaaaacgccttcagagcatctccagcaggaaccttaaatccagcccctattcaatttttgagagttaagataaaaaaactagatccagcagggaccctattacagccccaaaataagaaggccctcaaatcctcccctaaggcctcagtcctaggggctccgagcacggccccatcattctttttttttggcgtggataacaattttgcttcgcgctttttcgtgttattcctgcgcggctgcgacgagggatcttctccggcgaccaccggcgaactcccagcatctccgccaagcctgccccaaaaggtaagacttttccacacatttgttcgcccgtcgtccacaaggccggcggcggtggtccatgcgtacgcctggtcaccgacctccccccatccgcctggccatacgccggccgtcgcgtgccctctgagactgcccgcacgcacatcacccacttgcatggtgtttgcccccacgctggcctctgcccgatcatattttcagatttcactggccggagcctgtacaccgccgctgccccattgatttttctggaaaaaacttgaagttggtcatgtggtgtggtggttgagtagtagaggagatctcagtagtagagtaccagtcaatttttctgaataaactcgttcttgactacctgtggacgtggtgacagatggttatggtggtgaatgatttgtttttaatatttttttgaagaattgtagtggactgtcggccaggacaatctaaattctcaactagtatatatcactgtacttatagtagcactgcattgtgtagcactgtacaattgttgcaatggatcgattataaccatatatatatgcactgcttttcatagattgaatgttgcgtactgtatatgtgtagttggatacgtgtgtgtatatgctctaaattttcttattaattttatgatcttgtgatggcagtgttttttacatggacttctacgacggtgacgacgacgacgacgacgatcttattaccgaatggtgggatcaagaggagttgtttgacgatgatgactactacattgcagctgctcttcttacggacatagagcataagaggaccaaaagaaagcgtcgtggttcagtcccaggtcgtgagataatttatagggataggtttgctggcaatttgcgcatagtggctgattattttgcagatcctcctgtatataatgcaaaattatttaggagaaggttcagaatgtcaagggagctcttcttgcgcatcgtggctagtgtggaggctcatgatgactacttcaggtggagaccgaatgcagtgggtcttctcggtgctactgcattgcagaaggtgtatggtgcaattcgcatgcttgcatatgatattccaaccgatagtcttgatgaagttgtgaggatttcagagagcaccatgatagaagctttcaagcactttgtcaaggctgtggtagatgtgcttgctgatcaatacttgagggcaccaactgctgaggacactgcaaggttgatggctataaacactccaagggggttcccagggatgttaggttgtattggctgtatgcattggaggtggaagaattgcccaacaggctagaaaggacaatactcagggcatgtggatgggccaaccatgattcttgaagctgttgcatcgaaagatttatggatttggcattccttctttggactaccaggttctcttaatgatatcaatgtactacagagatcaccactctttcaaaggcttacatcaaggacagctcctgagctggagtttatagtgaatggaaagaaatacactatgggttactatcttgctgatggcatatacccttcttgggccacttttgtgaagaccatttccaatccacaaggtaacaagagaatacattatgcaaaagttcaagaaggagtgagaaaggatgttgaaagagcatttggtgttctacaagcccgctttgcaatggtgaggggtcctgctagattttgggatacagagaccctatggtacataatgacagcttgtgtaatcatgcacaacatgatcattgacaatgagcgagatgaagatgtagactatgactatgatcgggaggacagtgaggtgttgagaaaggaggaataccaatggcgtaataaacctgtgttagagaagtttctaaagatacataaagaaattgaagaccgacaggtacatgagcaacttcgagatgatgttgtggaacagttgtgggcgcttcatggtgctcgatagtttgtttcattgcattttctatcatgtatgggttatgttcaatatttgctcgtaggatatatcattttcatgtttgaaaattttgaattcaaatttgaatcgtggtatttgaaattgcaaatttgaatatggttgaattccacgcgctagagttatctatgtttgaattattgtgtgttaaactaaatataaatataaattctatactaaaataaaagagaaaaaggaataggggctaagatatggaggctactgctagacataaaggcatatttagggtcctaaagcattggggacagcccccatttaaactttagggactctaaagtagggcctactactggagatgctcttaggtatgaattggaacgtcaaacaaaaaaatggaagggagtaatagtattatatactacctctgtccctaaatatttcacaccgttgacttttctaaacatgtttaaccgttcgtcttattcaaaaatttttgtgaaatatgtaaaactatatgtatacataaaagtatatttaacaataaatcaaatgatatgaaaagaattaataattacttaaattttttcaataagacgaacggtcaaacatgttttaaaagagttaaccgcgttaaatattttgggacggaggaagtgtgtagtagtgcagatgattttaatttttcacatgcctcttttcttcttcttcggccaccatccggagagcgccacgcgtcagacgtacggcgcgagacgaataatcggacgcctcgcacgaccgtccgatccatcataaatgaatcaagcaaactttaaactatttttttctcttaaaatatttatcaaaatcatgatccaattacactattaaatccattacaattaaatctttaaaacaagaccacacatgaatataaccagatgaaaaaaaattagcttattattgaattatttttaaatgttgcacgctgttgcaccaagtatatcagaattgtttcactaagtagatcaaaaatgtttcatcgaacgccttatttgaaaattatgtttcagcgaatagcgaaatgatgtttcaattcactgcaacatttgatccatatatagtaaaacatcacgagtacactagatgaaacattttaaatgaaaataactcatttgaaattgaaaaaaaaaatcagacggtcaaatattgcagttgaccaacaagtgaaactttaagttatatatggtgaaaaaaaatcagcaactgaagcatttaaatattttatgaaatatggtgaagatacacgttgaaacatgtcgctatcacatataaaacaataagtattaatggactgaaacatatgtttttcttttatgaaaatataattaagcgatatcttattgtaaagatttaattacaacgaatataacggtgcgatcggatcatagattgaataagtaatttaagataaaattttgaagcttgctaaaatacatgcatctatgcatgcatgaggtggagagagagagtagtagcaggtagtttcagggattttgtgaaacacactgaagacacatattaaaacatatcactatcacgtatgaaacattttgttttaacagtttgaaacacatgtttttcttttgacataatataatcatgtgatattttgttgtaaagatttaattgcaacgaatacaaacgatgtgataggttcgtagatcggataagtaatttaggagaaaaaaatttaaagagaggaggaaagaatgaaaagaaacagatagacatgcatgttacggtaacatggttcgtccaatccaccaggctgctgatttgtagtattttcctgacgtcgacagagagagaagaaattagtaaataagaagtgagctggtcgtaggtgtccgatgatttttatctgatcggacgttccaagagaagtattttcgccaccatcctcttctcctcgattcggctatctcaacctttgtcttcgagtagaagaatgactataggagggtagcaaacaagtgctttgtcttcgtatagcccaaacagatccaagcttgtcgatcatctcgagtaattcttcttctcttgccttcgaattgctccgagcattaatgccgacaatgagtagattaggacagcacggtccgattcttaaaacatccgtagctgccaaaaacttttttaactagacccgtctatgtgtcattatattgtttttttatgtctcttccttaaactgaagagataaatccctaaagtcacgaaatttcttaaagaaacatccttgtaaatgcatacagttccaaaatttcatgccatgggtcatcacaaccgcaaacatctctcctattagggattattgaggactcccaaagatcgggtttcaaaccttcacagaatttcgaaatgaacaacggttatgttattgcagaaacgtatagctttttttttttcttgaggaaaaaacgtatggatattcaaacaattgaacgcaagatgaaagccagatggggaatctcgtcaccagcgctgtgtacgagctatatatatggagatttttctgcacgttaacctcaatctcctcgaatcttttccacggctgaatgacttttttactcttgctgatcttcttcattgtttgtttcctcggtttcaccttttgcaagagcctatgtgctttcgggtggtgcgttatcctgttggttactgcgagtgtgacccactttgctttattttcccaattacagtgaagatgcacacatatcttaaattaaacgatactctcttcgtttcatattataagttgtttgacttttttcttagtcaaatttctttagatttgatcaagtttataaaaaaaaattagcaacatgtataatatcaaattagtttcattaaatttaacattgaatatatataaataatatgtttgtatcgcattgaaaatgttagtatattttttctacaaacttgattaaatttaaagaagtttgattaagaaaaaaatcaaatgacttatgatatgaaatggatagagcataagtgagaggcaaactttgatctcgttgaaaattctatggatatcgcgcctatgtgtatacttgacactactagtaatctcttcgatccgttgtcaaatacgttacaatctgagctcaaaattaatgttaactattgttataaaattattaggatttaatatatgaaaatgacattattagacttgtgaaaaaaattgatgcaattattatattttgatgtttttagtaatgtataattagaaaagtgattattaaacccatgttttagattcctttcgatgttgtaaacggcatctaaaatggcgtggctaatgggtgatcgctcgcttgcgatcgatccccatcccccctatacactccccttcccccttcctccttcctccttcctcctccccttcttctcttcctactacactataaatttttaaaaaataaaaaaaaataaagttaaaaaaaattatgtatagaaataatatatataaaaaatatttgattcaaattcaaatttgaaatgggtatgtaaacttttgacttataaactttgggtctataaactttaggtgtataaacttcagatgtatagaaatactatatataaaaaatatttaaattcaaattcaatttgaatcggatataaaaacttttgatttataaactttgggtctctaaactttagatgtgtaaacttgaggtgtacaaacttttggtgcataaatttactaaaataggaaagtaatatagtgccaaaaaaggaaaccacgtgaaggagagaggggcgacccgatcgctaggggtgatcgatcgcccattaggagtttcgcatctaaaaggaacataaataatgtggtatgtttgtgaaaacaaccctgttgactttattaatctctagtatgatatatttgtgaaaccaagcaaaaatatagtcctaggaaattattctattttacgaaactattccaccggtaccattcaaatatcaattagtcacggagatgaagtcatggagacattaaagctcataatgctggcctgattcaacgcccaaaaaaagtcacacatcgtttaatagaaacatatttcagttggttcaccgtaccggattattatcatggattatttgctccacctttctaaatatactttttttttaaaaaaaagtcttctactatattgtttggattagactacttgtacaatatttattaagtttatgtttcaaactatttaattcacgtacatattcagctagctagataatccacgacaataatcctatcaataatttgtttcgaacattaccttagaaaagattcttttattttggatggtgaggccaggatacacataagtcgaatggaaccgtagaaaatatgaccaaagcgtgctgtttcagaaaaaaaaaaacaaagaaaagaaaatatggccaaagcgaaggacaaccaggaccacactacaacaattcacaccatgctactctcttagtacaaaatacacgcatcttttcttgttagtagagattaaatttaaatgagaagtaattgatgagacagtgataagctaggaagaaatttaaatgagaagtaatcgatgagataaatagtagtagtacttagagcaagtttaatagtatagctaattactagcttcaattcatctatagtcaatctaatagatcattcatacaatagttacatactacactattaatacctggtcccacatgtcatacacacactgcgtcttgaagtccgtgctacagctggctataaatctgtagcccccctgctcttctctttcctcatttgtctccttaaaatatgtttggaactggcttatagcctgctattatacttgctcttaagaacaacactataaacatattttaatataactttcaaatgctacaaatgcttattttttagataataggtaaatcctatctttactttagcaggagctaaaagtgcttctgaatggagagagtaggtttttactgtttatatgcttatctcgaattctaagaagaagcgaccgacgagagtcttcctcgtctcaatcacaagtctccccatggctcaatcgtcaccaaaaactgatgcagagacaaaggattggtcgtcacgacaaatatgaatcaacagtggaatgaaaagacggacaatttttgtaccttgcaaaagtcttctcctgttgcaaatctttggtcgccagagataagtatcagctggtcctaatcttagcacgatcagtggtcacatgaacaacaaagactacacagccaacgacttgcagtacacgaacataggcgaccgcagtgaaagttgacctatagctaccatagaccaaacgcaccaataatatttatatattccaaggaatcaatcaaattaaagctctagattacattatatatatatatatatatatattatgtcattactcaccgcagttgcacgatcggccaccaatactagatactgctacgaaaacagttttcgcaagcggctgaaggcctaaaaacaagtgggcggaaatgtacatcattttcacgaacggtttcttagcaatacacgaaaacttattctcatatgtgcagttccttttaaccggtcatctacgaagttcgcacctgcattatgtcgttatctaaaagaaattcttgaaaattttaaatgatctgtgtggtaaagaaaaagggtagcgcatggttggttgagttagatgtcttatcagccatatagcttaaccaaaatcaacgattaagttcaagagctgtaaaaagaaaacttagagaaagtcttttgcacgacatatgttacatctaagaggtgacatgggcaaggttgttcgattaacgtcatcgtagactcgtagacttgtggtggcgtggttgcccgtgtcaatctcgatcgtacaatttttggcggaaagtagacagaaccggttggctaattcacgcgtgcgtccactttgtgccgtcctatacgcaggtaggaacatgctggtcttgatcaagtactctctctgttcccacgtataagtatttttaagatttaaattttgtacacactacataaatatttttgtaacactgaatccaacattttttatgggaatcaaacatttcagctaatcaggtgcttgaagaatctaaccaattcaaattttgaccaataaaatcactcaaagaaagtatttctctataaggttgcgtttgtgagggttggaaaccctttcccgatatgcaaagcatggcggtagattggcgcataattaattaaatattaaaaaaactgaaaaatagattgatttgattttaaagtatttcttctatataaatcttttagaaaaggaaaaagtatgaattaccccctgaattaccgcgatagtttaggggggtaattcgtactttttttccttttaaaaaatatattgtttaacggtgcacgcgaaaaataaaagagcagaagttgagaaagtgtccaaaggaacacaaccttaacgttaggcctatttttggtttgatggattcgtataggaaatcttaattcctttggaataaacactattcatgcattcggttcataggattccgatcaaaaatttcatatgtaaatcctatgccagtcctccaaaatggattgattccatgggaatgaaaacatccacttcatcctcttttgttaagctcattgaagcaaaaaatcatgtgttctaatcatttgttttgcacatacattcctacgctattcttgcaattttcatttttcttattcctgtaatttaaaactcctgtgaaccgaagaggctcttaatatttattaaacaaactaaaatacccatattaggacaacaccaattatgtttacgaaccagtaaacaatattggacccaagaaaagtagctaggcatatgtttttaaaagtttcacaatgtcttattagcaataaggtgagacccataataatataaagtttagcagcagccaataacacgaagggagacgggtgaggaccaatgcatagcaaataccaggttgtaatattattgtttaataaaagctatttactgatttcgcaatgcttattagtggataagtacacggtagaaggattaaattattgcccatagggggttttgggagcccatgtcctgtcacaagcaacttgaccaaactgtccggagattcgttttcgtgtggttcctggcttgtttaattttacattggtacatcttgagctgcccatattttctcaagtatctttggactggagcatatatataaacatactcgagcgtaaagatcttcgtggtcagaacatggatgagacgactcactttctgtcactggcaagcagctggtctcccctctgttatacttcatccgtccaaaaaataaaaatgtataatgtttaaagtttatctttaaaagagttgatttctaacttcttacctatcattaattagtccacagatccataagtattaaatgaaataagtattattcttttaatactctttatctatcctcctaacaataattttttttgatgagctatactttagtcttttttctcactcgctgctaaattctcttcaattggctctaaattaaagtgtttttggattgagggagtattacggagggacactctagttatggtagaacagtaaataaaatgcgatagctagatagcgctcccttgttaaaaagtatataagatatattttattttgttaagacataattaataaaatataattcttatgacagaattgattttattaggtttgtatttaaaatagtttattattataatttttatgacctagataaatggtaaagtagtaagacaactgcttctttcgtcataaaatataattatttttaggttgacacatatattaaagaagtagatgaaaattattagagaaatattgtgattggttgagaaaagaaaaggtagatgaagaaattaaatgaagaatggttatgattatgtgaaagaatagattgattttaaaataagtcaatacgctataaataactactccctccgtcccataaaaaaccaatctagtactggatgtgacacatcctagtataatgaatctggacacatccaattctagattcattttttttttacggagggagtatatttcgagactggagcagtattaatcaaagtcctgttcttgtttatgccattctggattggagggagtagcactatgggtgtgtttagttcacgccaaaattggaagtttgattgaaattgtaacaatgtgacgaaaaagttgaaagtttatgtgtgtaggaaagttttgatgtgattaaaaagttagaagtttgaagaaaaggttaggaactaaaccagacctttgtatccacgcgctcgacttttgagacaaatttgcactgagctcttttgctgtatcaataaatatgaaccatccatcacacatccaacgacccagagcattcgaaatgccatgcaccggtgctctctgccatagcagcaggcttacggcagaggatcccgatccaccagaccaatagttggggttccccttaccatttttccttttttgcgcggttaccgcaccccgcggtaaaggcggttaccgtgagacataccgtagtttcaaaaactaaaaagataaccgtgcgtggtaaccatggtaaccgcgtggtaactgcgcggtttggtaaaccctcgttgggacttgggaatcgagtaccgactactgagacatgcctttgtcaaaactagagaaaaaaaagacacggatgcacatcttatcatatgaataataatcaatgaaaacatgcacaatgtatagtggttggttgagctgaagctgattaaattttaggatttgattctaattaaatttagagggtattttttgttactttcttgcccctctgcattactcctaaggagcaaggacactacttaaaaaaagggttttttccctagcggttcaaaaacagttaggattaaaacaaaaccgtcaggactactttaccgtcacggccaccgtcaggaaagcgccgattggaacagcatgttaggaatgtggctttctccagagacaagtaaaatatctacataaaatatttttgaaaattagatttagaaacttcaaagtcagcatgtaacaaattatgttgttacatttcggatcttgcaaatgggctagcgaggaggagtagtttcactttcacccattagcatttaaacgtgtgctcgattagtgagctactccaatatagtggaaatatatatggtacttatattgaaaaaaatagaaaactaatgtaattttttagatgagaaaactaacgtaaattgtatatatatgtgagaacggcatgtagggctcaataggtctaccgtctaccggtcaatattaatgacacatacgtacagttaatgatatttttaaaattttatgatttttcaatggtccttatttttttttatttttatcaagaaacagtacctctaaaaatttaatgtacagaaagatgaaagaattagaatacgaatatatatcacatgatcaatatccatcacttcactttggccagtgagccagccagcgccctcattgccggacgtccatgcgaacagtatactttgaacgctattcttgcttgccagcagaggccagaaaaacgatatgctaacataaaggcttgagctggattttgcttagctcctcattctttcgtgtaccactctacaaaataagaataaaatcctagagatactcttatgtttgtgtaccactacaaatcaatggatttggatgataggaaagatcaagggatatgaccctcatagttttttctttcatgcgtaccagtaaataaactaagcggttttagatgatatgacattgtgatttaaagattttgaattttaaaaattagtagatgaactaaaaaaaatcttgagtggaggatttagaaaacaaactaaagggggacgtgggggaggtgctagttaattgtatgtatgcatacgtgtcttatataatgaaatatcggaaaaaagtggttgcatcttatatttgggatggagaagtatcacttattcttcatggcatgtacaagctatattatttttgaactatataaataatagttttattatatggtaaagaacttaagatcagttttgtaatatgctgcacaaaatagttttataatatggttaaagatcagtttttgtgattggaatctttactttggaatgtgcataatttatttacttttggtatacacaaatgggcaactgaaaaacatttctgaattgttttaggtaaataaactattttggacaattcaaatgcaatcgcatccgtgggttatgtatctgaattttaaaaaatattataaatttctgcaagaaacactagttacaaattgggcaaattacataatttggtccattgtgaaataaaatttaattttatcttaaaatatgattttattaagatttaagcacgtatatgtgcgacttgtgtgagccattttatagttatcaatttgttggtagtgccgaattatagactacttttttttactaccaatgtattttttttcacggtagagttgtatctattgtatttatttggtaaagtattgggggttttttttttttttttttttttttttttgcaaagcgaagtgaacactgttgaagaaatgaagttgtcagacaaggcaagtttcggcgtctctaccagtatcttaaaagcacggtcatgctcctttcctcctctccccaatcctacgtataaaaaatccactcaaaaaacctgtataaaaaaaaactaaccaatcgagagaaaaatatgcgataagagagaaaaaataaatcacgtttatgagatcttgtcccattgtaatgcataggcctatgactagtttttagatatggaattgctaaaaattgttgcaagtttttttttggaaaaaaatttcaaatgtaactatgatataattatagtgtaactaaaatgtaattacactacagttatattatattgtaagtgcattgtaatctctatataagttagatataagttgtaaatattattttaatacttatatacaagttatattataattataggggaattatattataattatactctctccgtccctaaatataagtgattttggttggatgtgacttgtaaccaaaatcccttagatagagggagtactatagtttgatttaaaagttttccctcaaaaaaaacttgcaacagttttttgagatagtccccaaatagcattactactgcttgtttagttgaaaaataaaattagaaatcccttgcgagccttagcctaagcatcaattaatggagatgcctgtagaggtagagttccattttgtactacttaggaacattaaccacaaatcgagcaagttgatcagtaaataatcgatgagcatgttggatgctttttatcttgaaagggttatgttgcatgcttttgtaaagtgccccttgtaagcatgtaaaatcctccatctaggataatagcgtgcgtatggccccatccaataaacgtgagccatctctttatttgttcctgccaagtgaagtggagctcccaaacaaaaggcagattggatggacggtgttcatttctgaaagtcgagatcagaatctgatggagccggttctttgatttctggcatctctggtcatgaggccctgcatgaaagtgggagcaatcagataaataaattaaagctaaatttgatactcccttctttcaaaagtgttagatatattacttttgtcatcaagactaaaaagaatttaactaatcctacgtgaaatacaatcaataaatattaagatgaatacttaggtttcggtcaatcatttaatttatctctttatttaaatcttgatgtacggaagttacaaacatgagtatatgaccaccttatttttttaaaaaaaaacagaaagtaaaataagtctaatagttgaatgggattggtgcagccaacaaatgcattaaataatcaaatcacggataatctgagtgaatctgaactttatacggggtaaaattgattttgtaggaatctgtgcatagaagaatctgtgccagtctggttagaacttagagcagatgcaatagcaggctataagccaactataaatatattttaaagagataaaagaagagagagaagagcagcgggctatagatctataaccagctgcagcacgaactccaagacgtaatgtgtgtatgacaggtgggaccagatattaatagtatagtaagcaactattatatgaattggttattatattgactatagatgatttggagctagcaatgtactatactattaaccttgctcttagaaccaatgagtaccaccatggctgcagaacggtcgagcgaaacggaattttttttatttttaattttttttattaaaagttttacaaaaataattttctattttgaaaattgacggaagtagtcgcctaccgccctctgggagggcgatttttaaaaatcgccctcccagagggcggcgaaaatgacgtggcagacggccgttcgctctcgggcgacggccgtcaacgaaatttgcaggcgggccccttgccgccctccgcgagggcgattttgtactgtgcggggggccgcctacaaatgggcggcgaggggggcatggaattttg

SEQ ID NO: 71668 - DNA, 2107 bp, Oryza sativa
gccagtcctccattggtttactggccaacaaactagcaattgtaatgatagctaatggcacaccacgacattttttcaaaattttgtcacatgcctcaactgatgggctatcaagacatttgccttcactgtcaactatcctggcatacaataatttttcacagtcatcacgagaaagtggctgcattttgtaaacatcaccaacatgtgtggcaacttcagaaatgcgagtggttgcgactactctacttccacacttacagtcttgcagagcgcatctgattaactcccatgatttcttatcccatatgtcatcaataacaatgaaacatctgtgcagccgcatgacagtgcaagagccatcaatttaataattgaaactagtagaaataacatattaaaacaagaaaagtggcaaccataaaaaaatatcataactactgaagctaaagaaagcattataactattgaaacttaagatcactcatataccaaaagtaaattgagaccagcattgggtgatcatcatattcttacctcattttctgaacaaaattctggagcttgtcgataagttgcctttcgtcaatatcatcacatcagaaactttgaagccaaaatcaatgagaatgtcccttaagactttctgtatgtcaggtactcgaccgactggaacaaaaaccccacaatcgaagtccggtttaagcttgtcatagactgctttggcgagagtggtcttgcccaatcctccgaatcccacaacggagacgatcttcatgttcctatcatccccaagggacagcatctttataaccttgtccactggcccatcaataccaacaagctctgttgatcttttgtacagagcctgtaggcgaggatcaatgctcgctggtcctgcaggcttggtgatgatgctatcaactgtgtatctagcacgccgggcttccacctcctggagtttcttgtcaatttctttgatcgcgccagcgatcttgcgacgatccttggtcctcttgaacagtctgctcatcttcttccggaggtgcctaagcacagaccggtcatcggtctcggagctgtcgatacgcaccaagaaggtgtcgacgatgtcctccatgtcataggacagctcccggacatcgcgtgcccagagcttcaccagctcatcaagctgctctggtgttacctcaccgactttgcggaggacggcgtgcacgctctcgagttcccgtgagagagacttgaccttctccttcatgcctgtctgcaggtcatactcgtccttgagcagctcacctagcttcgggagcaagctccccatcgcccctgtcaccagctccatgattcaagcttgatcaagcaggttgagttgatggataattgaacaatgctaatagtgtggtagtgtttttggtgttatcctctgctaattgtatggcagcttcctgtacctcatcttctcagacttctcaccccccccccccccctctcctttttcagtcacagccaagataaggatcttttaatgaaagaaatatttttttactcgaattttatatgaaatttcaactcgctccctaaaaagcacttcactcggttttatctgaacttcaaaactctcaaatctctaactcaatttcaactatcaagtaggagtatcaaccagaaacctgaagcatgtttagctctaatttctaacagcttccaactcaaacctcacaaagcccaactagactaatactagcagatcactttcacagtgagtgacaacaaaaatgtcccagctattggaagcccacaattccaactaggtaaaaaaaattttacagaaattccaaacgctcccatctaaagatcccaaatttcatcaaacaaaatcgcttgaaatgctaactcaagaggcccctagctaccttctgtcaaagggactcgtcattcatcgctaagcaatgagtctgtagccggagctgctccactccggcgattgagcagcggcgacggcggcgcatcggaaattgctccggcgactggatgcggcaatggtacttggagggggcggatcggcggaggaggagattggggggccacagaactacacaatagc

SEQ ID NO: 71669 - DNA, 519 bp, Oryza sativa
cccatgccgcctaatgggcacgtccgcccctggttatatgtcgttaatatctatagccgatcgagtagatttagtctaatcttatttattcatgactgtcaatcgatcccaatatgacatcggcttgatgataaatgatatgtcatcggcaattagccgatcggctatcgtttatggatttaaccgcggttttcttgtctttctttcttgttgattgtaggatcaaatcaattggcacgctcacaaatctaaaagcaagattttggacctgcacagaagttaagtagatctttcaggccagtgtgtgtttttcgcatcaacagtatgaaacattgagttttaaaggtttgaaacacatgtttttcttttaacataatattgtaaagatttaataaaaaacgaatacaaccgtgtgttaagattgaaatttggtaagccctaagagaattatcacatcgccaatagtcggatttctgctatatttggttaaggaaattaatctattaaaggaagcttatt

SEQ ID NO: 71670 - DNA, 18277 bp, Oryza sativa
agtccaagagaaaacaaagacaactggtcgcttttgtcgagatctcttcctcccccgttccgttttttttctctctcttttcaaactccgccccctcctctcctctttctctcccacatcagcagcagcggcggcggcggcggcagagcgaagagctccacttgtacgcacgggaatccaatccgctcgaagccctcgcgccgtggagtgcgtgccggccgggcaggggcagtgcggaggcccgcgcgcgggtagctggcgcctggcgctgcggcttttagcatctggtgctttgcgcgttcgctggaagctttgcggccaccgcggccagatgcggttgattgtgttgtagtggttgggtttttttgggttggaacgccgagtcgccgaggaggaggaggaggaggaggggaaggggaatggggttcctggtggggttggtgctggggatcgcggcgggcgtggctctcatagtgggcttcgcccgcgccgagaactcccgcgccgcccgccgccggcagctggtaagttatactactaattgcctagcccctctctttctccgtaataaatttgatttgtgtgatgtttagattggagcggtagcttcgaagttgataggagattaattgcgttgtttgtgaatcgagtggaaggcgaatcgcttaccttctaccgattgattgcgttgagctggatggtccctgcgttaggtagaggcgctgcactccccatgtcgactgcttttccattggagcgtatgactagtcaaaatggaaacatgttttgggcttattgagctttcaatttacgaacatgatgatgcggtttgctacaaacaaagtttgttggagttggaaagcactcatgttagggggctcaagttgcagcggaggcctcaaattgtgggggcaagtgcaagcgcttctaataaacaacctagcatgcatagtgcaatgttgggctagaaggccggtgttcatttgatccgtgttgccactattctatttgatgcctattcttgtgccatggctgctggcatgctaaaattcatggctgctccctgctactgactcactgcgcttatggcattttgtttaggccagttgtccatatatgattgcttgcatgctactctgtaaatttagatagctttgatctctgatctttttcctcctgattaataaatgaaactaaaaggggattctccttgtttgtttggacaggctgccacaattgctagtttctccaagatgactattgaagattcacggaagttactcccagctgacctgtacccttcctgggttgttttctcaacacagcaaaaggtatttgacagtatttagttagctctcaattttcatgcttacacactagatgtgaatgagagtatatgctaatgggggcaattttgcagttaaaatggctcaatcaagagctgataaaaatatggccatttgtgaacgcggtatgcattcctttccatgggagactagaattaggatttgacttcttttacaaatatgcttttcttcaatgtcttcttctcttgtcaattgttgtcgcaggcagcatcagaactgatcaaaacctccgtggagcctgttcttgaacaatatcgaccaataatcttagcttctctcaagttctcaaaactcactcttggtactgttgcaccacagtttactggtaagaagctattatatatcattgactgtttctcattatattcttgacagcactgagctatattgttctgctttctctactgtatttttgttagacaaagtaaatcaacttaattttgcatgcattaaccaagagtacaatgactgaatagctgacaataaccaccgctgtctggtgtcagcagcttgtggatattagattgtacatggtgtttgatgaaatgttcagaatcatgaaaacttaaaagggttttgatttttgtggttgcaagcgtgagccctgtgtttagatgaataatagtgtgtaattcattattaagaattgcatcctttggaaaatgatgccgtgtatgtattctttaaacaatactaatttatgctaatgtacttattttatgaggagtttaatgcgctcgcttcattatgttgtttgttttttttagaatggttttaattctttttcttttctacctaatgacaccaaatatttggtatacattttatattttgctaccatattagatttttctgttggttttggtgcaggtgtttcgatcattgagaatgacgaatcaggcattgtcatggaactagagatgaattgggatgccaatccaagtatcatactagacgtaaaaactagacttggcgtgtcacttccaatacaggtgatttatttcatgttgcttgttgtcctgtgttatgaatactgacgaggaggcactgaggcatttacatagtgaactagacctagttcacaaggtttgacagtaggctttgtctattggaacactgaattggtgttcttgataactaatgattaagtggacagttctggcaaaaaagaacatgaattcaagttgcaactaactttggtgcagttgatcttagttaataatccaattttgtgggggtatgtaattcttcatgcagtttttatgtgacatcatgagtagtgtgatggtctgattggatagtgatactgtagatattatctttttattataattgtgctatgtatttcatacacttaaattaattattctttctataataatcttgtgagtgccttttgccatataggtgaaagatattggctttacaggagttttccgcttgatcttcaagccacttgttgatcagttgccctgctttggagcagtttgcttttctctacgaaagaaggttccttttcttggtcgtgttttttattaaaaaaaaatctggttgaaggtattttctcattaatctgatatttttttctcaaatcacttcagaaaaagctggatttcagactgaaggtcattggtggtgaaatttctgctatacctgggatttcggatgctcttgaggtttgaccatacttctctgttttgttgctataaaagtttagtttgcatttcctacagtcaagatggtgactggaacatctcgtgttacaggacacaataaaaaatgctatagaagactcaataacatggcctgtaaggaaagtcattcctataatacctggggactacaggtaattactggtgatttctggggacatactagttttattctcttgactgaataatatcattgtcattacttactatatcaacatatgaatacaaaaatggataaatcccataaattattgtgtgcaacagtgatttggaactaaagcctgttggtacattggaagtcaagctagtacaagcgagggatttgacgaacaaagatctgataggaaaatctgacccttttgcaattgtgtatgtacgacccttgccagataaaatgaagagaagtaaaacaattgtaagtatcagctactctattccctgtttatgtgctccaatagatatgtatattttttaatgcatactgacagctgtttatgtgcttcaaatttacagaacaacgacttgaaccctatctggaatgaacactttgagtttattgttgaagatgcagatactcagactgtgacagtgaagatttatgatgatgatggtattcaggaatctgaattgattggctgtgctcaagttactctgaaggatctacagccaggcaaagtgaaggatgtctggttgaagcttgtaaaagacttggagattcaaagggaccggaaagatcggggtcaggtgagccctgttttcttggcagtgccactctccattttctgtttctctaacacagtaaaatagctcgatcttcttatattgttattcatccagggttgtaaatacatagtatttctcttgtttgaatatcacctcaacaggtgcatcttgagctactctactgcccatttgacatgaaggaggagactccaaatccttttagacagcagttttctatgacatccttggagaggacaatgacgagcatggaaaatgggtcagggagcaatggttttaacaggttgtcttccaggaagaaaaaagaaatcattatgcggggagttttgtcagtaactgtgatatctggggaagatctgccagcaatggatatgaatggaaagtctgacccatatgttgtactttcactcaagaaatcaaaaaccaagtacaagacaagggtaatttattcatcatatatggacaaactactggtcacaaataaccattacatactcctaacagttattagtattacgctatatttaacataattgctcctatcatgtgtctgaccgcaggttgtgagcgaaagcttgaatccagtttggaaccaaacttttgattttgttgtcgaagatggtttacatgatatgcttatgttggaagtatatgatcatgatacttttagtagagtaagttcaattgaagtttttatctcattactggacgagtggcttgttcaactgcagacgtttgtgataacgactgacaccaaggcactgaatatgtttctgtaggattacatgggacggtgcatcctaacattaacgaaggtcttgatcgaagaagattacaaggacagcttcaaactggagggagcaaagtccgggaaactgaacttgcatctgaagtggtcgccgcaaccaatcttccgtgattcgcgagaagaggacagcttaagattcagatgagttttgtatgcgcggagagtcatagatgcgtgtgggcatctggtttctgcgggccggatgtgatgagggtttcctcctgaaaacctgatgagttcagtcatctcttttttgcggtgcaatttgatcatccgctgcacatatacatggaagaagagttatggtgttgatcagctagcttataatgtaattgtcaaacaacatttatgtgtttacttgcaatgtatgctcaaagcacatttatgtacatgtgaaaaatatataatttgagctgttggagtgagctgttgaagacaattgaaggtgtcatattttttagtgtaaaacttgttatcttcatatactagttacctctaaattttttatagattaaaatacatggccggtccttaaacttgtggagcgatctcactcagatccgtaaacttaaaaaatacacgtttaggtccatgatctcgttttaatgtaccatcctaggtccaatccgcgcgtgacagcgtctgaccgccaacgtggcgtgccacgcaggcagtatatttgcattctcccccctccgcaaaatgtaggcattaatatcatccctaaacaccaccatgtgacgaaacgatccataacaaagtagtcttcaaatgtgaaatatgcagtaccattgtgtggaattacagatagcgcagtagcaaactagcagcctcggaggcttgatttaaaatgcagcaaagaatgttgatcgaagatagctcaagtgcctttgattaaaacaacatgacagactacattgttgatttagtagttgctcacacttctgtagaacattctgtagaacaaaaccaactcggaatttcaataagaaaccaaaaaacaagacgattcatattgctttgctgtcttacagggtctgtgtcaggttccagaaatcatctctcttaggccaggaataagaatagtatcaaacagtgatgttattagatgacatttcaagcctggcaagcacattttttgacagaaacaaacacagtccatggttcaaattcagtacatgacaaacacagccccgtcgacgcgcctcgcggagcccagcgccacgccgccacgaaccagagccctgccgcccccgccgcgccgacgcccctcgcggaggcgcgcggcgcgccgcctatcccggagccccgccgcccccgccgcgtcgacgcccctcgtggagcccagctccgcgccgcctctcccggagtcgtcgaggtcgccctctctccctgggaagtggacagagggcatttaggtttggggatttttggggatttaggtttgcgacagagggatttaggaggggggagaatgcaaatgtactgcagtcagacctggtcaagcgcggattgaacctgagatggtacattaaaacgagatcgtggatctaaacatgcattctctaagtttacagatataagtaagaccgctctacatgtactttcttttaggatcgtaaaatttctgaagaaatagcatacaggaaatctgtgaatgctgtcgtcagacgtaagaactaacgacataagacgaacccattgtgtacgccgcctcatcgtgttactcccgtcatgccgattcggcatgaaaaaaatctgcagcatagatccgtgcctccaacgagaatcatgcacgaaacatgaaaatctccaacgaagacatcgttgtagtaccaagcatggagtattctgtaacatttctgaaactctgaaagctacggctgatataaaatatgcaggagtaaagatttctaggtcaggacacgagccgcacgagcatcccggggtttcctaccttgggcagattcgcttcaggtttggacgataccaacagagcatcatcgtgtgcttcatccagcgcccaataaaaccaagctccgagccccacgggtagaggcacgctcctcccggctaaaaaaatcaggcacaaaacatatgcttctttcttttttgttttgttaatcacgcagatgattctcttcacctggctttgttaattgatcagtaatgcgcacgacgtcgcaatctggtaaagctttgacagcattcatgatcccagccagctttaacaatggcacataatggaaaagacgtgcttcttaagggaatcgaattacagaattaataccatcagatttagatacccaaattaaggtggtccttttcttatattttacctcaggctagctatttgctagctatgcctaaatgtactaacttattatttttatgcgtcaaatctgattttgtcatgatgcaagcgacatcgttatgtttcttgcttttaataacatctgaatcgacgggctttgtatttttcttatgaatcacagcttgttaaacagtataatgtggtactctagtgtcacgccgattgaaccagcacatctgcctgccccgtactaatatgacatatcggcatgcgtacatacatgctatacagactgttcatcgtctgtcaattgcttgcaccctttagagatagatagcagtagcaggtgtatttttgtttcgaagtctacaagctgccacacgtattagtgaagcagtttccggcacaaaaacaacttttagcttgtgtctatatgtgtttaactttaacccatcaatctactggactcttcctggctttgttgtcatctactccaaccggagtgacaccttgctggtagtacacaaatcgcagtactgacaatgtgatactagctagcttgaggtgtccagaaatattccagactgcgtatatgcgtgtaggaaaccaaaactgtactgcgtctcgatctcaggctcatgcagtccacgttttcaatccatccaggtatgttcacgctaaaattaaaagtttggttcaaattgaaacgatgtgatggaaaagttaggagtttgtgtgtgtaaaaaagttttgatgtgatggaaaagttaaaaatttaaagaaaaattttggatccaaactcggcccaacttaccatcaggcaagtccttcggtaattgatttccaaggagaaatcgcccgaaggtctcaagagctagagaggacaatttcacgatggacgtcagtcagttaaccatcgacaacgcaccacattctctgaacatggcaagcaattttacgccctactgaaattccactgaggtaccaacgggggtaggatctctgacttcttctcatgttcacctccgtccatgtcccaatcgggtctgaatgatttctccaggctaataattaacctcaccatggatatcctatcaccaaactgaattatcacgttagctaagaaacctactatgaccaagagaacgtgctccgaatcacaaaagaactctacacaaaccatataaccgtcctaaaatatagcactatattatcaatattttttaatgtagattcgtagtgctatactgcgttaaactctggttttatattgttacattttgttgctagacgcactgacaaacagaaggagagaatagtggccagaagcgtcagagctaggcgcctcggatcggccggtgaatcgaacagctccggccctggcttagccgtgagccatctggccttccctcctctcctgccgctgcaggagacagacagagagagagagagagagaggtgagccctcgcgtcacgtaccccacagccgcgcttgtcgccgtgctccgctctctcgtgaccgtcgaatggtagccgctactgcaatgcaacctgtgcagcagcctgtatcacacagcttttcttttgttgtcattagtcattaccaagccagagttttctttctgtacttggggtggagtaagctgagccgttgattgagccgtgcaggacaccggaaagcgtgatacgtagcgtgttggtttggaccccacctgtccgcgacacgaaacgtggggccccgtgcggcggacgctatcggtggtgaggcaggagaacgagaggccgggatcgcacgaaaatccgtgggtttcagatgagcgccctcgcacgccgcacatcctatatcctctccctctcctccccaaccccaacctcgcgcttcactttccaacgagcgaagccgtcgtcgaggcgtccgtctcctcctcctccttctcctactgctgctgctgctgcttaaacccctcagggctccgggccgacgctccatttgtggctgttgggtttggagcttcaggcgcaatggcccccaagggcgccggccgtggcaagggcaggggcggcggcggcggcggcaaaggcgacaagaggaagaaggaagagaaaggtattgtgtagtacatgttgctggaagctcgataccgcttgagctctgcaaaggcatagagttcacttcatggcatgaagctgtgtagctgttgcagtgtgaggagctttgttcttgcgaacattgaattcgctgctgctgctgctgcagctgtaatctgtgtgtgtatgctgttcaggacatgggttcttttgcatgggtaaagggtgaaaaaaagacgatggtctctctgctattagtagcggtaatcttttctttattccttcttttgcttttgtttctcttccttttttcttgcctattcgtactcctgatttcggtgattatattgctgtttaagcgcttttttcttggtgtttagcttcgtgttctgtgctcatgattattactactagtcttttgtcttttttttttttgcaccttctcttgttccattaatccttttcgttcgcttccaagcaacatggcccgattctttccttggtgtaacgcacaccgtcgtgcggttgagtcatgcgttctgcgagctctagatgaatactctgttttcactttcacctcgacatgatgtcgccgtctccgtttttaaggtttttttctgcagctgttggtatgatgctgggttcttcttgtttttgcagttgtgccgagtgccatagacgtcacggttgtcactccctatgaatcccaggttacactcaaggtatgtgtggctgcattagctggctggtacttgctgcacacatgaacacacaaaatacctgaaaggacaatggacaggacaagcaaaagtgaacagaaactggtatctttgggaaaagggggcctaattctgataactgaaatgtctgcagctatttgcaatgagctgcaaagccagttattacttactccacactgcatgctcacaatgagtccgggaaattgagcctttgaaatggaacagtgaacctgagtgaaaagattaatcttgtttttgttctgtgtgtgttcaggggatatctacggaccgtgttctggacgtgaggaagctgctgggctcgaatgtggagacgtgccacctgacaaactactcgctctcgcacgtggtaatgcttgcttcttgtctgctaattcaatcaattgcagtgcttgcagtatctactgataattcaattgcagtgctagtactagcatctatcattccactcttaagtcaaagtgttaattactacttaattatctgccacttctttgctactcttctggaattcacccgggattaatttgaggacagtaacttttaatgtatgtgtgctgcaatgctgttaattctgtaactaattctgtataagctgtgttcggtgaagtctgaatttgtgaagcgtgtgatgtatgacgcagacgcgagggcagcggctggaggacggcgtggaaatcgtgtcgctgaaaccatgctctctcaccatcgtggaaggtacggtccatggtgaaagaatccgcacgctagctgctcttcacttgttcttccttgctcgttttgtttctttctcctttctttttttttcgcttggcaacatggaatgcttcacataacatgatcgaggtggggtagctggcattaggacacataattagttggatgcttaagtagacgaagcaacctgacgagaggacaaaattaagcttgagcttgtggtgtaccgtgtggcacaatctgttagcatgacagtgttatgctacagtccaagtgtccaaacagtctgccatcaatgattaatcaaccaacggtccggatttttccactgaaagctctaaagtctgacgctaatattgctaatattagggaagaacctaatatcaaataattagaaggggtgaggcttcaaatctaggtcgtctagtccaccatcttgtggagctagctggaagacccctaagtgtttctcataagctctaaagtctgaacatgcgtttgccgttgtccgatggtgaagctagtggtttttgttaatgttgactcaccggtagatcatatcaaacctaacttcaaaaatcataatctattcaaattgggacggcacaatgcacatagatgcagccttgtttgtcgacgcacagcattgaatcgaagagcatggaccgcgccggcctttcggctgaataaacttcagaagaaaaaaacacacacatatgactagatcactagattcgcatgctaaggtgcaacctcccacgactccttgtaaatgcagtcatgcgcctccatcacgccccaatactggcacaccagtgagttagataggagcacagagtacaatctagttcattatacttcataattcttgccacttagacagcgagacgtgcaggcaggcagcagcagcagctttgcatagtgcctccagtttcagacattagaagcagcgcatcctgtttcagacacttagcataaaattgtttagaccaaaaaaaatgtgatttacatctcgggtctctaccgttatcctcagatactagcagcaaatggtagccggtttcagtgccgcatctgtagccgatgggagatatagatcgtggccgtgacgtcgtcgcgcgatctgcctctccgcggttggttggggcggggcggctaaggtgttttttccacacacacacacatgtcccgtctctttcgctgccgatgtcgcatttgccgtcgccgcgcgaacgtttcacggcggctttgccagtttccgggaggaaggaggcggcggttgaaccgaacctggacgcccccgcgcgcacgccggctaataagctgaggccctgtttagatgggactaaaacacttttaaaaacacttttaagttcctatcacatcggatgtgtactaattataaatattaaatgtaactattaataaaatctatccataatcttggactaattcgcgagacgaatctatttgagcctaattaatccatgattagcctatgtgatgctacagtaaatattctctaattatggattaattaggcttaaaaaatttgtctcgcgaattagctttcatttatgtaattagttttgtaagtagtctatatttaatactctaaattagtgtctaaagatcagatatggactaaagttaagtccctggatccaaacactcgctgacggatgccggtgatgtttcgtatggttttttttcaacgaaacgtgtggcagcgatggtcgtggcatgcgaccatgtgtctgtgtcgacgacgaaaacgagcatagaacttaacgattgattagtgcgtaagactgtacgaggaaggggatgactgaccgattggtctgacacgcgctcgtagtcaaatgcacttgcttttactgctaccgtagtccatcattttaaaaaaaaaaacctgaaattcaagtgcaaagtggcatttggacaaactggaagggcattttcactcgttgatagcgcttgattagttgcctaggcgaagtccgtcttgtgcacttctctagtgggtcagagcctcttgttctgctttgggaaatacatgctcgttaattaactgaacatagtgctccacctgctgtctgtctcatatggtatttagaactgaaagctatactagtgtacaattaattactgcagaattatgcgattttgtagttgttgtatgctccaaggtctgagctaatggctcaccggttgttgtcctgtcctaaacgccggtacgggacaaaaggacgcctcttggaatcagcgttgggcgttagctcaagtgcctaacttattttactcgccactcttctgacgaatcgacgggtttgtgaattgtgattgtacatttgtttgtagtattggtgtttaggtggtcactgactcatactggtcagtacagtacgtgctagacctgctaccggtcgtaccgatgccatgagtcaaaatcacgttgttggccatgtgtttctaactcgctgacaccgctgggaacgtgatagaatagcgacatagcggtgatagtacttactactatgacacgagtatcaaaacttcagccacgttcctgtggatgaacatcagtcttaagccattttttttttatttttacatttgaattcgatttattctattttgatttgattcgacgacttttgttcaatatgatgcagcagctgctaaaaaaacaaaagaaattgcttcgcttatttgttccagaattgatgggcctgttcatttataaagggaagcccagcacttggcctattgggcctgaattttggtagagctaatcgagcccatgggcctttttgtgcagaggagtacgcgacggaggcggcggcggcggcgcaagtccggcggctgctggacatcgtcgcctgcaccaccgcgttcgtgaacaagccccgcgacggcgccaagcacaagtcgtccaagcacgcgcgcccggcgacgccgccgtcaccgcccgcgctcgccgcctcccccgacgcccatggcgccggcgccgcccaggcgccgccgatatcggaggcgcacgacatggcggccatccgtccgccgcccaggctgggcgagttctacgacttcctctccttcgcccacctcaccccgcccgtccactgtaaggccgaatgctgcatcgcgtttccccctttttgcgaggcgtggaactaggggttggactgacgcgtggttgcggtgtgcagttatcaggaggaaggagagcaatggcgcttctcaggaaggcgactacttcgaaatcgaggtgtgatgcgatgtctctcagaacgctagagagttcgtctgatctgcagtagccaactccgcgatgagtctatgactacgcacttcactgacgggagttgatgtgtggccaggtgaaagtttgcaatgggaagctcctgcacatcgttgcttccgtcaagggcttctattcggcagggaagccgcacaccgtgagccactccttggtggatctgttgcaacagctcagcagtgcatttgccaatgtgagtaaccatgaatcctgaacatgtataatgtataacgcgttgctcgatttactttctgctcctgtttgtttttggctaactatacagccgaccttatctgacagtgatgtcttctaattcattttgcacaggcatatgatgcactgatgaaagcttttctggatcacaacaaggtggttatagtaaatgctgtttcctttttttttttcccccttataccgtagatttagtcaagtaaaatgctaaatttgacaaggatacttctttgcatctccagtttgggaatctaccatacggatttcgtgcaaacacatggcttattcctcctatatacttggattctgctacaaagtgcccagcattaccagttgaggatgagaattggggtggaaacgggggtggcaatgggcgagatggaaagtatgacagaagacgatgggcaaaagaattttctactttggctagaatgccatgcaaaactgaggaagggagggtgatcagagaccggaaggcttttcttttacacaatctctttgtagatacagcaatttttagagctgcatcaacaatacagagactcattgatctgtctgggaactcaactagtcaacaagctggcctagatggttctttagcaatcgaggaacgtgttggtgacttgcttataactgtaaagagggatcaggctgatgctagtttaaagctggaggataaagttgatggagttgcactctatcaaaccggttctatggatatatcacaaagaaatcttctaaaaggtttaacttctgatgaaagtgtcgttgttaaggtggtggcatactactttcatatctctttttttttcaaattattttttgtccttaatattaattaccgatttccaccaacatgattaccattcaggacacctcaatactcggagtggttattgttaaacattgtggatatacagcaacagtgaaggtttcagggcgcacaaaggacggaaatggtggcaaacaaaccagtgatatctgtgatcatctcgatggaatttcgaatgttgatgtagatgatttgccagatggaggttctaatgccttgaacattaacaggtttgatatatgttcccatgtaaacttattcacatgcttgctcatcagtagagaaaataatgttcactggtaactagtttttcttacatttggcacacaataatgttccattaacacaactctctctctctctctctctctgtatatgtgtgtttcagtctaagaatatcactgccaaaaattgtcaactcagacatcgctagtactcagtgtcctactccgcagtctcatgttgataatcatgcaaggaaactagtgcgcaaaatacttgaagatagcttgatgaagctggagaacatgcctgccaataatcctagaaccatcagatgggaacttgggtcatcctggctgcaaaacttgcagaaaaaggattcgccggcatctgaggacaagaaaaatgcaggacatgttgaaaaagagacaactatcaaaggtcttggtaagcactttgaacagctaaagaaaattaaaaagaaagaatgccatgttgaaggtgctatgtctgagaaggaagactctgacagtaactgctctgtcataaatggcatggaagaatctgaaaacaccaaggagactgatattagcaagctgatgtcagaggatgatttctgtcgccttaaggatctgggagctggacttcatcaaaaggtaatttatagctatacagttcatcaatcaatatggtctgaacaatttagttttatgtccggtaagctcatacatgctattttgcttgggattaaagttctaatctgttaaaattttcaccagaagccttgtgttaagctgaatatgatgtagtagcagaagcgcagcattgtatttttccagtaatcaggaatatattggttattttgctgtttaatacttaactttgttatttcttgaactagtcccttgaagagctcactatgatggcccataaattctatgatgatactgcgcttccaaagctggtaagccttgccttgtttatttggagatccttatgtaaattctcgaacattttaatcggcactctcttctctgaaaacaaagtagtcgctttttgctggcattggtattgtttattgtttattgttgtagtaagtagtttagttatggtactaatgttcagttagttcatttgtaattttgaggaagtagtcaatccacattaacaattcgcaccacaaagtccaaaagaattacagttcttgaaaatttttgcgtgtaaagaagaaaaaaaaaacaatgttttttttatgttgtcttaaactttcttaattattatttgatgcccataatagatagttaattttttcttggaataaaataatgacaggtggctgattttgcttcccttgaactttctcctgtggatggaagaaccatgaccgatttcatgcacacaaggggtcttaatatgtgctccttaggccgtgtggtgagtttaaatttattctgaattacttttgcttctatggttggatggaatttccagaataaccttttttttatatataaattaaacaggtagagctcgcggagaagcttccacatatccagtcaatttgcatccatgaaatggtcattaggtcctttaagcacattgttcgagctgttattgcagctgttgatgacatgcaaaatatgtctgcagctattgctgagactttaaacattttacttggatgcccaagacttgaaagtggcactgaaacagatgcacatagtgaacataatttgagatttagatgggtagagaggttcctttctaaaaggtacaattggaaattgaaagatgaatttgcacacttgcggaaatttatcattctgagaggtctttgcagtaaggtacaatccaaagtgtgttccaaaacattcatagagtacagtttctgaacatgcataattaatatgtttatttctcaggttggacttgagttggttgcgagagattatgatatgaatagcccaaatccatttgacaaatctgacatagttaacattattcctgtatgcaaggtaggacactatcagaaaacttaccactgtactttccccaccacctgaattaataattatattgatttgatctgctttggccttgcgcttcttacagcatgtggtgtactcttctattgatggtcgaaacttattagaatcatcaaagatggctttggataaaggaaaacttgatgatgccgtcaacttcggaacaaaggtatgcaataatcagttcttttttctgtacgttgtttaacagctatgctaaaatatttctcttcctgctttggttgggtgaagttaccattctaaattctttcattaactatttttttttcttttcttgaaggcgttgtccaaaattgtagcagtttgtggtccataccatcggctgactgctaatgcgtacagtcttcttgctgtagttctttaccatactggagattttaatcaggtatttcaatgaatttggtgggctgtattctatctgctgcatagtgatgtgtttttggcacaatgtttggcaactgcatttttcactagacttctgttctttctctgtaggcaactatatatcagcagaaggcacttgatatcaatgaaagagagctaggtcttgaccacccagaaactatgaagagttacggggatttatctgtcttctactaccgtctccagcacatcgaaatggctctaaagtaagtgctgctattaggtgttttgttgtggaaacacaaaagctagtttcatgacttggcttgtagctggtattactatcatgcacaatgtcgttacgctggttcatttctagccattacatgcattaaatatattgcctgtagaatggatactactgcatttgtacggcactatggctgtattaatttgtagacttgaactgtgcattgttttgcattattgtccatgattgttacttgtggtttgcacggaaacttgctgaaggcacatatttgcttgacaatattgtcaaaactcatcttccatctttctttttttgccttttgttttttgtatcgctaatggtatctttttcttaaaggtatgtcaaccgtgcactatatctactccaattttctgtgggctttacatccaaattcagctgccacatacataaatgtggctatgaggaagaggtatggaaagt

SEQ ID NO: 71671 - DNA, 37909 bp, Oryza sativa
cattgctgtccctcaaaggccatgagcaattgtttaagtttctttcaatttcctatccaacttgtttattgcatatccaatttcaaaactagcatcttgtttcagtagtacccgcgccaccatgacttgtatcttttaaggaaaggtttattttgatgtctagacccacagaaacagtcttttctgtatatttcaatccgtttgacataatgcatgtaactacggacaacttcaatggcgtatttgttatgcatatgatcccgtgattcagttaacatgaattttcatgcatttctttgaacaacagactgctgcgagctatcatgccatagccatagccctctcaatgatggatgcatactccttgagtgttcagcatgaacagaccaccttacagatacttcaggagaaactaggacaagatgaccttcgaactcaggttttttttcccttcaaaatatgcaatgacgagtccaaatactgctatgttctcttggactattagacatgataattttcctgctgcaggatgctgctgcatggcttgagtattttgagtcaaaagcattagaacaacaagaggccgcccgaaggggcatcccaaaacctgactcatctattgcaagcaaaggacatcttaggtatgaatacactgtgcattatcagtcgcaaactgtgatgatctggattgaaacatttatctttccagtgtatcagatctacttgactacataagcccggatcaggaaagaaaagagagggatacacaaagaaagggcaggcgtgcaaaggtgattataacatgcctactttttcaaaattattgttgttaaaatgtagtcagaagagataagtgcacactggacagtggagacaattccatcagtattcatgaaaagtctagatgagaataggattggcacaataacttccatataggatgtctggtatatgaactgatgaacatatgctggcagcaaatcagcaatcctatccagttcatgaaactagtaaaaggttatgaaccatcatcactgacataataaccatgacagttatccccaccagtcattgttggagcatgaactatgagaattgaaaagatattcccgcatccacagctagtccattgataccaggcatttatccagatgattccagttcaacccattaacttagcaatgaattgacaacacaatttcttcttagttgggaatttaactccctttacatatggatatttaatcctttgttttctaatatgcttcatgaattgggaatcacaatatacatattttggaagtccattgatgtcatggtttcaattgttgcctaaacattatgcaagcttttattttacccttactaccctttgctttccttttcaccttgtatagtattaaatgcagaataatatcagagcccatcaaggtgaattagttgaagaaaaggagagctttgagcacgacataggatctcctcatgaagcaaacaaagaggagtttcaacaagtaaaatcgaaggcacaccctccagcaatatcagaagaaaattatgctatccatgatgagctgaagcaagttgatcctttatcacctgaagaatattctgatgaagggtggcaagcagctaatttgcgtggacgatctgcaaatgtacggaagaaaagcagtcgcagaaggcccgctctcactaaattaatggttgatcgcttggaagatggccgcacaggttctgcttatagggctggtgtacaacaacacatgaaaggagataaagaagatgttataaactcttctagccagctctcctttggcagctttctaaaaactgacaaggtgaatgggaattccagcaatattgaaaataaggttttcaatgctatatctaaaccagaacgaggcataaagctttcaggaattaacagacctgctactatagcttccaagttggtatcatacaaagatgtagcagtgtcaccccctggcacagtcttgaaaccgattttggagcagaaggaagcaaaggagaaggataatgcacaaaatactgatctaatagtgtcatctgaggaggaagataagaagttaacagatgaagatgaagaaaaggaaaagccaagtcatgacagcagcaaagaggttctttcaagtgaaccagaggaaatcggcaatgatgaaaaagctccggacagcaacagtgatgaaagcccaactgaatctaagaaaaaaggtggaagcaagctttcagcttcagcgcctccattcaatcctggatcactcttatcgatgtcgcacccttacagtacagtggcaatatatgatgctagcgtcgttcttcagccaataccaagtcaaccaatggagattctccctcacgccattgatactagggtaccccgtggtcctcggtccacattgtactaccgtactgggcataccttccaaagaaaacagggttacgcacacagccagagcaccattctgaggggtagcaactcccccccaaccatgaatcctcatgctgccgagtttgtgcctggaaaaacttcgcaacaacctgatgtggctaacagagagcctagtgcagatgtttctgtaactgattcagcagatcaactgttggcaccacagacatcagatgaagtaaaggctggtatgcctgcagcagaacaagcaattcaaggtgagagcaccagcccatgcaaaggaaaggaaaacagagcgaaagatgccttgagaaactcatgcaaaacagagctggcaaggcagattttgttcagtttcatcgtcaagtcagtacatgatagcttaggttccactggagctgaatcggacagaaaaccaagtggaccagacgaatctggtaatgcacagagcagcaacaacataaacaagagtccgtcaggtcgcaaagagcttgacaaacagcagaaggccaccgtggtacctaagagtgagaaggatacagaaggatttacagtagtttcaaaacgtagaagaagcaagcagcactttgtgcatcccatacatggtctctattcccagcagtcaatttgcacttctgtcagctaaaggtcccggtagatctctttttgggagtcgccatattttggaagaaaggtatcgcttaattacttagcttagacgcttggtagcaaaagtcttaccctatccagatgatcgagagcatgtagtgaaactgtacaaagctttccgcaatgtcttttgtgtaataaattttgtaattttggggtagcagccgcatcagcgctgaataaaatatatttgtgtcatgtgtagttatatctgtgacagaatcatataggatatagcagcagatgtttcagtgtagagctcctttttattactctatccgtttcaaaatatagtgatttttagagtagacccggattttaggaaagtatatgaaattaaatgagaaaaaattgaacctgcaatattttgagataaattttaaatattataagtggctatattttttagatttagggagtagccgctattctttatgatgtgcactagccgaattgtctgccataaggacttgatgactgcaattactagtactaggagtaaactcaaagctgactcgagtcattttctatattgactttctctgcttaaactatgatcagctcagtgtggtgtggtctttggatgctttttcacagttaatttagcttccacggagcagagacggagcagagtcagcagcagaccagacgtgaattggtttacagttagtaagctgtagcaattgcacctgtaccactaccatactctcattctctttaactctcgttacgaggtcaactcggcagctagatggcagcagcagcatatgcatccattcacctcctggccaatagctagctcagccattagtccataaccccattacattactactctcctcctgcttcccttgcgtaccacggcccatgccgtgccatgcatggcacattatgcagcatgcgacgcattcatatcctcccgtcttgctcgcttcatccacctctgaatttctgcatcgtggatgcagcagaatcagagatacccccctgcatgctgccccttgctatgctacgcatgatgctgtattgctgtgccatgctagctataccagctgcaagcctgcactacagcttgcagagactttttatttatggcgttggagtcagattcagaagaggatcagaggacggcatggcattggcatggcatggtgcagcatgaacgtgtgtctgaagtctgaactcctaattaatagttgtagctagcatttcggagctgtgtagttaatttcatctactatagctatagctaagtcacgggattccggttgggacgacgacgcaacgcaagcaacgagagagatacatatacacactcctgtcctgaagccggccgggtctctgtactgattgatccatcagaagtgtgacaagaaatgtggtatttattgcaggttgtgcatgcacatcagagctagctttgggctctgcttcgcttgcctcccatggcggccccgccggtgtgtgtacgtgtgcacgcgtgggctcggacttacgcctgcttacgtgcgagatcagatacggatcagcttattcattcaaactggtctcctgattgtatgcgtttttcctgaataatggaaagtataacttccagcttttgtgttagtaagtagttaaccgttaatttttaactcttggatgctcctattacacatcgacttttgagagagaaaagttagggttttaatcctagttcgtgagttgagagaggagtgctttaggtgcactttgtaaacacatattgatacaataaagttgatataagtttcgtcgatacgtgttttctagatcccgacggattgatcgatagcaaggcggcggtctaaccagtgggagtacgacggtctaaccgaaggcagcgcggcggtatgactggacaggctacggcagttggatcggtggtgacaggacaacgtcaagatctccatcaatttgagggtaacttttttgggtttttggttttccctaccattcaccccctctatggtaggcttggttacttgtgttcgattctacatgtatcagcatcccctccatcccgcaatatatcactcaattttagctattagttgaagaattagtgataatggtaggtcgtaagagatattaatagtagtgttatacatccgactgaatcgccgaaccaatcatcacatagttcataagcatttatgtggacccagtcaaaacaagttaaaacctagtattatgtaaagtcgtatgtaggtcggacaggtgcagtcgtatatatagtcattccgagatattaaaggagtaatttttttaatttataaatcaagagtaggtaatgtagaaacgatttcttttcaataaagtttgagagttagaaataaagtctttctaggagggagtacgtgtatatatactaaccaagcccggcgaagaaaaatattttttttagataatggaataaaacatcccggcctttgctcatcagagttacagccaattattacaaaagtaacacccaaacactgagtgtagttcaaatgaattaaacacacccaacaaaataaaagatcaaactaaaataaggagagcacatttattcaagtctatttctgaatctccatccatagtttgcaaggagttgcatgaccgttgtctcaagcctacgacatgcaaccttcataagctctcgatcatcttcacacatttgcagctgtgcccaaaatcggagccaatatgttgccctgaaaattacctgcatatatgagatagatggtgatttgtaaaaaaccatatcattcctagtcaaccacagagcccaacatatggcagaagctcctacaagtatgagtttacccttcttcttgtctacccccaagagccaaccatcaaacatattatatatagtagtaggaaggtataaaccaagagagaactgtacatatgctgacaaataagcgagcactcttaaatcagaagtttgacaagtgtgattggttaacctggatggaccggtgactagtttgtggcttttttaatttgaaacactcagtacaatattttcatatatatttggtttaattcttttgaaattcctccctcgaaaggatacctaaaatgcaactaactcaatgatatgttggtatagcagtatagactacaatggattttaggccaactagtaatcattggatgtgtttagttcatgctaaaattgaaagtttaattgaaattggaatgacgtgatggaaaagttggaagtttgtgtgtgtaggaaagttttgatgtgatgaaaaagttagaaatttgaagaaaaagttgagaattaaacaagccattatccttaaatatacacttcaacatggtaaaagtattctctgttttttgtcacacaaaaccctaatcaatgcatcacgcatccgaaaccgtttattgttcatctgcagagcagcggcgtggcacccgtgactaaatatctttgcgttttttttcacatattttaattttatttgaatgttttatatgtgttccttgacaatttcatgggtccccacatgctagtgaccgcaaggtacgttacgtgtgtagcacatacacgttgctgtcgctgagaggagaatataaacttgacgttggcatccgattcccatccaactttttgtgaccaaacatgatcgcaagatcgcctgagtacgtttgatatgctcgaaacttacgctgaaactgcttgatttgaacagcatgatctgaataactattttctttctttttaaaagatgggcatgtgaaaagtacccaacttgtgtagctctcgcgagttgactagctcattacatgacaagatcgtgcagagaagaaagcattaactgctgttcatgaattgaagaacctcttcattctggctatgattcgcaacatgcatgttttgaagcttccatggaaacctagacaggttcacaggagtagcttgtactactacttttgattgaattgaaattaattaatgtagagatatgcagagagttgattaactgatcaagacctaatcataaccagcaatggatgttgcatggattgatatattgatcatctaattgattaatacagatagatagcttggtgctacaaaggattaattaagcatggcatcgccgggattaacaagataattaaggctgattaattaataaattaagatctggcaaaggaggagctcctgggggagtggacggggaacagcggcagcagcttgggcctctcgccgtcgccggcgccgccgctcctcggcgacgagtgcaggtagaaccccttggaggcgatggccttctcctccctctcctcctcctccttggttatcaccaccaccccgcacgacgacgacgacgccggcggcgacggcgacagcgaggacgacgacgacggcagcgaggacgacgacgacgaggaggaggaggccatcacgtaggcgtagtccatgggcgacaccggcgagtgcatcagcctgtggtggtggtggctgtagtacagcggctgcggccgcgcgagctccagcctcgccggcgccgcgcgccgcctctcctgcagcttcggcctcctcatcaccggcgccgccggcgccggcttgctgccgccgctccccggcgcgcccgtcagcttctgcacgagcgcccggaacgtcgccgggtcggcctgcacgaacgtcgtgttcgtgtccaccacgcagccggccgtggcaatcgccgccgcaggcgacgacgaactcaccaccaccgacctcggcgcatgagacgccgccgccatggccgcgccgtcgagctagctatcaaccaaccaaactctctacgaatcgagagagatgtatcaagctatcaacgagaggaagctagctctagctaagctctaggagtacacgcactacatgtgatggtgtgaagagaatggaagtagaatgggcgagcgaggtaagctttttaagggacagaaagggtggcattaaagcttcaaaacctttgcatctctttatcgatcgcatccatctatcactgctagctaacagtgtttgcatacatactcacgtacatgcatgctgctatggtcgacgtcgactactcacaaactcaactagcaacatgtacacacatccattcacatccatccatctatatctatctggcccagctacgtacggtacatgcaatgcaaagccatgaagcatcttttctccctgatcgatcgtccactggtccatcaggtattcaggtgaattgcaggtatatacttatgaacacacgatacggccgacgggttgctacggtgtcccttctttccatctcttcagggttcagactacttcagaaattagctcttcaggtttttaagcagctgggacgtcgtcagtactgcagtacagtgacaatgtgtacagattggttggtcgatcacttaattggttgcttagcttaaatgatgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggggtgtgcgtgtctggtgttccgtgggtgtgattgcatgggagctgacctgtcagggacgacgttgtccacgtcgaatggggccccgtacgtgggccggtgtggcccagttgtcacgtaacgtcgccgtccccccgtgttcacgggggtggccgtgtggggcccgcatgtcagaggctggggccagaggcgtttgtccgcttgatgggtgtgtgtcgagttgtctgtctgtcgaccattctgcatgtacgtagctttaggttgtgctttcagttcttcagtgtcgtcggatgggatcgtctccggccggccggtgtatgtcttcgttgttaggttgctcattattgtcgatggtatgcatggtcaactggctaggtcgtcagttcgtcacggcggctccggttacgtgcatactgttggtgtcatttgcacatgttcattcattcattcagttaggatgtatgagtggctgttaattttcttgggacaaatatttaaggctctaagatgggtatatcatgtatgcatgcatctctgttgtggacttttggtgtttttgttgttgtgtatggcggattggctaatggatagctccgtttgacagttccttagcagcatgtggcacagtggcagtagtcactagtcgtatacaggtgaactgtacagtaggcgtatagctgcaagcaagcatgtgggtagtgtcgaaagtgtcggcgacacgctccagtgcctacccgacggacgtgctcccaggaggcaagtaggcaacgtcagagaatccaagcagagagagacacgccgccccgtccggtctttgcaacggggccgctccgtcgtgggctctagtactacctgttggcggctactgtccgcgaagatgaaagtacaagtactccactcgcagtcccaggcctcggcccaaccagagatgctgcggccaaggccgtgcaaaaaggccggtggtttcggtgggccgcctacccatcgtcgccgtcgcgtttgccatccgcagcggccgcgcggtgatgtgcgtgcggcgtgtggccctcgcggcgtcgacactcgaaaccgcacgcacaccggcggcgtacgtgcaatcgtgcaccaccttggaaaccaagctcatgcgcgcgcgcgcgcggcccggtgagaagagaaggcaagcgagcgcgcggcggatggataccggatggctgcactgcacgtacgacttgggcgcaaggccgcgacgtggtcggcttcgtttcttgtggggagcggcacgagtacgcgcgtatgttttgccttggtgtgaccttgtttcacaagcgatttcaggttttcttcttgggtatccgagcattcctagcagcagttggtttatcctgtgggtcgagccgtcgaggggctgatcagctgctcagccgctcagacatgagaagcttctatggaaaaccagcggaccaggcgaggcggcgtccaccgtacctgccccaagcccccaactgcccaatggtgtactgattcggcaggagccactaacacaaaaacaaggaataaattcgttcggttgcacatcgaatcatcaagttgtaaagcaagacttcttcagcatacaattattattagtagtacaacgagccccatctaattaagattagaagaagcatatgaaggttagaatgccatggagatgatggaggtggtagccaccgagattatggacgccgcgctgcacgtagccgtggccgggcgcacgctggccgtggctgagcgcgacggcacgcacgacccggccacggggcgcgcgctcaccggctcatggctctgggactcctccctcgtcctcgcctcccacctcgcgtcctgcgtccaccaccaccacctccgtggcgccaccgtcctcgagctcggcgccggcacgggcctcccgggcatcgccgccgtcgcctgcctcggcgccgcgcgctgcgtgctcaccgacgtgcgcccgctcctccccggcctcagggccaacgccgacgccaacgggctcaccgccgagcaggcggacgtgcgtgagctccggtggggtgggcacctcgagcccgaggtccaggtggacgtggtgctcatgtccgacgtgttctacgacccggacgacatgccggcgatggcggacacgctgcatgggctatggcgagacggcgacagcgacagcgacggcggcggcacggtggggtgggcggcgagcgaggcgcgcgacggcgtgcaggactgtatcgacgtgctgcgagagcaaggcttcgaggtggtcgaggtagacagggtcactaggccgctgctgcgcgaccccgagcaggccgccgacttcgccgtctatcgtctttttcgccggacaacttcgccgtccatcgtctccaatccaacgccgataactacagccgggtgttgactttcactctgtaacagtaaagccaagcttgtaacggcaccagaatcacctttgaccttttattttccaaaaggccattttgtacgtactttcttctcggttgcaggacttgtaaatgttccacaatgagtcaaggggacaaagacatagcaattaatatatgcaagtctactgtaggaagctacagtagtatacattgagaaggattttatagcaaaagaatttacagttgcaagggttgctacagcataaagtttcttcaagtcactcttttctatttcaccgccacaaaaattttccattcctgtgtgtaaagggccaagagaaaaaaaaaactacagtaacattttcgcaatcttatgaaacaagggtatttgtctaacgatccacacagatgtacactctaataaaacctggttgatttcgtgacactagagccctagaaaacgtgaaaagcgatccgcaagatttgcaatgacaaacccagaaaatacctgcaaagcacaagtaagcagggtaaagcaaatgactagttcaagcaggattgatctaagaacaaataaagtatcaaagaactaatcagtcagattttcatagttataaagaatggctatattattataagaacagaaaattttgatttactttcacctaattgtaaaatggttaataacagcatttacataacttaaaaaaaatacaatcctaagctgaggacatcagttacctggacagaaccaaagatatagaccgctgaataacgacgaccatgaatgatcatatcagccaccattgctagtggaattgtgagtgacatgcccaaggtggccaccaaaggagtagtccaaacaacagaaagagccctgaccagaagctccatgtcaaaaatagcacaactaggcaacaatataataaaaatgttatccttggtcagtgcgtaccagaagtagtctgacaatacacttccaataaggccatttgccaacaccacttcatccactttggctgagtggggtattgtaaactttggttcaatgcctaatgcggtcaatggccagactgaaaataaaagagagaaatttagcatatctggatcaaagaaccaatcatggaatacatgaatgatatatgtgcttgaaccaaactacaaaagaacatggtcacaaaggtttgtgttctacgcagtagactagaatacctgaacaaaaagaattattggcatgcgtggtgctgaagaaagagaatttcagactacgaacaatagagacagattctctagcagcacatgagatgcccatacatgacatcctttgcgattccattttatgtaccaaatactaattaaaaattgaatgctaattagtcttttagacttttcattgaatcaatttttatagttaacaaggaaaatcttaccaagccaccagagaagaacaagactgaaaagtccgaggtagccaaacagtttttggacatcaaccttttctccttcctctccagcaaacttttttagaagcactaaaataatgttgaaacaattagcagttgaatcaagacagatcaactaaaggaagcaaagaactaaccagtgaataaaccatatgacatagctgacagaagaccaaacatgtcacctagaagagttctctgagtggcactgcattcataaagtttacagattagctgcagaacttgtggccaacaaagtgagtgctgtctcaaagttacaaaatcatcttcaacatgatcttcagttacaaggccatcttaaaaatggaataaatagcgcttttatgtttttttatgcacttatatttatatgaaaagcaattcagttgcagcaaccaatctactacaagcaagcaaatgcaagggctttatgagcatagcaaattaatcacaaacaattttatatgtcctgaggcatcagtgcagaactgtgatgtttatttaagggtaaaacgcactaacccagaattgctgatttctgattcatctgatgcccaagtctgccccatggttgtcattaccacaccagccatgctaataaaaacagcaataacttttgcagcatttatagaatcttggccaagtagcacaccaatgaaaagagtgaagagtcctgacgttgaagatagtacagtagtactagcaacactagttcttgcaagtgccgcatttgacaagtactgcatccattaaacagaagagaagaatgagtaacatttagcaatcaaactactgcttgtatggttgaaatcaaatgatccctatgaattttaatgaacaggtaaatattaggaaattacctccgtcacaaaccatatgggacaaagatacaacccatacattgcaatctccttagtggaaagttcttgctccttcaaaacgtcatcgaattcagtgattccacatataagaggttttgtctcttctattacaggaatatccacatcagtatagtttatgactatagttttttgagattccatttccaacatcttctggaattcaccattcttcagaggagcacaaccaccgaaagaagatttgttggtaacttttgaaactctactacttgaagaagaccttctcaacaaattacatataaaatcctttaaaaatgaaagaggtatatagatgatcataagggaggcccccaggtaagtaattgcaaagggttgcttgtatttagtgaatatcccctgcacacataatgaaataaaattatattcatcgcataacatcaaatttatcaaaactataagaaacaaaaacatattatgttttaagacataaatcatacgtcttaacggtgggctactataactgacatgttcttgagagttaaatgcaagtaccaaaccaatatcttgttttcttcagaatagaattttaaaaattgaacacgggtagggggaacatctttttcgataataaaagggaaaaacatcttgatttgcaaaaaaactagaataatactttcccatataatatttaatcacgcattacaggtgagcaaggatgtcataaccacctccaattaaccaggtattgatgatgcgaattgtcacaaccacctcaagcaaattagggtttgacaccagccacacgaggaaagacaggagaataatcaatggagcatgtacatcaattctctagagaaattccatgagcacacaatttgacatatggaaaaaagtaactggttgcaaaagacatcaaagctcgtaagacaaaagaattgaagaatctataactcaagtcagattctaacgttgcctggacaatttttaattactggaaagaatgcatgaacagattaaacaaatcagcgaagaggaatgttccaagattcctgattaaataataaaattaatctgctgtcaaccaagcatgcatccccggccaagatctaagaacccagaaaacaaataatcacaaaagataaaaggaaaacccgaagaaatcttgtcacctgcgtgacctccgcggaggtgacccatatgagcaccacggcgacgatgaggacgaggccagcacggtacttgagattggaacccatatcaatccaaccctctcctcttgccccgcctggtggtggagtgagtgcgggtgcggggcgcggcgagcaatttaaccgcgcgggcagcggcggggctagcacccctcctcaccgagaggcagcatgcttgcggcgcggctctcggtgggtgagctccgcggcgcccctcctcgcctcatcgcccgcccgcccgtccccccccccccccccctcttccctgctcacgaaaagagagaggggatgctcttccctgctcacgaaaagagagaggggatgcgaggcgaggaggagggggacgaggcgaggtgggtggggtaaagcgggcgtgacctaccggtggaagtttctaattttcgtcccacgccgcaccgaggcgggcagcgcggcggaggcggaacggaacgacgggcgcggggcgggacggcgggattgcgagtttttggcgtgcgattcggggtgttttgggcgtgtggcgtgtgggtggtgggattggcggtgtgccgcactgccggtgtcggtgggagtgggacgggggcggccgttgctgttgtcgacttgtggatgcgggacgcggccgcgcggggagcccggcgtgcgtcgccttcggtgttgtgctgcggcggaagcgagattgatggggccttgtgtacctgtgctggactggcccatgaatattttttttccttgtaaaaaacaattagatataagagcaggtacaatagcaggctattagtcagctataaacatattttaatgagataaatgatgagagaaaaaaacagcgggctacagatatctagccagctgtagcgcggactccaagacacaatgtatgacaggtggaccatatattaatagtatagtaagcaactattatatgaattgactattagatttgctataaatgaattggagttagtagtgggctgtactattagacttgctctaaatgaactgcctatccatttgtcggatggttttttaaaaatcaccaagacaacatagtttccggtaatttctcaacagccatgcagaaaacctgatcggtaacggacgacgacgcacgcagagtcctcagtttgggcccaactgttgttcctcagttcacatgtccaggatggcaggcactaggcccacgttgcttcattcaagcccaggccattactattccaattcgtttgcaccaaaacagctacaggcacgctccactgacgagagccactttgagcggctaaaataatatcccgggacatctataaatacctaatctatatctatatatctcttctctactattataaaaattaaagaatctatatctatatatctcttctctactattataaaaattgaagatgttttttatcgagattttgataagtcattcgtgtttgagtcggtttttaagttgattaaccatatatcctctctattctcttctccgtctactattataaaagttaaaaatgtttttgtcttggtatgtcgtccgaattcgtgagcaaatcgtaggaagtttgactcccgcccgcgtccgattccctgcctgtgtccgattcccgcgtgacggccgttgaggcagcacaataatgtccacgtgaccgcatccgcctccgctctatctgtttccatgtttccatgtgtggtcgggatcccaagcccacgggcatatattactgttgcacaagtccttcacgttgacggataaagcaaacatgcaccgatgcacgcataaatcaatgtacaaattgcactgatatatggttctggcaagaagcactgcttgatctgtatgcacaagaaggcaaccactgaaaggaggaagaaccatgcatcattcaaatttcgttgtcgctgctcatcaaaatagagatcaattcaatgaaatgactgatgaaaacacgttcctgagattcgtgcaactacaaagcaacattacatgcaactcaaatcgttcatgcaggtgtttccgattcggtgttcgtttgtcgaccacgtgttcccatctgtgaaggtctcatgaccaaaacgagccagtcccaacgtcccaaccatgactacttcgtcaagccactccaaaactagataatgcggtgatgttagacctaccatatagcagatcagtgcagatttcaccttgattttcatgggtctttattttcttcaacatcaccataaagaagatggtgaaatttgtattttaattaattgcataatgtaaatcttgatttccttcaaatctagcgtactgagcccagtcgggaatgttctcgtcctccgcttcatcttcttccatttcaaccccttgctcaccgtaggatgtccaacaattatagcttgacatgaaccccgactcaaacaagtggaaatgaatagtcctggatgtagaatactccttctggttcttacacttattgcatggacaacgaataaaaccgttacgcttgttagcttcggccactctcaaaaaaaataatacacgccctcgataaactctctggaccaccggtcagcgtacatccattaccgatccatctacatgaaatgaaaaaaaatcgtacataaataaatttttgtacaataatgacagtcaaacaataatgataaaataattaaaaactctttcgataagtatacaataatgacatatcattactcatataattaataattataaaataattcaacaaacaattcttatttttaacaatttttgaagttctaaactaataaactaatattaatgttgtacttctcttaattttcaatttagcttgttttctattttgtaagattaattttcatcatattttaaactatgagaataaaattcttttaagtaaacaataaaatttctatatattcttcttcccccacacaaattttctctatcatcaacttacaataaagttttagagaaaaaaaatgtgtgaaacatagctccaaaagtaatataacaagttactaacattttagacacctccgatttgtatataatcactaaaaaaaatttcacaagaaattttggcataacctcctttctttctttaagaaattttgaagtttgctcaggctctttaagaaattttgaagcttgctcaggctggaggaggaagaagacatatataaatgggggatttttaagtcccggttggtaagatcccggagggcctaacaacgtctaactaaaaatgatctttagtccggttgataatagtctcggttttaaatggatccgggactattgtgaatttcgaccgaccgaccaaagatgatttctccaccagtggatccgaacaacttttagctatgagagagatgaggcacttcaaaatttaagaatttgaattccttaaatattctgattggaagcggtaaaactagggaaaaaaataaacgaaattgaaggagaaaaaagaaggcctaaagcaaacaagaaggtcaaaaggatccaggatgaggaaaattagcagcaaacctaaatcaaaacgcaagaccaccgctccaccgctcagctcatcctacttcttcgtggaacgagaacaatgcgggatgacgtctcgaacgctgatggatcatgccccgacacaaggaggtacgaggaagaaaaatctgagaagggcaagctttagggatggggaatgcaccgaggtcactgccgatctgccgcaatggacgagctgctccctccctgctcactgtcgttgcgcctgagagcatggatccggaggagcgccaccgccgtcgcgctgaggccgctgctcaccggagtcgccgccgcctgtgccgaggccattgcctctcccgctcgacgaggccgaggtcgctactcgtcggggctgctgctcgcaccggtgctgaggctgtcgcctctcccgctgctcgacgaggctgagggcgctgctctccgggtggtgtcactgccgcggctcgcaggggacgaggccaaggttgcgctgctccctccatgggcagctgcaaaaggggaaaaggaagtggctagatgcagtgcactggtggggactggggaggaagaatcgagattggtcttatcctatcccctctgcagctttaatttttttctctcctatataactcaagtgtcaagagcgtttgagaaaaaaaaataaaggaatataatcactgctgctttcttttttacctcttgtccaccatgtgttttattcttattctgtctttattttcctctctttctgctttgcttttatatttttattgtctatttttaaatatttaacctcaaatgcataagctgaaaacaatactcacttaaaaaaacatagattttcactatttagatgtgacgtcagcttttgcacgtcgtgatttagacgtgtcatcaattcaacttcatgcattttcttcacatatcaatgcacgtatatattcccacagttaaattacatagagtgctctacacaaaagcaatctcatcgttcatctgatcattccaacaatcgaagccacatgtcaaaaaggtatgcacatgataaattgttcataaattgcaggctagcggcttgatgcgatgcttgggcatggaggtggcggtggggttggccgcgacaccgggtgacaggtccgcagcgaccaggagcaatgacaaggatgtcgcggaggatgccgacacggccaccacaacaccgatgaagggtcgttctccaacgtcatcccccagcctgaccaggcaacgggtaccgcacctgggcatgtaggcggcggtgggggcagctgtggcattgggtgatgggttcgcagcgaccgggagcgacgacgagtagggcgctgttggtatttcttacaatcacagataaaatccacaagcgcacgaatataccgatgtagcacttcccctacggagtattccaaaggtatcgaatccaagagaacgtgtataatccgatcttcctccggtttatgcaaggatatcaagcaaatgctgcaagttgagagcgtctcgtcctttggaaatgagtctgttggcaaccgaaacaacccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattgacaggcaaattctccctgtcatggtagtcctctggtgcagggagagccagtatctcctgctcaggagattggcttgagctgcagagctcatctcttgcagaagtgaactcgtcgtcgacgggggagtagccgtcgtcttctgaatgttcatcgtcccctggtgcaggaagcgccagcgtcacctggctgggtggaactggcttgctcagcttctgactcagggaaatcctggcaagctgaagtgcctgaagaacactctctatgtccatgttgcttgttggctgttgatctggccctgcatcgacctggttgtcgccatggtcatggaagcttgatgagctccagtcagagaccttgctgttcagggtggcatcactcattgacgggcttccatctgatggcgctttgatgtcacagtagcttgaacatccatccggattctcgtttccttgttcttgattcttccctgtcattgtgccggcgacattagagcttccttgagactgtgcatgacagtggtcgtgatgctcctcgtgcgcgtcacgttggtcggcagcagcttcttgtcctgatgcgtgtgattcaggaagggaatcattcaacagaaggccagcagagcggttgttgctggcgctggggtgatttttaacgcctggttttgcctcttcgttgcaatgtaccgcttgatccgcgagcctagcatgctccttgctctgctcccaaccattttctatctggcacgccttattctctgcctcaacatgaacctgagctccaaagacaaaagtatgggtaaaatgtcaaattttgaaccaaaacaaccaggtttcactcatgatactaactaacctgtgggttgcactctgcagtgcattttgttattaaaaaaaacattttgagagagcaaattatttatacttatcaagttggtagtacacatttttgtactgcatgtgcactaaatttggtagcatgtggaagtcaaggggaagttgactctctctctggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctctccatctcgccgtccttctcgtacctgatcacatactgaccaccagtatcctcgccgtccatgtccgcctggccgtcgtcggtgcaatccgatccatcttgctgccccttctgactccaggcgagttcctcgacgtcgccgcgctgctcttccggcgccgtctacttgccattgctgatgagcagagccgtgtgatgttagaattcgacaaacaatggcgtgtgccagcgtcaatggcgggacggagctcacctgagctccttgcgcttgttcttgcggcaggactgccccatccggtacttgggctaggggtcggaggagaggaggtagaagtagctcctccggtgcttctgcttgagttgcctcgccttgcgcgggctcacgctgcggcctttccacgacagcccgccgccgggctcggccgtcccggacagcgcgtcctccgccgcttcgcactgcgccggcggctgctcctccccgcgggagcctgccgtgtcgccgtcgctcctcccgtcgcgtgggtcgtcatcctcctcgccatcgtgttcggagcccgagtcgagcacgtctgagaggttgccgccgaagccatgtgactccagaatacccagcacctccgtcgccgcccgctccgcctgccgcctctgcgccgtcaccgcctggacctgctcctccagctccgcaacctaaaaccaagtgacccaacacatgcaatcaatggcgcgaacgacagcgagaggagaaggacacggcgagtgggctgcgcctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgcgcgcgctgtgttgctggcgctcacgcactccccgagcccgagccgcgagtgacgctgctgcgtacgtatgcggcgcgcgcactgtcacatgccggcggtgtggcttgaccggcgcgggtattaaaaacggcttggtttcccgtgagccgcgcacggcgcacacgcagcgcgcgtcgtagtcgcggccgcgggcgcacggcgcaccgacagccaaggccagggagtacgctacctacgcgcgacacaagcgccccgctgcagcacgagggccatgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatcagagtttgggtttatggtgtactgtgtacatgaactccagtagcacttgtttatggggtaaattcgtcgaggacaagagtagtgaacgtggtacagctttgccatgttcgagcaacgcgacgaagccagcaaaactacactcgtcttctcttgtgctaccgcctactgctactggtgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattagcatcgagtaacagatgtttccattaaacaactttagaatacacacatgcagggtgttgaggccgatgatcaagcaatgaccatgcggcagattaatgcagaccgtaaccacaatctcaggtacttaaataacgtcatacccggtaggcaggtttacaaaacgttttcgtaaacgtttttagccgaaatttcgctcaagaaacatcatgtctgcttagtttgacatattcaaacaagataatgacgatatctcaatcaccgctggcacagcctctgcatccacagtgaacacattctataaccttctcctctctgagatgcttggggacccggcagacacatgtagttgcaaagttgtggtctcgtgtctgtatgcatcgaagacagcaaaggcgctcatagcctggctgaaaacacacaaaaagaagcaatgatacatttgatataagaatgcctgacaaactcttgtgacaaaaaagcatcttcagcatttgcatctaaaaagtgactgaaaactttgacagttgaattcgtcacgtacatgtctcacagtattcttagggcaatttaggcccctcgttatcaatgttcagacaagtatataaagtagtaatatggaacataagtattgcatccctcccaaatctgccaacttttatcagatgtccaggaaaaaatatatataccattgggtgttagaagtctatccatgatttgatttctggttacatcagctgctagtgtggcaataaaaatacatagcagaaaatacataaacatctttagtcaactgccttttctttttgctcccaaaatcttatttttcatggtacacccatataagaaagtatatagtccataaatccccacaagtcactcatgctgcattatttcactatttcctgtggttcattgcatgaaatccaataaggcactactcaactttgacatacagctattaatcgcaggttcatacatatagattatattctaaacaagatttatgatgtgtcatgtcaaactggatcagtatgtgatagcttaacccaatataatggatttactgcaagaaatggtaggatgcggttagtttaatgttttatttttcatagtacaagtacaaaaagtatggtcagttaagttacattctaagcatgggaaaaaaagtgagaaacttaacagtgtatccagggtctatggcttcatctgaattatctttgtacacaagttaattaaagtcttaaagattatacaaggtggataaggcatcttactaaacttgcacagagtataaggaatgatgggcactcgcaaatcatgggtcaaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgcgtgtcattttcagctgcatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctctcaatgaacgtcgaggggctaaagcttgcaaagaaaccctgaggacatagagtaggtgtaagattcacaatgcaaaacatttacacggtcaggctcttccatcgaactcaagagattataagaacataatggacactacacactattacatagaatttatccccgcattgaagccttacatcagatatgctatatattccttactataaaagaactgtgttgaacacaaataacacaatttaaacaggtattttgcatcttcaggctaacagtcttgtcgaatcatgatttaaccctattttgcaagtacaaaatatgtgcacctcgaatcggtgaatggacggtctaatacataaagaactaatcgacacgatgataaaaatcgcggaaaaggttccccaaaccctaggctactcggaagaatttttttttgagggaatactcggaagaatttcgtcccaataaccacatacgagagaatttcgtcccaaggaggagacgaattgaacgaatccaataaacagcgaggtagaaactactaaaatatccagcgaagcgaatcatcttcaggcaaagaaaaaaaaaacaaaatcagaatcatggaacggaagacgaataataacctcttggcttgggcggccttgcagtcgccggatggaagctgtggcgcgcgggggagcggcgatccagagggggcgcgcgtcgtccgcgccgctggtctgcgctgcgctgcgctccgctccggtcgagcaaagacggccgggtttggagtttggaccggagctatcagctatatgtcgtgattctttttcccctcctttttgttttttgagaggagctatgccggtttcacggttttctcctctggtaggagtagtatttgctacatgggcctcaagaatcaaaacgggacaccaactgtgctgaaatccaattgggcaaacgagggttggtttggtttgtagctcaactttgctaagggtgtgtttagttcacgctaaaattaaaagtttggttaaaattagaacgatgtgatggaaaagttggaaagttatgtgtgcaggaaagttttgatgtgatagaaaagttaaaagtttgaagaaaaaatttggaactaaactcggcctaagtcaatatttatgcaatgttaaacaatagtctatatgtttagattaatgccaagtgtcacagtatgtcctttagaaaattttgtggaataaaaattacttataagaatatatcttgataaaaagatattttgtgtgactatgggtagtttgtggtctagattcttcttaagaaatttatgtgagtttggatgagtacaaattatgtgagcttacatttttcgttctaagggtgtttggatgagattcagtaaccaaattacatatgctaaaaacggaaatcaaaattaacaacttgaaagtaggtggagctgggcagaggcagatctaaccctgtttcggttgaacccccaaactttttgagggataacgcagaatacctgatgaggtgtgggtagggagggatgctcaccggcgagcgacgatgcggtggaagaaggaggacgccgggcgccacctctgctcgcaggatggggatcggcgcaagcggcgggcgaggagacgaaattcgaggccgaggccggatgggatggattaggatgctcaccggtgagcgaatgaggcgggagcaggaggacgccggcgccacctctgctagcaggatggagatcggcgccagcggcaggcgaggagacgggagtcgagggcggcgggcgaggagacgggacggattggggaggcggaggttatgcacgcggtgtcgcctgcctatgggtcatatgcacaggcccatgaggctggagttttttcatctcccaaaaaagttcatctaaggtcccttatcttatcttgtcgttgagttttaaacgactttgaacccctaatcttgcaaaatggattacggatcacttttaatccagtattgctttccggttttgttgacatggtggctgagtcagtgtagaggccacgtggaccccacaagctaaccaacaatcttcttccacctcactcccctctactcccatctcaacccaaacctccagggcattcgccaatgggtggggagaagggtgtcggtcggcggggaaaagttcgacggcggaggccgccagctaacgtggctcccaatgaccggaagcgctcacgtcatggacttgcgcacgtgcggggtgtggcgcgggtcccaactacaactgcaatgttgtcttcaccggcacgcgtgaaggctggggcttccgcctcatcacgctggccaagctcctatcccgggcttccgcctcgtcatgatggccagctcctatcccccaagctcatagtcgcccccatcgagcggctcaaaagccgatgtgttcaggtgtccccgagcttcgcctctccttcgcagaggcgaacgcgcggctccgccgcatcgtcttcgaggtcaactccatctactccacgttgcggtcgcatcgtcctcgatgcatgcgcccttttccccaacgcttgccaccgccaagcttcttgttcgctgccagccttctccccacccatcgccaggtgccgtcgtcgggcttctacctaccaccgccgcccaacaaccaccacccttctccctgctggtcaccggtcaccacacacctctctcgcgattcagcgtctggcgtcctcttcgcttgcatgcacgagcactcatgcagtcagtggtgctcgcgagtatgcttaggcgtcgcaacgtactccatctcccaactcttggagatcctctcgccaatcccgacagtgtggatgacatgcgaccatgatgtggagcaataaagtacctcgtattttaccttcagcttctggctgtctcgcaataccttctacagcttgtcctgcagcagtaccttgaccaactccaggcccaatagaagcaagccctacggccaatccagcagcaattagtggaatgcctagtttgactagttggttcagtagcagaaacaacttatttccccgaaaaagacctagcttcttggacagctcaatccggtgcggcaggaacgaatgaaacgactagtggtcctcggaaccctacccgagcttatattccttgcttcaacgcccgcgccttccgtggaaaagtactagtgcttcttatggagcaagaaaacggatgcgcgcgctaacgctttcgcgctagtgcactcaccccgttgcttgttgggcactgaacacttttcaagatccggttttggtaggacgaagatttttcactttcgtgaaggtcattctgaggtggaatcgaaccactatgttaggatttagagtccaacgcgcaaagctaaagaggatttcaagtcccccgcccgccagaacctaaagattgctttatttttatacgatttattgagttaactaaaaagctggttcgttccatagagaccagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatctcgaggctattatgcgcaagcttggtttccaccaggtggaaaaggtgatgaaatgtgtgacgtcggtctctttttcggtgcttttcaatggtggccaactggagaagtttaagccaacgagaggcatccgtcaaggtgaccctatctccccatagtaagccagccaatagtaccctaacttaagaagttctcttagctagcgcatgtccattaatgtgaccaccgcatgctcctgcatgagtttcatgaatggtttgtttttgaatccattcttttttaggtatactatcttgcaagaaaggagctcgcaacaaaacgagagctttttgatagcccgttcactcgactaccacgcttagtaagtctatctgcagggatgggaatggcgtagtctgtctgcccttcttcgtaagcaactggaactatcaaaagtcaatgtcaattggccttctaaaggctatagccctgtttcttttgaaaaaacgaatttcgagtttcgaagaagacatgcctccaagaaagccactccgcctaaagagtcctaattcctatccggtctacattcactattcttcataggcactgcgctgggtcggtaggttgctgttttgacttttttcttcttgctttaatccagtcgctcgataggacttcccgtaacccgaaaaggttggttcttcccctacaacccctacccctccaaggctcatcggcaaatccgaatgtctcgatccgagttgagacccacctacagaaattgatccatcaacggcttttttctatagtggcaggaagtctccaactcttcgatatgcgctagctaggtaatccctttacttaatctgatatgggatctcttgctaccagaaaggaactgaactggcttgcccggaaagaatggattgctacccttggagagctaatggtactggactgatagcgcactgattgaaccgaccccggacgtaccactggggaacctgtggctggagagaatctctcgcgatggaaagaaataaatcgaatctagaaagacacgttctacctatgactgccatttgttcacttttatctatcgtattggatagaattcaagtcccttaccgtattcatctattccctctcctttcagtcgagttgacctcggattctaaagcaacccacgggcataagcaaagaagttatcaagcttttgggatagcaagttatttctagggtaaaggaaaacaagctaacagtctaaggctaagtccctagagttccagttttaatagtcccattcctcctgccttccgccgacctgcggccttatcatagtagcccttctttcttgccagtgagatagttactacgaagtctgcatcgggagaatgggaataacgatcttttatatgatacggaaagcgaagagaatagactgctacatactaagttggttattcgtagatttttaccttcttggaaaataggaatggggattggcagggcatctactatcaactagttacttgggcaccggtgatacaccccaggataccttacctatttagacatttatgcctcgctgcgcgccttcccaacgagccaaaactatgcctaggcctcgggcttaggaactatactacaactagttttgtatagaaaacccagaaatacccatattcctttaaccttcacgaagaagttcgttagctccccctatgtcatactcctaaagaagttgtaataaaatgtgctgatccagatagatcaaatcctgattacgacttcttcattcggtttgtagccataccgtatagagttccaaatgcctttttttggaagtaactagattcaagcaagcatcctagcaaaacgatcttttgacaatgggctctacccaacactaggactgactgactttatacagagatagaaaaggcagcaatccaagctctttttgaatcggatattggataggctaagctaggtgtagcccgctttctctacagttttgctgaacttgtcaagcccggggggcctttagggaattttggagaatgatagattctaggataacactttctaaggttgaaagggatggcatgggttaagcatctgactttggaccttcgagctaagttatttaataaggtcctactaattaattggaaatcctttttacaaatctcctcctcagagcgccctgtaaccttaccttttctgaatggtacaccttatttaagacattcagaatagaagaagagcaatcgtcgattgattgaaagtggattgacggcattcatcagttgattgaaaatgaacttttcttttatgatcgagcgaggtcccttttgggcttaaaagtcctttgagccgtggaatcccttttgtcttgatttaggagaataggcacattgattaggttacgtggtttgagcaatctgcaggaagtttttttttctttattatatataccattcatatttattattctatataccattcatattaaagtaagacggatagggcatatttgactaggaagcaagcaaagctagtccctccataccagcaagcagtcttgtttagggagtctccttctttactgagtaaggttcccgggtgcctatgtgattattaaggcagggtgctactgtaccagtagtagagtggcttgaatcaaatcgtttgtctagagagggtgtagcgataaccaaagttgactgtactagaaactttagatcctgtataggcaactggccttagaatagtgtcttgaactacaggaacgacccataatcattgacgaagaaggcttggaaaaggataaaacatattgaagagaagctttcacaaaggccaatagccgatagctgatgtcactagccttaacttctttatctacttgaaagctgatgagagtacggctttcttaaaggaagtgtccgtccctatgatattatatcatagtaaagagcccttggattcgcctttttccgtaagcctaaaggcaagggaagctcttcgtcgagcttcttatccattgaaaaagacagacttcaactttaagactaaaacctgcccctttattattattagtaagtaagataggttgcttgagccaatccttaaatcgtgggaggaaaaggcaaaaaagtgagcccacccaactaaaggaacggagaaattctgaacttcaataatcgaagagtggtcgtaggtgagcccaccccaggcaaatccacttatcgttatcttgctcctggtcaagctcccgtacccgctcctttccgtgggctttctttctgctttgacttgttccttttcttgctttcaggaagtcgtccttgacgagggccccttgatagccggtcttcattgccaatgagaaagaaaggctcctgcttgtgtgcttagtctagccttgcaagcaacctcttcctaccagaggactaccatataccgatccttgctgttaccgcaaatcgatcaattcgttacttttcatcggaagaagtagcacgcaactcggaaagaaaaacctctgatgctccttttttcttaatgatgcaactaatgtaatgcctagaactgatctattgcaagcccggatattcgattcctaacagaacaactcatgtgtgaagtagatagataagtagagttgctttcgctttgttaacttacgtaaggttgcgtaagatatgtgaatgtagttacgtgagcttgcttgcctcactttcctaatatattgttgacaacacttgcaatagggcgtagtgttgcgctgggtcgtcttgttcggaagctgattgagaaaatatgcaggcacaaattggatgcgtaaaccttggactcatcaaagctatgctatggctatgtactagttgatgagcttgcctccagtacttgatagaagcccatgactctctatctgaaagtggtcttggccgtaagccaataggcgtagttgtagcgaagcggcgtatatcgtagttgttcggatagcaagctacctgacgtgataaggctactagtgccctccactcgtgcctactttcactaacctatagctattgcatgcaagctcaatcttctatctcgcattgctacatgctcgaaacagccaattcgctcgtatagctaacgcaacctatagagtttggggagtgctgctattctttccaaatggtctctgagtgcggtctgtcaattcctgttgtagacatctgaggagagggggaagaagagtagacttactacttttgcaaatcaaagaaagaatttaaacagacatcaatcatctaatctgaattctttgacaattaatagatacctatcatagaaaaacctttctccaaggaagcttgcttcttgttccagatttgatctgatcctaaaataggttactttgctttccgctctatcggaaaacgttctaacgtattgattccgtaattctatttcaaaaaagagtgagactcaatctccttatgccatcccacgctaccgaagtagactcgctccgtctatgtgtcctgaacccgaagatagagaccccagctagacctatttagtttagttgcctcgggtgagctgaactaccagaactagttctttacaactcgtgccccggagccctctatctagaatagctctctctagatttcccagaaatgttaccagaataagttacaactgactatatcttcttttcccagcgacgcgccctcccactaagctctcaaccaatccaaggttaagaaaagaaagaaccaatggaatagttgcgaatagatcagtcaaacctcatcaagtccaggttttgtaggcaggtatccggataggtttatggttggaagagatagacacgaacggatagccttgtatgtatcggtatgaacagtgttcaggtttaggaagagtaatttgaacagaagggctagctgtgcttattctgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttcaaacgcaaataaataaaaataaagaatttcagcacgcgcatccgttttcttgctcgaaaaaatgattcaatctgactttatcggtattctggattgagtaaaaaagggatatatgaagttcaaggccttgccaaaaccgtcatggccctattatgtataggccgtactaagccaatagtgaataacaaactctttcctgctccctcgaccctaattaactcccatcctgccaagcctcagctgccagcgcattgtatctaagcacactgcggcaaattgatacaagtagctaaagatctcgcatccgacatccccggccgaacggttaggcaacactagggcgcctgggtcccaattccgtttaccaaacaagatgtcgagaggcgaactctgtaattcccccccagcaaaagtgatagcagctgtagcatccgtgtggaagagggtaagctttcggcaacacctttttcagattggaaaggatgaatacttgtgttgggtcctgcagaccaggatagccttagatcaaaacctaaatgtgccaggggttgatcatagaagccagggcaataagtattcaggaatttgagcgcttatgtagctaataactctgccacctgaatacttgattcattaaggtcgtcacccaatacccggaagtctctatcgttttctttgtctgttaagcttcacagggttgggactccctaaatcaaactgcaatcgctgtttatcaaccactcacgacgacaccgagatcttcgacttagctcccacaggtctcggggcggaagataacgaaagggagacaaagtcctaactaaatcaacacacaataacctcaaccttctaccatccatcatatcagtcgagtcgaggagattcgttcttatctatagataaggcaagagagaacttatgacctcgcggatggagagggattcgaacccccggtattcctatcaatacttcggttttcaagaccgactctttcaaccgctcagacatccatccctgcgctcgcccgccctatctatctgcgcgctggcaggtaggggcaattctatgtgattcgctacgcttgcttgcgctccaccccgtaagctaactatattgcctagcggttagcgacacttttccggtagtacgaatcgctacgcttcgcttctttttcaccgtcggttgctgcgctccctgcgggtaatagcaagagagtgaagaacgaacgatcatcagttagcagtgaatgagtccgacttgagttcgtgagtcaaaggcgtggcaagagagcgagttcgactcgcgaacgacctgcaagtgaaggaccgatcctttaacgccagtactgttgcgagactggtacttgggggctcacgagcaacatatagactaaggttgcccatcactcccttgctcctttttgaaggcccaccgctccccctttctttaagcatctatcccggcttgcattttggggcgagtactacagttcctccataatcacacagaacgcctagcttcgtagagctgctctctccccagtccacaacaaggtgtggaatctggatctacagtgtgttctgactctattggatcaagtcagatactaagccttctactactacttaggtacttaggagagaaaatgctatatttcatagattggactctcttactgtgtttttctcagggcagttcccgagccgggttccctggatccattctgacctaattggatgaatgaagaagggggcgagcagatacgacggcctctttttagccgaataaagctggatctactacatagggaaagattaagaaagcaagagcaagcctactctactatcgattcaaaaggtaaactgcccccgaagactttatcaatgaatggatcaaagaaggaggctctatctatgtcatcgtatataataagggaagaagcccgcccctgatcgaagaatgaagaagctagcccgggtagactttaagagctcttgctctgcctatccctatcgctctgccttctttcccctcgcctctgtaaggagtgatttgtttggacaaagccgaccaggaatccaactgaacgacacgagttactctcccgagcctcctctttattcagaaatgaaaccaagccatctgatctaaccttaggaaggcggtatggattgactataactaaccaaagcgagtgagtgggatattgtgatactaagaaaggaagcaaatgtctcatatctggccaacaataccatttacatcagtcggcatgttctctgcgacgaatctacatttccttttcaatctgtgccttaaactactcccactacttactccacttcaacatcttctcatacaactcttccagtcatctcctcagtctctgcttctcctcttaattcctctcgtccacctcctccttccccatgtccttaacactctcaacaaccgacacactctatgaccactcgaaccacagatcgcactatgaaacctcagaaattccctgatttcattgcctactcatctaccctgcatccattgcctccttccaatcaagagactaaaccaacatgttattcaggggctgttaaacatccacagtggcgctctgctatggcttcagagatttcagctcttgcaaataatggcacttgggtactggtaccacctagtcctaactacaatataattggtaggttgtgggtttacaaaaccaaacgcaagtccgactgtacgattgagcggtacaaagcgcgtttagtcgccaaagggactactcaggaggatggtgtttcgtgattcattgaagctactcccagattctttaagttctttaggtcaaagtctctgcccagagctcggcagtaaaggtgaagtagatcatacgtctgtagttatggataatttcgcatctaggaagagggaattggtagagaagcaagacatattgggtggtattatgctgatcaaaatatctattggagtctttacgagctttatattactacaaggatgatgaccttgtcttttctagcgctaaccatctttaggaaggattattatgatgagatgagtacacctatagcaattcctcataggactgctgatgagtttcttcataggggagactatggaggtcatgcggatgtgtataagctgtgagaattttttctattatgacgttcgctctctgtatccgtttataatgaaatcatccccaatgccgataggtgcagctaaatgggatggtaatttacagggagaggaactgtatggctttctcgaggcatatgtggactgtcctgaaacaatgaataagccattccttccatatcgatcataaaaaagactggattgcttattttccccggtttatcggagtttactattcagagaaacttcaatatgctgatatatttggatataaagtcagacctctttgtggctatctctatgataagggtgatggtttattcgataaccacatggccccttttccctttaacgcaactaggtaacaatacctcgctacctgttgctgtcctttttaaacccgtgggaaacttcatcatcaagtgaggtggaaactacagcttcgattgcattcagccttcctcgtcctaatattgcatgataggccggcgtccaccaccattgacggtcgctatggccacattcggagacttccaaaactgaactggaagatggtacccaaagcttataaggtttaaccggtaaagcttatgagagaagttcgaacctgggacaagattttatcatctcgttcgagaacttctttatgcaagaaatgggctacccgtgtcgaccagtaccctttttactcggtgcagtacccactcggagaacgtgagagtatattcccccgccctcttctagactttatacacttgtaaaaatatgtcatgcgccactggcgccttctctgcttgcttttgtctccctacggtgtttacatacacttcccaccatgtggcatgccattgactcacttttaggacatatttgtacatcttttgtctctatcctagtcaactggtacgcatggcgtaaataaagatgacccgaccacccctgttcaccttcctcaaacccaattcaaatgatggctgtgaaagtcagaatccttcctacctaggaaactctcatcagaatcattgatggtattaactgacggctgtgtggaaggactactatctcgtacataactctgtgtacactccgtgttgataatttgagacctaatggacacatcatacataagaacccgttgtcgagattccatcaatatcttgcttggcagcttcata

SEQ ID NO: 71672 - DNA, 7771 bp, Oryza sativa
  unsure (1)..(7771): unsure at all n locations
ctggtattaaaaacttgatcagtctatgctaggtcttaggcttgtgaaaagaattacaaaacttgctttgcgcgaaagaaccatagccatcctttgaattcctctgtcatgtgcatcattgctgtgatggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccaatgatttaagactatgcctgcgggcttatgatgtaataattcgtattagatactcgtgtatttgcacttggtatttcagctatgaattcgtgtgtaccagactacttgatacagggaaatggtactgtttacacgattgattcctgttataaaaacgggggtccacagagctggtatcagagccatacgactgtaggaaaagaccaaaaggcgccccaccccttttctaagttggccaagggagaaattcccatttagtaatactttcaaaaataaaaacgctatgtttacaaaaactcggtacaattttcatcttactcttaactattttctttacaaaacaagttttactctcaactgactttgggtttttcttaaaattagatggcagatccggattcacccgctacttgggtgttgagcctacctcaatcagaggggtatgtcattgagctgcatcggatgttgaggcgtctgcgatactctgggttcccgtcataccgagtgagacagtgtggctcagtttgggaggctcgggtcgaggttcacccccgagtcccttccgagttggactacagctttcagacacgtcaccaccgagacctgccagagaccgcgatgcaggatgcagcccaggaggccttactccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgaccaccagagacgtgtgggggagttagagactgaggtgaccgacctcacagcgcagcagctgcagttggaggaggagcaccaggcttggggcagtgagatagactcactgaaggcacagctccaggtccacggcgaccagttccagcagttatctgaccagtacaacgatcgccgcgggatgatggatactcttgaggggcagctgagagagagtcaggagcacgtcagccagctggaggagcagcttcgagcagccaagatcagcaccacaggggcttctacttccacagcagtaggccgtgaccgctacttcttcctcaccccgccgtacccaccagcattccacgctcttctgggagaggctagtatgctagctaccgagtcagcaccctacctagtggactcgacagcggcacaaccacctgtcctggagttggtgcacactccactgatccctacaccttctccgcagctgggttccagtttggagactccgatccaggtcgactccgagacagaggggaccgacaccgagccagagatcgagccagacatcactgatccttcagaagatgagacccctgttccccgcatcaccttccttggaggtcctcgcaccctcagcactgctcgcaagagcacacgacctccgggcaagaggcccaagccagatccagaggccactacctctgagccgtggggactcaggtttgcgcgtgccagcgaccaccctctacctgccccaggatcctgcggatggctggaggactagactgacggactccttgcagcttcgatctcgtatcagatggtttttggatagtatgcgagacacccccctcccttacctagattgacgagtagattgatgattagtttgatgtatcttttggatgaaccttatttggactgcgtatgtatgcggtcgattgcatcatgatttatgtaccatttgtgaaactctgttatgttatttatgatatctattgttgttgtgttataaatgagtttattccaccatgcttgcaaaacaaagttcatatcaacacaactcccttaatgggataaagccataggagctagttagaaaattaggatatttactccatcaacctacacagatggcaagccgacgtcgggcaacaaccagcaatgacgaaactcagacacccgacttaaccactcttgctggagttatggccacccaaactcaacttctgcaagctatcgcgaacaaccaaggcaaccgcggaaggtcaagctttggagagtttatgaggaccaagccacccacattcgccacagctgaagaacctatggatgctgaagattggttaaggatcattgagaagaagctaactcttgttcgagtacgtgaggccgataaagtgatctttgcggcaaaccaattggaaggaccagccggagattggtgggacacgtacaaagaagcccgagaagaagatgctgtagaaccaaactgggaggaatttaccacagccttccgtgacaacttcgtgcctgccgcagtgatgcggatgaagaacaatgagttcaggagactacagcaagggaataccacagtacaagagtacctgaaccgtttcactcagctggcgcgctacgcgactagagatcttgccgacgaggaggaaaagatcgacaaattcattgaaggcttgaatgacgagttacgcgggcccatgattggacaagaccacgatagtttccagagtttaatcaataaggtcgttaggttggagaacgaccggaaggtcgtggagcacaatcgtaaaaggaggcttgccatgaaccgctcgcctcagaccgcaccccagcgtcctaaagggacaacctcctcggcatggagaccaacagtggtgacaaccagtcgacctgccgcctccagcaatttccacaggccggttaccattcagaaccgcgctcctgcaccgaatcaggccgccactggatcagtaaggcctggaagctgtttcaactgtggagagtatgggcatttcgccaataaatgtcctcatccaaacaagacacccatttgcaccggagctaatgcaacggctattcacgggactgctacccctgccgttggacgaggtctattcaggactccgcagactaacaggaccgctaccggatttggacgcgggcaagtgaaccacgttcgagctgaagaggcccaggaagaccaaggcgtactgatgggtatgttttcactcaactccactccagttaaagttctcttcgattcaggagcatcgcattcatttatatctttgaaagcaagtcaacaacacaatttaaccagagttaaactaagacaaccaatgttagtacattcacctgggggtgagatagcagtggatacagcttgcattgacgtacccatccgccttagggatgtggtatttccctccaatcttatggtgctaataccccaaactcttgatgtcattctgggtatggattggttagcaaagcatagaggaataattgactgtagacgtagagaagttaccctgaccacaccctggggatcggatatgagagcaaccatggattaagatcctaggctaaccgaacgtgccggaggtatatttaccatgctacccctaaagggaatgcccgtagtgcagcgatttcctgatgtgttcccagaagatttacctggaatgccaccagatcgtgacatagagttcattattgacctgatacccggaactgcccccatatccaagagaccatatcggatgccggtcaatgagttagaagaacttaaaaagcaaattagggagttgcaagaaaagggatttgtacgccccagttcgtcaccttggggagccccagtgctattcgtcaagaagaaagatggtagcatgagaatgtgtgtggactaccgctcactgaacgaagtaactatcaaaaacaagtatccactaccacggattgatgatctcttcgatcaacttaagggagctaaggtgttttcaaagattgaccttcggtcaggataccaccaattgaaaattagaaccggggacatacccaaaaccgcgttctcaacacgctatgggttatatgagttcaccgtaatgtcgtttggtttaaccaacgctccggcatactttatgaatcttatgaacaaagtgttcatggactacttggacaaatttgtggtggtattcatcgatgatattttaatctactccaaagatgaggaagaacatgcggaacacttgcgattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacggaatggaaagcacccaaatctgtgactgaaattcggagttttctaggcttggctagatactaccgaaggttcattgaagggttctctaagatagcccgaccaatgacacaactactcaagaaggaaaagaagtttgtgtggtcagagcagtgtcaggaaagctttgagcagctcaaagaaaagctgacctcggcgcctattttagttcttcccgacatcaggaaagactttgttatatattgtgatgcttcaaggcaaggactaggaggagtactgatgcaggacggaaaagttgtggcctatgcgtcgcgacaattgcgaccacatgaggaaaactaccctacccatgacctagaactcgcagctgtggttcatgcgctaaagatttggagacattatctgattggaaaccattgcgatatctacactgaccacaagagtctgaagtatatcttcacccagtcagatctcaacttgaggcaaaggcgatggttagaattaatcaaggactatgatctagaggttcactatcacccaggcaaagcaaacgttgtggccgacgctctgagtcgtaagagccattgcaattatctgagaatggaagggatggtccctgagcttagggaggaaatagctcagctgaacctacctcgtgggcagataaacaccctggacattcaatctcttttgagaacccaaatagaagaagcccagaaggacaacgaggaaatccgagaggtgaaggaacgcttagctgcaggacgtgcaaaggaattttcaaccgacgaaaaagatgtcctatggtataaaaagaggatttacgtacccgaacagggtggactgaggggattaattttaaaggaagctcacgaatcggcatattcattgcaccccggaagtacgaagatgtaccaagatctgaaggaaggatactggtggcccaacatgaagagagatgtggcggaatacgtagcactctgtgatgtgtgccaaaaggtgaaggctgagcatcagcgaccggcaggcttgctgcaaccccttaggattcccgaatggaaatgggatgaggtaggtatggattttattgttggattgcccaagaccgcaacaggatatgattccatttnnnnnnnnnnnnnnnnnnnnnnnnngacggcaagattcatccccgtcaggacaaactatagtagtgctaaactcgccgagttgtacatgaccagaatagtgtgtcttcatggtatacctaagaggattttatccgatcgaggcacacagtttacctcgcatttctgggaaaaagtacatgaagccctaggaagttacctcgcatttagcacagcttatcatccgcagacagatggccagacggagagaaccaaccaggtcctagaagacatgctgagggcttgtgctctggattttagcaaggactgggagagatgtttgccctacgccgaattctcctacaacaacagctttcaagcaagcctaaaaatgtcacccaatgaggcattgtttggtcgacgatgtcgtaccccgctaatgtggtccgagactggagaacaggcggtatttgggcctgacattattcaagaagccgaagaaaaggttcgcttgatccgtgaccgtctaaaagtagcacaatcacgccaaaagagttatgccgacacccgaagaagaaacctggaatttaaggagggagattacgtttatctaaaggtttccccgatgaggggaacaaaaaggtttaaggtcaaaggaaaactggcaccaagatatgtggggccattccagatcatcgccaggcgaggagaagttgcatatcagttacagttaccagagaatatcgcggatgtgcacccagtcttccatgtgtctcagctgaagaaatgtttacgagtgccggaagagcaagccccgctggaagagattcacattagcaatgatctcacatatccagaacacccgatccggatattggatgaagccgaaaagaggactaggagcaaagtgtggcgtatgtacaaggtacaatggagcaatcacactgaggatgaagccacatgggaaagcgaagaattcttgaggacggagtacccacatctattcgaaaactggtaagaaatctcgggacgagatttatttaaggggggtaggtttgtaacactctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggaataaaccgtaaaaacaaaattggtaaaatacatacaaattaaaataaagattaggtggggatagaaataaataaaatattatcgcgaccatatttggatcaattaaatttaaatacgatggaataagaattaaccctaattaaaactcaaacaaattatataaaaataaaatatgagtaatattaatctagggtgaattcattagttaagataacacaaatattgagtaaaatgcatatatgcaaaattaggaattgtggaatcaaatttatatggaaaatacactaaaatcgggttaattagaaaatggcactgtttattgcacctaaggtgttcggcgcggtcccctaacccagctcctcctctttccccctctctctcgtcgccagccgccgcgcgccgtcgccctcgtcgcctggcgccgcgccaccgtcgccatcgccatctcatcgccgcggccgcgccgtcgccgtcgcgtcccgccccgcgccgcacgtgcatcccatcgccacctcgcgccgcgcgccaccactgccgcgccgtcgccgtcgccgtcgccatcccgtcgccgcgtgcgcgttccatcgccgcctcgagccgtgctgctgccgctgccacgccgcgagcccgcgccgcgccatcccatcgttgcggtcacaccgtgccgtcatgtcgccgcccatcgcatcccgccccgagccgcgcgccaccgctgtcgccgtcgccatcgacgtcccgtcgccgcgcgcatcccatcgccgctgccgcgccgcgcgctgtctcgtcgcctcgcgccgagagcccgcgcctcgcgccccgtgctgcgccgctgccgcctgccgcgccgcacgccgt

SEQ ID NO: 71673 - DNA, 2269 bp, Oryza sativa
ttcctgcagcccatttgttcaaaattttgtcacatgccacagctggtggtcaagtaagacatttgccttcagcattagctattcttgtgtacaaaatttttttcagagtcatcacgagaaagtggctccattttataaaacacaacccacatgtgtggcaatttcaaaaatacgagtagttacaactactctacttccaagcttactatcctgcactgcacatctgattaattcccatgatttcctatcccatatgtcatcaataataacaaagaacctgcacatcacaatgatagcacaagagccataagttagtaactaaaactagtgaatgaacatgtcaacataaggaatgatcaaccatcaacaagaagcccaggggagttccccttaaatgatggaataagaagtggtcattagcgttacatttgtcccatagaattagccaaatgtgtttgtacaatccggtaattgtgcatcgtacttgtgtttcaatttaacaaccagcattaaatgcggcaggcagagcgcctgactggtcgctatgaccggtctgtgaccggccaagtgattgataggacgacggcaacatgcccacttgctgcccgtgtgtcaggcggcgtgtggcatgccacgccccatcccatcgatcatgatgaggagcttttctactcctcatcctatctggtaccggcctaactactccagctgtacccggatttgtattcccgatgcatgcatgcacccaaagtcctcatccattaaatagagaatgacgcgggcgtcccctgtgtcggccggcctgatgtgatgggccctatacagcagccgacgtgcgtgtggcttccaagtcaaggcacaagacacacatttaatgtaaagaatatttttccttttccctaggtagcttttcggacccatgtggtaacctcttgaagtataaaaggaggtccatgcctagtgagaagggagatcccggaggaaaaggcaatctctggaggccaactccagtttatactccagagattcagagactttctaagctcagaaaaatcatcatatataggagtaggatattacgctttgcagcggcccgaacctgtataaactccttttgtctcatcttcttgaggggctcgaccccctctacttcaccattccatccaaatcctcaattctcacctgctgcccccgaccgaactaacaaagggggcctcacagtcccccgcttgaggagttcaccttccgacaactgttgtgcttgtaagaattaaatcattataataagatctcacatgattatattttgatgaaaaattataaattatttttataatatatctaaattacttttagatttcactaaattacttcttagacatataaaaataaattaaataaaacataaaattaatttgcatatattatagaagaaacttaaaacaaaaagaaagtaacttgtcatgacattagaataaatccgttgtgggggtaactatgatatgttgattaaatctaatttctagagacttatgtttttacctccacaatagatttcttttaataccgtaacaagttactttactttttattttaagttacttctataatatatgtaaattactttcaggctttattaaatttacttttatgactaagaagtaatttaatgaaatctaaaagtaatttagatatattataaaagtaatttgtatttttttataaaaatataatcatgtgagatattgttataaagaattaattgttacaaacataatggtgtaatcggatcataaattagatgagtaatttaatagaaaattccataagaagaaaaaatacatgcacttttgggtgtacaagtaacaatagatatgagattgaggtagctggttataacaatacagagaacggtctcgttgtagacacgtccttgcgagtgagaattgaggagacggagtctaggaaagagaggctttccgctcactgcaactacctcctttttcattgtcacaactacgacaaaaactatggaaacatagagaggcaactcagaattaatttattttttaaaacttcatctattcttttgaacctcaaaaaagatagggagcttatgctttcattaagtaaaagagagttgaccaatagagaaaaaatgggtccaaaaaacttacaactacgcagcatacaactggtgaaaatcagtaaaaacccatgcatagaagcaaagaactaaaaatttcggcgtcacgactactgaatttca

SEQ ID NO: 71674 - DNA, 18634 bp, Oryza sativa
ctcaatatttgcaaagatgtgtatataatgtataatagaagtttatggaaaacatactcatcaaagaatcttgcaccaagtttatagctgaccttggagaagttccataaaattttgtatacctcctgccagcagggaatgaaatagaattttatttaactagtggaccttgtaaaaaaacagatattttcgatatagaaatataaatgcacatcatttggaccagcttagaagaccaaaaaaaaaaaaaagataacatatggaatattctgtaaaattaaataaattcagggagcaattcaagaagaatgccgtgtggcttggtgggtgatgcgcagatctcctgcatgttcaagataaaatgcatatagatatacaaaatagttaaggccatgcaatagtatacatggagggttgtgcaatatgagttcaatgttttatatgcattcattaataaatcaaacactgttacttatattcgtagccatccttgtttgaattaacatgattatcaccataaataagaaattaagattgcataagttacctgtagtatgcatttcccttcttaaatttgaccttaggggatgaccaagccagggaaaatacgactgtacatcttccatgtggttcaacccaggtggatgcacaaactgctgcacaaactgtatcacccagcgaagaaggcatgctagggccggcactgaaattatctcggtcgaagcaaccatcctttaaacatttagatggtatgatagacagtctcagtcattgtttcattgatatgacagtgtcagtcgtcaataagagaaactagtgtaacaaaagatttgccctattcagagtagaaatgtgaaataaaatatatcaaggggataatcacctggctcaatgtgccccacatttccctagctgtaacagaactttctccagaaagcccaaaagcaggcaacacagtgacatttacattttggttctcacatgctgcaacagcaaaagttacaggaggattattgttggcagtcctgcaatggtaggaatacctaatcaggaatagaaatgatattgctcatcttattagatcgcatacaaaaacatagtgcatatctacacataatttcttgcttccagtacaaacatagcacagacattatggtattgtttcaaattgtatcagagtgaaccagtagaggaatagtattgcaaacaatgacaaactactagctcttaatctctgtggcacttatcagtgccaaaggagatctgacaaacaaccatagcaagaagagtgatcagcagacaatgacttgcttgtgatgcagaagcacgccagaaactccattttctcctctgcatgttaacagcacattaataatttcactttattgcagacaagatattgattaagttttaatgctttagttaagttctacaaagtactaacataaatggctcatttacatgaccgccggaatgatgggaaagccctccaatagaattctggggtagattcaagaatggaatgtaattagatgcaactaacagaaaacccaaattaaatttgcacattaaagtaaaaaagtagttactaccgcccaggtcattacgaggctgacttttgccctttctttaccagtgttcactatctgcaatttcatatgaataaaaaaataatatcaatgaaggaactggcgatagtggcattttgtttgtcagtagtctgcacgtgatttgtgtgtatctttgtaatttaattatatcactcacaattgtgggttatgataattctctatggtttattgagcaaatgaaaaatgtcaatgcaactatccattttagttttctgggtttagaacttgcgatacatgaatgtagctttgtttattctgaccagttgcaatgtatgtgctctaaactagtgcgagcaaaatattaaatacttaatcagctaaacagaataaagtgtcaaacatactagcaatgaacactaaaaaagcaactttcaggtttaacatactcagtatcctgttcttgaaagcacattcctataagcaatgaatacttacagtgtaaacaaaaacagaggtaggaagactgctctcttgatagttatggggaataaaaggagatatttgccggcaagatactttcaattcaggatcaggttcacctttaaacaaaccgaagaagttgtcagtaatatcctcatgcttgcgatattatggacaatgtgcctaattttttttttacggaaatgtgcctaattattatacagaaaagcagttagcttgttaaaaaaggctccactgctatgtacacttatccatgggtaattagtacttaatagcacttgaagtcataaagctaactaaagcaatgtttgtaattatcaagttcatcttataacgtagggttatttctataacaaggaatgagtaggtaccatcatagacagtccatgctcgaggaaacaacgcatggtatgtagaacgatcacctcttagtttccaatcccaggatgatataccatcatcattagatttcctggaccaagaaacataaaaataaccggacaattgtttcatatggactatgattgctatatattttacataaaagcatagatgagaatatttcaggtagatccatttagacaacgtccagatgaagtttcatactaaatatactatattgaggatcagggagagagtcatactttaaactatcatgctgaccaggagctaaaacagaggagtattttttgtttcctcctcgagttataaagatctgcagtaattaaagatatggtgaaaaaattgtgaatgttctcttcagttaatctttgtatttcacagcaacatcatgtttgatacactatcaagagaatatcagaatagtcaatactgaatgattgaatataattccagtgatatgttaagtggcttacaacataagggagctgctgaatatgataaataagtatttgatgaatggcaacacataacgcaacatccaaagttctgaagaactgctacctagctctcaattgaaaatattttttttattaattataatataagtgtgtattttaattcaaaaatggtgggtgcctctctaatatgtcatgaaatgtttgttcagttgttcctaattgattttcatagaacaaactcaccatttacttgacaggtaacattaaatgtgtgcataaaacgtaaaagaagtaaaatgctgatagtgtatcataacaaaaatatttaatagttcaatcaaacaataaagtgtcctgatacggatttccctcgtttcatattgaacacattgctttaagattcgttaagttttctaaagtagtacactgaagcatagccatcaaactagaagtatgctgccaagaatatgtcaagttcagcggagtgaaattgtctcacgagttaccgaaaattggtttgccatgactggtgacatttcacatgaacctgggattatctgccaatgtttaaattctcctctgaaccctcttgaaatgctaccgctcctgctcaaatggtccaaattaaatgatcttgacaatagaaaaaatcgaaggattgacagcaaagcaatcatcacttagtacacaccccatcccaccaagaggtacaccttgcgaggctgaaggtttgtcgctctccctcgtgaatggatcaattggtgctttctgacaattattaagtttcaagttagaagtgccataaaaaagaagtacaaagtaaaggcgcaggatttaacttatacagtatagttggtggtatgacacagaatcaacatattacccttccatgagaagcttcttcccgaatatatgaccagaggcgcagaccaagtttcatctaatagccacgaggagacacaactcaatcatgttgacatacataaccagataatcttaagatttcagcagaatgaagagcaatcacagccagaatttccatgaactgggaatgctgataattgcatttcctgtaccatcttaattgcttctctaaaggtaacattgaactccttcaatctattggcatgactacttagttttcttctccaagcatattctggtggtgagccatcatcaaagtccagctgcagtattccaaaaggaaatcacaaaatgaagtcagtcatgaaagaagccaaacaaaacaatatgatcttacaaatccatgtcatattgtgttattcttggcatacattttaccagaactagtcagttttccactgtaaaagagtaaagatataactgatgaatagagtgcaactttgggtactacaatcgtcagccaaataagcacttcacatgcatcgaaaattgaaaatgaaaagggacagagaccctatatcataatcagcaaggtaacagacttgacacagcaataaaacaggtaaactaactatacaatttacacttgttagcgaaacctctctaagttagagaatgcagtaacaagtaacaacataatatcacaatcttgttactttcacaatatgaactaaacaatctttatagccgattttcatattacaaggaaagaaaaacatcactgctaatgagagcatttgagggggaaaaaaaggaaggggtaaagccctcaccaattgcagggtgctcctgctcacgagatcaccggcacgccatgagcgcttcctccggtagaacatgttgctgctcaccattgctctcccgtcgccaaaagcccaagattatcgcagagaaggaaagaaaaaaacaatttttcacaaaatctcaaactgccccagttggataaagtcctgagagaaccgaacagtcctgaaataacggaagtcgcaggaatgaaacccacaaatacacgacatggggacgaattttgaacgggacgcaaccaagaattcgagcagattaaagcgatagtagctgaacttctaccaaagtaccagccaaaaaaagaacctttaaaatcgctcacaaatgtacccagcagaagaaaatccaggaaaattcaaatcaaattatggacctgagctcgaatcaaattaggcaagaacaagttactccctctcttcataaaaattaaattagggaaaggagcggattcagggaatctcctactggaagaaatcgggaagaacccacgagctgtacccacgggaatggacggttggttcgaggggaagctacgagaaagctcgaatctattttcccctcgcggcgaggaagaagggggaacaagtaagaaatctttgacggctttattaatcctgccgtcgctttcgctgttcctcatcttctcatcttctctcctcatggcgcggctttattagcagttaagctagtgagcgaggcgtataattaaatgcaagtaattaattaactgcaggattagtgaggcaggcagcagtgccgccacatcagccgggcaggtgtcccggcgaccaaatcaacaaagcgaaagccatcatattttgctgagctccccggagggtgtgcactgtgcaggcatttggaggtggctgggcaagttaaaaggggagttttttttcacctcgccggcggcgacgtggcggtgagaggcgccaccggtatctcgcgcgaggatgtcaggatggtaaggtagcagcagcagcatcaccctgcgtggtctaacggcagattattttatcgcggaagaaagataaattctgtgagtaaacttgcagcccatttggttagacggagtttttggtagggattgggagtttagagggatgaggctattgagtgttttgtttggttaggagacataggaattttggtgggatggggatgggaattgagaaaggaactccctccttttcaatgggcctgttcggctgccattcttgctgcagcgctgagcgcttggttgcgcggctgcagcggtgcttcttgtgttagtgatatgccctagaggcaattatagagatgattgtatcacacactatgtttacatatttatccgactttgttcattgaaatagataaactcattattggttaatgaatatgtgattctttcacgagactctttatgttgtgtgttgctatttctaaaggatccctgatcaaatattatatgtggaacaaatatatttagatgatcagcacatgtattaatcgatgatcatgtctcatggatcatggtatagagataccaaattaataatgtggacatatgttgatgaacatgttgttggatagaccgaacatgagacactgcaagagccatatgtgttgtgtcatcagtgatctcatttagtgttggtgttgaatccttagacctgagattatcatagttcccaacatatgtagtagcttacttagggactgctaaacgctactccgtaattgggtagttataaaagtagttttcgggtatgctatgacacatgtagtgggatatgaataatcaagatgggattttgcccctcctatgaagagatatctctgggcccctcgatgttgtagattaaggaagtgcattgtcacgtcctgaagtttccccctttttcttgctttaaaaaaattggttaaataaattgcccgaagaaattgtttttttaacctagagctaatcctcaattaataaatgcatttaataatcaaattcggcgtggtggattttttcttgagttccccatgcttcaatacattaacaatatttttagtggaattttcagagccttggaaataattttaaccaattaaaaatgagcaagtgcaatattttaaatcccatgaaaatctatttccttttttccctcctttttctttgttgggccgtcggcccatctctctcccgcgcccctccctcttgctgggccggcccaacacccccctctctctgggacgccgacaggtgggccccacctgtcaggatgtccctaacctccggccagccgcgcccaagccggcaaccgccgctgccgccccacctcctccgctcctcccacgcccacgccgcgccgctcccgcgtcctccccacatcgccgccctctcccccgcgtctcccgccccgcccgcgcgcacgaaatgggccggattcattttgaatcccaccccactctctgtctctccacccccacgtcgccgacgaaatcgggggctatcccggccacgtccgcccctcccgtgcctataaaatccctcccccgagtcccctctccctttttccgcgctcgccgctagcgcccgtgccgctcgccgctagcgccgccgcctaccgccgcctccggcagcacgccgtcgccgcgccaagccaccgccgccgccgccgctagcttcaccgtcgcgtgggtcatctcggccaccgcctcgcgtcgccagaaccccaccggaaccccatttccctcgcaagctggtgagctatccattcctctccgcccccagccgtcaatggtggccgccgtggtcgtcctctccacccctaatccctctcctcctttcctataggtgtcgccgccgcccgcccacccctcctcgtcgccgggtcaccgccgcctttcattctccgctccggtcgccgtgctcgccggtgaggctcccctctcctccctttttctctcctctcccgcgtgcgccgccgctacatcgctatggccggccggccggttttgtgccgagccgagccgtgcctagccgccaccttcgccgtccgatcggcctcgggccgatctagaccgtcggtcccgtgggccggcgatggaccactcgtgtggtcccggtccacggtagaccggccgcctcgtgccgctgacatgcggggcccgcttgccggcgccgccacctcccttgatgacgtcggccctggtgatattgcgaaataaatcgaataaggacttttctttattagtaaaaacacagattatcttctaaaattcataagtaattcattcgagctccgtttaagtccattcaagtctcagtaaattcataaaaatccctagaatccattaaaaatggttttgcttcctgtttcagtagtcttatagcatgttttgcttatgtgctttgtttgtcgcgtagatttcagccgttttgtcgatccgcggtttctcgaagacgttgttgaggtctcatcagtgcgagagcaaggcaagtgtggacccccgtttttataacaggaatcaatcgtgtaaacagtaccatttacctggatcaagtagtctggtacacacgaattcatagctgaaataccaagtgcacatacacgagtatctaatacgaattattacatcataagcccgcagacatagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaattttatatttgcaagggtgagtaccaaccgtactcagcaagccatcacagcaatgatgcacatgacagaggaattcaaaggatggctatggttctttcgcgcaaagcaagttttgtaattcttttcacaagcctaagacctagcatagactgatcaagtttttaataccagtgttcatattaaacaatgacggttctgtccaccatccattgtgatcccagggatagcttcccgtcattgagtcgttatggttttctgaggacgtccacattcccgcctctcaggaagtggctccatcagcataaaaatcatcatgcaatatctcatcccacacaagttaaagaatttagagtctagccaagtgtaatacatgtcccggtgctcaataactgcgagcacggctattcgaatagatttggtttactcacactgcagtggatgtacactttacccgcactccgcgactgcccaacacatgagcctcgtcgcaacacatgagacgcgtcacggcaaagcttttcgataacctcgcattggcagtacccgctccatgaacttaaatcctcatgcactctagacgtccatgtttctagcagtgagaggagttctggcgctcccgggaaagagaggtctcacacacattaaattatggttcaagttaagttctctctctcacacactcatggcagtcctaccaatggcgacaccgatgtagggcacgcttctcggccctacctcaacggctgtcccatcgtagcgcaactgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccgccccagtcgaaaacagttgtttaattttatttcttctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcgggctctatagttacgtgcaaaaattgatttgaattcggttagaattcaaataaaaatccaaataaatccaaatgaaagtcgaatgcgaaagtcgattcctttttattaattttactatctgcgaactacggcaaacccaatttcaatttaaactattttgcgggtataattatttcgttgtcataagtttttaatttactctccccgagcattgtatataataggttagaaatttctattacgagctaaatatcggacgaaatcctagaaatattatacaatttaatttagcctatggctaaacgattaaatataatacacggctaagattcctagtaattaaatccgaatttcaaccgtgaaccgatgacttatagagattaccaaaaataatctataataatctataagaattcatctaattgtttagctactaattatatctaaattacttacaattttactctaatctgctcaagatacacatttttataattaactcggaatttcgaccgaaatactattacgctcgaggaatttccaaaaataacctatgatcaaccccgaccatttttatttcctaaatcctcctaatttctcccccaatttcccttctattttctccttttcttcttttctatattccctctttttctctcctctttttttttctttttctctcttttctctccctctctttctttttctctcctttttctctcctttttctcttctctgccggcctctcttttctttttctttttcttttttttccttctctccctctctttctttttctttttttttcttctttctctccctctcggtttctctcctccttccttctcctttccctccctcggtttctctctctctcggctctttgcttccccgggcggcgacggcggtgggcgcgaggtgaaggggggagacggcttaccggcgacggcggtggcggcgacgacggcgacggcggcgcaaggtggcgacgcacggcgcggcggccccggggcgacggcgcggcggcttcgaaggtggcggtgcggcggcacgacaacggcggcgcggcggcgcgacgacggcggcgtgtggagaaggggaagagggagaagaggagggaatggagtggggtggagaagggggattgggccggggtctttataggggagaggggaagaaataaggggaagaggggagaggggagacgcgacggcggcgcggggcgcgaggtgcatggcgacgcgacagcgacggcgacgcgcgtgcgatggcgacggcgcgcggcgatgcgacggcgatggcaacgacgcgcggcgcggcaggcggcagcggcgcggcacggggcgcgaggcgcgggctcgcggcgcgaggcgacgagacagcgcgcggcgcggcagcggcgatgggatgcgcgcggcgatgggacgtcgatggcgacggcgacagcggtggcgcgcggctcggggcgggatgcgatgggcggcgacacgacggcacggtgtgacctcaacgatgggacggcgcggcgcgggctcgcggcgtggcagcggcagcggcacggctcgaggcggcgatggaacgcgcacgcggcgacgggatggcgatggcgacggcgacggcgcggcagtggtggcacgcggcgcgaggcggtgatgggatgcacgtgcggcgcggggcgggacgcgacggcgacggcgcggccgcggcgatgagatggcgatggcgacggtggcgcggcgccaggcgacgagggcgacggcgcgcggcggctggcgacgagagagaggggaaagaggaggagctgggttaggggaccgcgtcgaacaccttaggtgcaatgaacagtgccgttttctaattaacccgattttagtgtattttccatataaatttgattccacaattcctaattttgcatatatgcattttactcaatatttgtgttatcttaactaatgaattcacccctagattaatattactcatattttatttttatataatttgtttgagttttaattagggttaattcttattccatcgtatttaaatttaattgatccaaatatggtcgcgataatattttatttatttctgtccccacctaatctttattttaatttgtatgtattttaccaattttgtttttacggtttattcctaattaactattctttacttacgattaataattttcgagatcaaatccagataaaatagacgaataagatcggcatgatgcaattaatttaaaaagtttttgaaaatccgtatttttagagttttgattttgtcggtcgaattttcagggtgttacagcaagtcatgcattacaattggtcatattgtacccaatttacaaatatcccgcatttctattaaatgttgcattcttttacaatgttatgtgggatgggtcctattactcagccatttattgtttaccttgtgccattgataatttgggtttcaaaatgactagatgttggtttaggaaaatgcttagccatgcctagttcaactagtacacaaatggggatcacattattacatagactttgactattagcatagctttggattggtgccaccgcaatggtgttagtttattaaaatacactgaatggtgggctatgggtgcatggttttgctagtcgcacccatggcaattaaggaccggttcacgggaaaccctgggagacttaccgtgcttaccacaagcgggagtgggtaactgcttgatctgaagtatagcttgaccctttccaaggcaccggtggcgagggtgggcgtgatggagttgggtcgtgtaacgacccgcctctcccaggccgggcccacttacatctggcagctttcataggtcatagactgccctcacagaccaacacatgtcttttctgcacactttgtcctcactcgtgtgcacccgggaagaatttcccggtcggtcacccatcccaaattgctccaggccaagcacacttaacactagagttctttggagattggcatccggaaaagaagttgcaacttgttgatatgagtattctattaatcttattaagccgtaggccgggatgttacatcgtttgtcacgtcccaaaacgaccttaaaatatatcctttaaattatgcctagaataattaaaatccgtgtgaaagcctccaaaaattaaaatgtgcaaagtaaaagtcaaacaaggcttagaggatttttgtatatttcctaaaagcctaaaatgtgtaaataaattttagtggaattttcagagcacaaataataattaagaagaaataaacaaatttaaaatgattttataaaaagaaaaaccttaaaattcccccctccccctcttgggccggctcggtccatctccctccccctctctctcctcaccccgcggcccacttggtccctccccgcgcgcgcgccgctgacaggtgggcccgccctccaccctcgctgacgggtggggcccacccgtcatccccgacctcccgccgctccgcccgcaccaagcgccgccgccgccgccgaatccgccgcatcccgtcgtccccgcgtgcaatcaataggggggaattattccccgtgattccctctccctttccccccaattttccctccctctctcccttggattcgtttagaaaccctcccctaatcccgccggcgccattgatggagcctgagaacgccgcgccggtttccttcccctccggccgccctctcccccttccaaccctatttaaaccctccccgcacctcctccgtccgtttccgcctctcgctgcccttcctcctcgccggattcgagctcgcgacgtcgctctctctctccgccgtcgccgccgagctccggtccgccgccgttgtcgccccggaccacctcccacctcggtgccgcctccttcggcttcgccgcatcctcgccgacctcgtccacctctccatttcggtcgccaaccgccggaacgccgccgaccccgtcgacccgagccgcgctgccgccttcctccgctccagccgcctcctccgtcgccgccgtcgcctcggggtgagccgtggaccgccgcttcgtttccccctctccctcccctctctcgtccgccgctccgccgtacctatggtcgccgccggcgaccataggggcgcaggcgccgcctcccgccggccgtgccggcctggtcgccctcgggcgcgccgagtggctgccgcgtggggcccggccgtcagccgcccgcgccctcgggtgcggctgacgtgtggggcccatggcgccggctggtgcgagcccgggtgcacctggtccaccgtggaccgtgaggctgccgcatgggccccactcccatggacccggtccgcgcgcccctccccctcggctgacgcaataaacccttttaaaattagaatttaaatgaagaaattcacaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgccgcagcttcggaagatccgctcttcgtggaggttgaagccgacgtttgggaaagcgagcaaggcaagtcacatcatccttgaacatattgaatcccattttataaaattgttttgatttaaattattgcattatcgctttatttaaattcccgcgttatcactgttttatttagccatgcctatttacctttgttatgaccttattagtattgctattgttattattaccttgttcaccctagaataaacaaaaccccaactagtggaccctctactcatggtaccactagtatgaatttaggtagatgcttcgctggttaattaggcaacattaggtggttttacaactctagactttgggaatattctcatcacctggacactatggaatggttggattattgtggaattggattcacacctccccctctattcaaaatcttcaaaatggttttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgtgctgcggcccggtagtcgagatgtcatggcacagggctggtgtcctgctgctaggggctcagtcctacttacctgtcccggaggttccggccgtaggtggggttgggtcggtactcttgtctatggctaggatgggttggaaactatgtcacgtcttccgcccgtataccgtggtggtgtgtggcacgtggttacacgtgagaaagatgtgtcttttgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccatggtcgggttgccagttcggtctgaatcatcgtaggccttgggttaaggcaggttcgtttgggttcacggccttgattaaaaatattgtatagctctaggattgtatttacaatatagctttgagcaactaagtgtcttttaatgctgtttactgcaaaccctaacccttatattataacccccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctatttcccgtttgtctttgtgtgtgctgggccttcgctgcccatgtaataaattaattatttatgcttccgcttgataaactctaaaatgtatcaacttttggtgtaccttgcctcctggaacaaggaataatacacgcacgtaaggaatgcccgttgggttatttccggtcgtgacaggtcggccggggtgtccggttgtccagctgccgcattcaccgcggcgcaagaggggaccgcccactgcccgttgggggtgggggtgaaaccttagcgtggtgtggatggttaggggagggttatgcggatgatcttgtcacgatttccccctttgcagtatcatggtgatacttcggggcatggcgacatgtgtggaatcgtgtcttgtgggtacagttgtacacctctggccagaataaaactatttgaatagccgtgcccacggttatgggcgatcaaccagattcaccgtgattagtctcaccctagtttagcttaatgaactggtgtagttcaggtggttggttgggcctgttgcaacgtggtgtagcgttggacagtgattggttaatattgattaatctactacaattgttttactgctttcaactactgcttctaaatgcctgctttatgcaaatgaacccttagcctcctttggatatatcctgcatcatacctcctcttccggtatgacttgttgagtacagtgggtagtactcagtcttgctctcttttcccccacaccagagttgaagttcttcccagttggagctaccttagaaaggttggtttcatcgctgccgtcaaggatgcctgtggagtggagtcgccccgctgctgaagtcaagcttccaagtttagttcgttttatctttttccgctgcatttgtaatcttttatatttttttgtaagacgtggatatgtatgtcaacaattgtcgtttgtgtaccctggctggtcctagacaggggtttaatgcacattcagcttagaaattctggttcgtgaatttctgggcgtgacaagttggtatcagagccaaccttgaccgtaggacaagccaactggaaccctaagagccttctgaaccccttttcatctgcatatgcctttttcacttggatttgtttcgggaaaatttggggttttgcctctttggtttgcgggaaaaatcttggtcgttcattcggattggatctttaaaattagctcagtctagggttttagtaaaattttatttggagtttattcgacagttagtcaggaatttatcgggtgatatgcattaggtcgtgtctatgtttgatggggcaattttatgcgcatcattttccatgcatctattttatgcattaagttattgtttagtcagttgcattagtgtctttatctgggttcatgaaaaatgttctatgcataaaaatcaccatgctcggttatttatttgagtcatttgttgctttgtttatttggatttgagcatgcattggttcctatcccttgtccatctttagttgtcagacctgttcctcgatcgcaagcgccgctccgagcttcagagtagccgcccttagctttatcgtcttcttagtctgtttgcttgctagtttccgtgttttaggtttgttgcttgtgggttagtcggcagtcgatatcatgtgtcagtggtatgactgccttaattaggagttatttgcttccttttcagtgttttattcaagattgagataattgcacttaaatttataagaaagattagtttctgagccccctgtttttcttccttttctcatatttctacctatcccccttcagatggtgaagacaaggaatggttcccgtgaatccaacaacgccagtggcagcgaagagcagatcaatggaccatgtgccagcgttctgacaacagtccgtctccaccgcccgagaacccaacgattgctcaggtgttagacaatcagattcagatgatgacaatgatgatgcaacagatgcagcaacagtaccatcaggtgttgcaggaggtgcagcagcaagcacaacagcagcagcagcagaacctgcagtttggtctttcacctccacaatccaaactattagagtttctccgtgtcaagccaccgactttctcaagcaccaccaacccaatcgaggccaacgattggctccatgcgattgagaagaagttgaatcttttgcaatgcaacgaccaggagaaggttgcttttgctacacaccagctgcaaggtcccgcttctgtttggtgggacaactacatggtgacccgtccagctgggacagaagctacttggtcagagttttgtcaaagttttaataaggcacaggttccctagggaattgtggaacaaaagaagagggagttccgttctttgcaacaaggaaccagaatagttatagagtatttgcatgagtttaaccgccttctgcgctacgttcctaaggacgtgcgcactaatgccgagaggcaagaaaagtttctgtctagtcttgatgatgaattgaccaaccaactgatctccaaggactatgaggactttgagaagctagtggacaaggctatctgtcaagaggagcagtgcaacaaaatgaaccgtaagaggaaggcagctcagcttaggacttcccaggggatcagtcagaagcctcgctacacgatgggacatcaaggtggaccttccaccatgattatccggcagcaccgtccttaccacccggg

SEQ ID NO: 71675 - DNA, 1137 bp, Oryza sativa
gaggatcacagtgatcaagatttgtccataactgctgcaactcactagcataactgttaaatttgttgtattccatgtcctccatgcttggctctccttatcagagggctcttcacaaccctcttgcaaaaaatgatccaccccttttgctctcaacattatgagctctcctacaccaactcaaataatttttgctcccttccaacctcaactcacttggcatcacttctagtttcagtttagaccctcctgctacattcctctgacctatcatgcccatcttcaacaaatcctctagcaaatccttcatatcacccttagtgataagtgaggaagcatctacaacctcctttccaaccactgaagacatttctttcttctccttctctcctctcttcagcaagcagcaccaaatttactagcagcaagcagcaaccatacacaacaacaagatcccaatctactagcagcaaccacacacaacagcaaaatcccaaatttaccggtgatagtactccttcctcctcctcctcctcttcttaaatcaaccacacaaaatcccaaatctaccggtgatagtactccttcctccttctcctcttcttgctgttctcttccttcttcttcttctcacccttctccctctttttccctccttcttcctctcctcttcttcctgcacgcacgcgcgctgtggacaccgctgcctcacgcacgcgtgcctggccttctgctcgcgtatgacgctgccactctgggcccaacgcctatgccgccgccaaccacctgctccgggcccagcgcggcccatgcacacgcgccgctgctgccgcctcacgcgtacgatgccgctgctctaggcccagccgccttcctcgcgccctcctcctgctctgggcctcaccccgccccacagatcgccggtgagctagggtttggctctaataccatattgtagtttggttttggggcaatttctcagggggcttcaagcctacacaccccttcatcatccttctattcttaaaaaaaaacattttacaagtagaccctcgtatacattacatatttacaccaagagatataataggaaagccttcagatgtgaagtcagatcatagtagctaaaagactatc

SEQ ID NO: 71676 - DNA, 1019 bp, Oryza sativa
gtattttgcattgaaattaggtatgtccatgagacatgttaacaactcacttactccgtcccaaaaatgccaacctatgctagtataacaaatatgtccagatttattatattaataggggttaatgtgtttaggttggaagcactcaagatagatttaaatatcgagttttaaaatttcatgccaaaaatcataataaaaagttagaaaatattttctaacattgataacggtgtcatctgtgggtctacaaaattgcagcctaaatatatagcctatagaaaacaaaaatgttaggcatgagggagctgagttaaccattttcaatagtatatataagggtaaaataagaaaaaaattaatttaaggtgttcgatccaatgaaatagttagtttgaatagttagtttgagtggacttttttctttaagaaaatagttctatatttaataattctaagaaaattgggttgtcactaatttatgaaagtcctggaagcatcgaaggacctcattcttatgcttaagcatataaatccaagtcatacgagtatgacaatcaataaagatgacaaaccacttgaaaccactcacagaagtaacagggtatggtccccaaacatcagaatgtattaatatgaatggttcatagctatgaaggccaagcccaacatatgtagagcgagtatgtttaccaagctcacaagtatcacacaccagtctatgcatatccactctactaaagaggtctggatacaacttactcaaaaccccaaagatggatgtcctaactaacaatgaagcaaaccgatctccttctaaacatctccaaccaccgcagctagtaccagttcctcatgattgatgtaccacaacccatcacgcctgactccagtcccaatcctcctcccagtcccttctcctagaacagacaagaattctcatcaaatacaacaatgcacttgagttgatcaatagccgaacaaaccgagagaaggttaactggaaaggaaggaacatg

SEQ ID NO: 71677 - DNA, 37047 bp, Oryza sativa
ttgccgccctccgcgagggcgattttgcactgtccggggggccgcctgcaaatgggcggcgagggggcatggaattttgcaggcggcccccttgccgccctccgcgagggcgatttttgcctcccccttataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaataccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgctcaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcatatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgctaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcttcgtggcataacccatccgtgacgtgtagcagcgccccaggacaagatggatataggcctgtttagttcccaaataaaagcttttcgatcaccctgtcacatcgaatgtttgaatatatacatagagtattaaatatagaaaaaaaactaattatacagcgtgtaaattgcgagccgaatcttataagcctaatagtgtcatgatttgataatgtggtgttacagtaaacatttgctaatggcggattaattaggtttaatactttcgtcttgcagtttacaggcgtaatctgtaaattgttttgttattaaagtacgttcagtacttcaaatatgtgtttgtatatccgatgtgacacgcaaaaacttttcacccaagccatagcatgagatatgacctaagcagcgtacatgccaagcccgatgtagataggcaaaagtagtaatccctccatcccaaaaaagacattcgatatattctaacgtaacaaatctggacataaaatatgtatatattcgttgtattatgatgtataggttttttttgtttgaatgggggagtactattttaggtggcactcatacacaactgcttctttaagatgcaatcgatccaagtatttactacggtcacaactactactgccaaactaaaagaaaacaacttaataaaaaggttatgatttggatggctgtgtgtaaatattgtggttggatttttatccactatatgaaaaaatgatttggagatgccatgactagcatgtgtagctaggtatatatgttgaatgaagcatgttcacaagagcatgcagtgagtcagtgacatggagtccagtattggagggcttgtcaataaatgtttcatctatggtgaccacctacaattctaggccatgtttagttccaaactttttcttcagacttctaacttttccatcacatcaaaacttttctacacacataaactttcaacttttccatcacatcgttccaatttcaaccaaactttcaatttttgcgtgaactaaacacacacccctagtgaactacaaatccaacgcagcttgccgtcatcgcagacatggcatccataaaagtcagcttcggctttcaaatgtcacagatcaagacatcttgagctaccatcacaattgttgtacttcttccctcaccaaatccgaagatccatcatctcccataaatcgagactgtacaaaactgagaagaagcaaacaaagcttatgatatatctagaggattatggggaggggaaaaaaatatggtttctgtatctcaaaagtataggaacggtgggcattgggaatggcgttatcgtaggcaaactgtagtgtcactgatgtgaagaacagtctagagcttttcctgatcgatggcatgaagcatttagctatggcgatgtatgctgaggttaccaactatctcggcacgcactcctcaaccacgctgcccgaagggagatgccacgacatggcctgttcacaaggtagatgcggctcgttgtacttaacggccgctgcttcaggcacgtcgagactggtgctgtggaattgtagacttgctctgcactgtctacacctgaatcgcgctgacgctgcagcgatccccgtgcacgtgatcttcggggagctcgctgcgtccgaggcagccaccacaatggtttcatgctgccgtgttgggctccgatcttccgaggccctcgtgggaagtgaattgatggggagcacgtacatggagcaagcaagcctccatgtcctgtgtaccaccttcatcatcctttccttcagcagggtttgcaatctccaaattagggttttttttggcgggccgggggaggggcgaaagaatcgaaattttggaagtttcggaaaatttctgagccgaaattatttagaagttttacgtatttttaatgaatttgaattaacttcgaacaaattgaaaaaatgaaaaaaaacccgtaaatttcagacgagatttgtgtttacctgtgagtgaggaaatttctgaaattgtaataactgccttccggtcaaagcagcatttacctttttcagcttttcacttcactcagagcccgaagcaacaggttggtagtagtactcaacaatcactgtctagtgttagtttttttttttaaaggaacaacggcagaagattccgttctgccggaatttaattaaggggaaaaggaaaaagtttacaatcccaggaatgggatttcaagtccaaaaacaaaataaaacaatcaagggtgcctaaaggccgatcttctaaggtctagatcttccatgacaagatgagctacctgataaactgtacaggaacgattattgaaaattctcctatttctttctaaccaaatatttcaccaagtagttaacagtgctcctctaacgtcctgcttttgatttgtcgatccatcttgatttacttgatcccaccaagtagagatatttgccggctataggatagggactagtagatttcgccaggaatgaacgagagtccaaacttctctgacatacacacagtcacagaaaagatgatttgtatcctcgaatgtagacgtgcaaagacagcatatccagttgcacggccagtgacgccttagcaggttttgggctgttagggttttgtgatgaaggatcaaccacccaaaagatcacatttttagctcagctggtgacttccatagggcatcaaaatccaatcgtgcaaaagttcctgcaaattgataggagtaggcttctttactagagtaaaccctggaaggattccagttccagttaatttcatccggttgttgggagagttagatatcttggatcattccccccaagttgcactaggtcatgcagctcttccactgttgtgaattgtcagaaagaaacaatccaattgtttgacgaaatttcaaactggacacatcgttgctttcgtttggctaaacgaaaacagagaggagcaacatcctttggacataaaccgttaaactgtctagtgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgctaagtccaaagcactagcaggatcagaagttaagcagagaaaaggcaaaggcacatgaagcaaactggcttatatatgtatgcgtcgttgggctctgcacatacatattatgcatatataaacctgagtatatttatagcagacgcatacatatgcaaagaacatgaagcaaagcactagcaggatcagaagttaacacacaacagaggaatcagttcagactaggtattttgccacatgggtacggacccttgaaatgcctgcagtagaaatgataggaccaattatagaaaaggcatgtgacattatgacattacagaaaaatggtcaccgtgtatttttgaccattttgttgtatgaaaatggtagatgggcacatgggggaaaaaatatttgagaagtaatttacacagcatcatatgcaaaggcgttaaatgcaatgcttgtcgtagcttcaagcccacaagaactaatagcatcatacatgcatgtatgtacggaatgtaactcatctatattccaaaatctaatatgaaattcattttttccagttaacaatgtcgatttcaatgtacccagataaaattataggatgtatagtttctaccaagagagaagggactaaagtcggcaggtttttacaatatgctatgtaactgtaagcaccataagcatatgcgataactgctaacccagttgaacggataaaagaagaaattcaaaatgctgctgtccctgtagaaattcaaacaaagtatacttttttatttctcaaacatatgtcagcacactacccacactaaaacagggaatttttttttactgaacttggtgtcatctcagccatttcatgtcatctcaagcagaaaacaaggacaggaactaacctttggtgatgctaggccatttcacttctcagccaaattaaagcagactctaagtcatcttcgtaggcgccggggagagaaaggaagaagacgatgcattaccggcgagaaggcagcagagagcgcggacgtcagatgggaagaggtcgccatcgccgtcgacgctggtgcgccactgcgtcgcctcctcgcgtcgccagccgcgcgcgctgtctcctcgcttcaccagccgcacgccgccgcctcgcatccggattggagctggagggtctgatgtgaggaattgatccgggccaggaacaggggaagggagggaggccaaaccggccccgtttccaatctgggccggccaaaacgaacgacgcttccgagccagaccagatttggaaatagaggccgtttcgggccttaccgaacgaggcctaaggcgttgtcagggatggccggaatggagcaggcggcgctcgcggagcttgcacatgcaccactccaaaagtgtatttgctatgaattaatatacgactcgaggggctagcggaaggagccgccagcgagaggatttctcgagaggtaagcaaattttattttttaaaattttatcgaatgcaagcaatctgccagcaatccagagaagaaaaaaactaaatggtaaacctacccctaatcattgagtttgtcaagtaataagaggaaacatattcttggcacacatgcttcccatgcacactccatgcacaccaactagcaaatgtcacgaaaaattatagaaaaaattgaacacatatttttaatagtattacacatacctatgaaatctcatgttcaaattcattatattttagccgtaacaaaaaagacaaaattttgacagatttttactcttaaaactgtcaggtttttctcctttttattacggctaaaatacaatgaatttgaatataagactctacagatatgtataacactattaatagtacatgtcatatttttttctagaattttccgtgatattttttagttggtgtacatggagtatgcacagaaagcacatgtgtataggatatgttaaaaaatgtccttattaaggaacggtccaaaattatttctgtgagtagtataatataactagtagagagtacagtagcgtttctcatataaaaatgctagatacatcactgccatgcgcagctcaatgtttaccccgaaaaacaaaacgaattatacaaggattctgacctgcaagcagtatactcgggcatcactatcggtctcatcttttctcttatacttataattatcaatcaaaatttaaattttcacctttacatttggagttgattttgagagctttttcattgaagtttaattttcaatatttgcttttagatcactgagaacttatatataaaaattttatttacaaattatttttcgtttgtaaatatgccgttgggccaatacttcttctgtcctaatatgttgctatctaggataggatttgatctatcctaggacaacgaatctggacataagtcctaggatggggtagcaacattttggatcagacaaagtagcatatagctggaggtccagcatcaaaagcagcagtataccaagcaatctagcattccgcctactgcaccagtcggccggcaaccactaggccgcaaagctcgatcgctcctcaccgtcgtcaccgacgtggcgtcttccaggtctctcagcaaatgtgttgctgagctggtggccacaccacctctcagtctcagctgatatactcttgagctgcctcttggtgatgcagtaggccgcagtagccacagctgaagaatgcccttttttttcacgaagatgctgaatatatatcccggtttctgcatccaagcgccgcctttgccagtcaccgtcaagacgcaacttttcatttggtcgacaggtacgtcggcggcgagagaaagaaaaagaaaaaaaaacaaagaagaagcctgcaggatcgaatctggtgccggcctgtggccttggaacaatgttccccggtccaatccacgctgccggccgctagctcgctcaggcgatcaaatgacacgccacacggattctccaccaatcgatctactttcagtatcaatctgctagcacactggctgactggataagatgtactcgttctatttttaaatataacaacttttaaaatttatttatcatgtcaagtaatatttttatatatttaatctgtatttcttctcaaaaaatatcaccattccacaattttttacctattttttcctaatcaatcgtaacctttatccattgaattttacttgttttcttaacaatctcttatgttatttcttatccgtgaagatatagatggatagatagatagtacttgttgtcgaaacatgaattcggcaataataaaaggggttagcgcacgagacctaaaagtgaatggatgcgaagacaaggatttagacaggttcaggccctctcaatgagaggtaatactctactcctgtttggggatttgaatccgccgggtgtagtatagatctgacgatcatatgtgctcatgcccctcagagggcctcctgcccaccttatataggatggggggcaggattacaagatagaaaccttaaccaatacggtatcggtttcctaaatctattttataatattatcaaatcaggactttaggccgctccataatataaaaggaaacgtaatacctaagtcatgatcggttacatattccatagatataagttatcccctatgactagtcggataaccatgccatgtgggtatggggtacccataatctccacagtagcccctgagaccttcacagtcagaaaaataatcttctctcgaactagattactccaaagccgagtgcttcaatcatcttcgccatgatttcccgagtacttttaccaaatatgaagactgtggagggctgaaaaataaagtcaggtgcatcgaatagatgtacctaatagatgcaccaactgaatggttttgataattgtagtcaaccaagtgacttaatattaatatatagcatatgcagtgtgaatccctgaataacatgatcgagtgatataccgactgctttgtaaaatatgatgcgtgcaacctaaagctgactacatcattgaatacacatagcaaaacagctataaagaagcttgtatgttgtgaataaataaatttccaaagtattgggcatacaccatgcgcacactgctttaacagatgtgcttgagcccctaaaagacacatggtttcaccacacctggaaatatatagcatatgtggtataaaatccgagtaaatgaactcataaggatttatcaatcgtttggaaaatgaccaaaatatataatcagcctaagccataatattggtcaataaaaatgcacacttacgtggcaaaaagcaatgatattgtatccaatcaattgctttatgaacccaaacagcgccttgacttatataaaaagtcagcggggagctatataaagcattactgtttggcaccttttaaaatgtattgtaccaactcctaaaaagttgagtaactgcggtataaaaggattttaaggtattgggcacataatcacgcgcacttttgccaaagcaaaaagatgcctaagtccctaaaagaacgtgacaggccacacctgaaaatatgagctgcagacatattaggcctaggccaaaaaatatacctttgacaccctttaaaggattacgcatgtaacatgctctcgagtaataaatctttcaggtgatatagaccaagtgtagctcatatgaatagcttctgatctgagtgattatcctttatgggatactccaaaatagatataacaattgaattccgactggcgcaagtattaggctgataacccatacggggaataataaatagtctagtctttgagcatagaaaatagacccatgatcatcaaattcatgttgcatgtatccggaacaagtccaaattggagatataatcctcacgcttgagttgatgagcccctgagcatatagcttgtccttctgtcatagtcaccattgtccattgatggtagctgacgcagttggcatagagacaagacgaccaatatagagataatattgcccaccagaggtggcaaaaatattgttagtagtgaagatagtgataccaatcaaaagtgatgaagttgtatagccgtggaggcgaagaaaccagtcggcaacagtcaggtcagccagcaatgaatatgaaggcgcccagcgataaagttgtgtagccatagcagcgaaataatcagttggtgacagacgatgcagctagtgaagaagatgaagatgcccattagtggcgacataataagccatccatgaaggcgaggataccggtcggtggtgacgaaagcaagccgacggtgaagatgtagacacgcatcaaaggcgatgacgaaatccaccaatcatgaagatgaagaaaatagtcggcgacgacaaacgcaaccaacagtaatgatgataagcagcaatcatagatgatcaaatataatgacgaagttgcccatcaatagcagtagagtgggctatattgaagaggcttgacaggatgttgattaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacaataatgcatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgataaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagactggaacaccacttgttgtaataaaataacacggcatcatatttggtgacgtatgccaaggtgtcgaaactcttgtagtcgtcatggttggtgaagtagaggcaatagagtttgctgatgccgaagataataaaaatgaagttgctccaccaaggtgacaaaattgcatagccgtgatgaagtgaacacgggtcggcggcaacagaagcaaactagtagtgaagacgcgcagttgtgaagattaaagcaccagtcggcggcggcataaccagtcggcaacggaagacgatgatgtccatcagtagtggtagctgtataaaccagacgtagaggcaagggcactagtcagcagcagaagagatgactagcgatgaagacgataaggccaatcaacactggcagaatcatgcagccatgggagtgaagaaaccagtcggtagaagacgtagacagcttgcattgaaggtgatgatgcctatttgcggtggcggcgacgtggccagccgtgaagacgatagcaccagttggggtcatacgaggtggccggtcggagaagatgtagacgtcctgcaatggcggcataatgggccagccgtgcaggcgaaaacaccagtcggcggctgacgaggcggccagtcggtgaagacgtagacgcccaacaacggcagcataaaggccagccgtgcaggcggaaacaccagtcggcagcggatgaggcggccggtcggagaagacgtagacgcccaacaacagtggcataataggccaaccgtgcaggcggaaacaccagtcggcggcagacgaggcggccagtcggtgaagatgtagacgcccaacaacggcggcataattggccaaccgtgcaggcggaaacaccagtcggcggcggacgagacggccggtcggtgaagatgtagatgcctaacaacggcggcataataggccaaccgtgcaggcggaaacaccagtctgcggcggacgagacggccggtgaagaggtagacgccctacaacggcggcataataggccagccgtgcaagcggaaacaccagtcggcggcggacgagacggccggtcggtgaagatatagacgcccaacaacggcggcataataggccaaccgtgcaggcggaaacaccagtcggcagcggacgagacggccggtgaagaggtagacgcccaacaacatcggcataataggccagccgtgcaggcgaaaacaccagtcggcggcggacgagacggccagtcggtgaagaggtagacgcccaacaacggcggcataataggccaaccgtgcaggcaaaaacaccagtcggcggcgaacgaggcggccagtcagtgaagaggtagacgcccaataacagcggcataataggccagccgtgcaggcggaaacagcagtcggcggcggacgaggcggccagtcggtgaagaggtagacgcccaacaacagcggtgttgtgaccaaccaaccgtataggcgtagacaccagtcggcggcgacgacggcgagccggtggtgatgttctgactgatccattcctggagcgtaagagataagcttaaagccatgaatcccttttatgcatatctggatttggatcctgcagaacaaacatataggatgagtagtatctgatgtaaatataatactcgagaaaaattcaagcattttaaaatgtttataaatatgtatttcttttcttgttaattttgatttccccgagcagatgactcattacgtttaaacactttgcccgactagttatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatacttttgatttattccgaataatacttagcaccttgcgttactcggtctatccaacgagcccccgggtgctaggaattggcccaaaggcaactatccatgacaaaccaaacggaaagcataggaagatagaactctataacttgatagacacttttgtactcagattatgtcgcaagcaatcaagataaatattatgaaaattattgaaaaatatgatataacatctgtagcccccgactcactactcaatggagaaccaattgatgtagtgaggcagaggaaaaggaaaatatcatataaggaataaatgatgacttagctttgtaatattccccttggtgatggcagaggtggccaatgtgggaataaagttgtccatcaataacaatgaagacaccagtcggcggcgacgaaggcggtcgacagtgaaagcgaagatgctcaccaacagcggcataataggccagccgtgtaggcagagacaccagtaggcggcggcaaaggcaggccggtcggtgaagacgtggacgcccatgaacggtggtatgaccaaccaactgtataggcgaggacactagtcggcggcgacagaagtaggccggcggtgaagatgacgattcccatcagcaacggccaatggagaggcgcagccgggtcagcgtgagctatgagaggcgcagccgggtcagcgtgagccatgcaggggcgatagtcgggctcggcagcgtggaagcagccaatcgcgaacttgttgagacggtcgacagtgtcagcggatgtagccaaccatgtaggcgaagatgcaagtgagtgcgggctaacgcgcggacaaatcaagtcgatactccgcggcacggcgacggcctgaccaccacggcgtctcagtagcatatgcaatcaaacaaataattaaattgatcagcagcagcaaggaattaattaaagataaatgcacaaatatcacgtgaggtgtgattggttgctggcttgatgggcatgcatgttgccgatgcatggtcctgtgcatgctggtgacgtgtcatcgtatcatttgttggccatgttgccattcacagccttgttgaatttggttgttgatgatgtcgccggtggcgaagacgaggagcttgaggatggcgagagcgatgtcgcggtcgtagcagggatctgtcgacgtctcggactccttcgcgtgatgcaacccgcccgactagttgacgatgacgacgcggcagcagccgggcagtcctcaccgacattgaagcggcggaggaacagatccgcgactctgggaggacggcggggagggaggcgacgtagtcgtcggagcggaggaggcggaggtcgcagccgcgcgcaggcggcgtagctgcgtgcgcggccctggcgtcgttggtgtccatcagctgcaaccgtctcccatgcatgctgattagatcggttttgtcatgccttgtgtctgtagatccatcttgcagcatcatggcatcttcgttggggtagattgattggctcagtaggcttggtggtggatgaccatctgatccatcagatcgtcgctgccttagattgaatctctcctgactggtttggatccaagtcagagtgtgaaaacttgttaaagttgtcagcggcgacgacgaagcaaaaatcccgaagcgaagtgaagacgaagccgacgactctttgaggtcgatctcagcacatctccagaaattgattccatcgcacttctcaatggaaagctcgacgcaacccttacctggcgcaccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatccgccggatgtagtatagatctgacgatcatatgtgcttatgcccctcagagggcctcctgcccaccttatataggatggggggcaggattacaagatagaaaccttaaccaatacggtatcggttttctaaatctattttacaatattatcaaatcaggattttaggccgctccataatataaaaggaaacgtaatacccaagtcatgatgtcacactccgaactagtcctgagcggaactagcccgtgacgctccaaattaacctgttaatcgataccagtcccatgaaacagtgctgatatcacaggaagacagaatatcacagcaacagaggtctctttattatagagtaggagtacagtcatgttgggctgcggatagatcccgagctcacaactgcattacaaaagggaaacggaagccaagacttggaccacacatgacaggcgcgacttgggaactaggccgaaaccctaaaactcatcgtagccggcttgctcctggaagaactcctcgtcagcgggatccgcttcatcttcttcagcaactgggggggggattatttatatagagcaagggtgagtacaggagtactcagcaagccatgggaaataaatgtttaatgcaggcttcaaagaaaggctgttgtttttgcgattgattttatttaaactcttttctgaaacaactaagggagtgcttcttaaacgacacggatgagacagtgcgtctcgtccggtcggagtatgtgcaatgtttcagtcttttgaattgatcaagattggcacccggccaacagctttcaaacggccacccgggcctggctgatcccatcagccgccgattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccacactgtgccaggaagcccaggggtcttccccgacaccagcccggcgaatccacatgtctcttagcaccatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtttgaaggcgatcatcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgccttgctcgagatcttgagattgatcctcgaaatcctcgcactgcgggtcttcgggctccgaaactacacgcgaaacgggacaactcaacaagcggcgaaaataaagccctattaatgacctctaagtgtgacattagatagatctcgagatttgaggaattttggaagctgaacggagtcaaacggacttacggttgggaagatattgaatttctaagattattggatttttggtctaaaggaaaaaggatttatttaaatctttttgaaaaagaaaagaaaagaaaagaaggagggagggaaattagacttccctcggacggctagggcgcggcctgagagaatggggcggctcggccgagcttaatgggccggccggcccaagaaggcggcccaaggcgcgcgcgcgggcggggaggggagagagagtgccggtgggccgggtccatcccgcgtggtcctgggtgggacccgcttgtcggcgactcggctcaccgtgagcgaggtgcacgcggggtgtgctagggtttggggagggaggcgcggcgcaggcgcgtggttcacggaggacgcggtgcggcgggcccacgcgcagcctcacggctcgcagtggaccgcgcgcgcgaggggcggagagaagcagcgggccggggtctgcttgacccggtcgcggccgaggtggcaccgacgtggcgcctacgtggctgccacgcgggccggcgggaggtagacgacgacgccggccggaacagacggcggacgacgacagcgagcggcggagcgaaccacggcgatacaggcgaaagcgagcacaccgggacgttgcacgggacgaggggagacgagccaacggctcggattcatcgggggatgctcgatggcggcggattacggcggcggcaaccggcagagagaaaagggggaaacggcgatgaggtcatgaggggccgattcccggcggcgagagcatctacgcggatacgggaacccatcccttgcgccggattaggaggaaacgcattgagagaggccggcgacgagaggcgcttccgagctcgggcggcgacggtggcgagcacacggcgagcgacggcagcagtcggggcggcgccggctagctacggggaggctacacatgctactaccgaaaactaaggggaagagatggattgaggagggagaacggggagatgcactaccgtgcggacggggcgcagtgacgatgggccgacggcacgggagtgatctctttggcctcgggccggggaagaggaggaagtcgagctcccggagtccccttccgcgtccacgaacgcaccggctctcccggtgcttggcgatgaacggcggaggcgagacagaggggcggcaatggcgtggtggcggcgagcgaaacgggaggaggaatggatgggaaggcgccttggtttataggacgacgatgtcggtttggaaaccgaccttgggcggtcaaggcgcgagctggcgctcggcgctcgcagccaaaacggtgacagaggcggatgacgccggcggggaggggaaaaggaaaaaggaagggagaaagggagcttgccccttgccactttgggaaaaggaggagggagcgggggcgacgcggcagagggaggaggagctctgcctccgtcccttggaggctagcgcgtggagtggcgggggccgggtcgtgatgacggcgatgacggtggggcggtgtggagcggagcggcgacatgggcggcaggcgcgggcaggcgcggcagatgctgacggcggcagcgactaggcggtcggccaccatggcgcgcgcgcgcgcgggaagcaacgggcggcgcggcgatttcagcggcgtcggcgggaagcggcagcgagggcggagggcgctcggctcggcgcggctcacgcgcacgcgtgtgcagcgcacgggcagagcgggggagagggagagagagagagagagagatggggagggagggggagatgggccgagagggattcggcccatcgaacccgagggaggcaaaatagacttttgcggagggatttgatttgggaaggatttggattcgggattgaacttgacgatagatcggggatttgagatctgagatggcacggacactagacaacaagcaaggaaacggatttcgcaaatagggtttttaagagataatttttccgctaggcgccacgacggaacgggcgctacacatgatcggttacatattccatagatataagctatcccctatgactagtcggataaccatgccgtgtgggtatggggtacccataatctccacacttgtaaagacagatatgctagggtgggtatatgagccgaagggaatccgaacgtctggatggtgacgccttttcagtgagggctggaggtaaaatattctgaatcccggcttgagagttgatgtggagagcagagaccaccttgattccaatccctgcgatgcaagttggtgcctggattctgggcttcttctttcgcagatttgggatctggtggatgtcgactgcatgtataggtgcatatgcagtggctgcgtgcgtgttagtcatcaatacaccgaccatgcctgtagttcatagtctgtatcccagcaaaatgagatgcactggatatgcagtatcaaggggtacgtggtttcaaccccgaggtcatgcgtttaattctcaacatactcacaatatcttacttaaaaaatattgggaggagtgcctctccctcgaaatctcgtttttttcacgtacccagtaaagtttgacacggctaataactcattaacaacgctggaagatagatcataatattcagcaagatttttaccgtggtaggaaaccactcaacctagcggcaacctgcaaccgccatgtcagctgctcattctgcttgttgatttgtcttggcgaaaaaataaaaatatattttaaaacgtagctgattttaccgtttctgttttccaatcttgaattccaaaccattaatactaataacatagatataaaagtttatccataaattacttttgcttgttttctttacattgtacagcttatcagttgtagctcactgaaacgctgttaatttccatagacttgatgtttgctgcaaaactgttagcaaaagtgaattacactagcatggattcgacaaggaaaaggcgttgaaaatatcgcagggaatcatgtatctttgtgagaaggcgaggcgctttatgtagattatattccacggagatctccccagaccggaggctcgaggttgcatatgtatggtttgcttggggcaacgcagccgcaacaatcagctggacacgaaggcctccacatcgtagaccatgctgcttttggagctttggagatggagcaaatcttccatgggcgctggaaaatctctcctaattccatgggcccagcatgctaaacctaggagcgaatcacgcacaggatggatggacaggaccatggataaagaaaagcatcactttgatggcaaaagccaaattccttctccaaagacatgggagttgcagatggtgagatccattcgttttcgttggatggctctaccagtttttactttgtcaagcactactaaaaaaagcatttttcccgacgtggaggtctttttttcgcaagcggacataacccttggaaccaaataaccgcctaaaaaaataaatcgggggtgaagttcgctgtccgcctctgtgaaaatcgaccacttaagcggcaggcaaaccgtatgtggtccgcctgcaaaaattgtgcctacccctccccaccactcatttccctctctcaactctctatctctccctcaacacttgtccctccactaggctgtccccttcccctccctcccgccggaggggaagcgatggcgacggcggcgagacgcgtggccagcggggcgcggggtggcgtcgacgacgcgtgttgcgtggcggcggctcccctcccctcccctcccagatctgaccagagggatgccaggggagggcggcggcggtgaggcgcgtggccggtggggcactaggcggcaacgacgacgcgcggggcggcggtggcggctcccctcccctccccttccaaatccggtcgggggagggcggcggtgacgacgacacgcggggcagcggcagcggctcccggcgcagctcccctcccctcctagatcctgccgggatgcgattttttttgttcgttcattggatttcctgcctgattttcacagtcgttggtctgcaggcggtccgccccccgcctggaaaaattacttttggctgcctgtaaaaatgttttttctagtaatgaaggtgaaggttaaagcgatcaaaaaaggaaaacgcatcgtcctgacacgttcgccagatcggaagtcaatgagcgtgcgctaactagccatttcgatccacgtttcctccccttcgtatcgtcatggagaaggccgtgggcctcagctatatctctccctgctaaatgggagaacagcgcgcctactcacatctcactatgcagataatgccacgatgttcatctgaccgacaaagagagatatgagacacctcgctcgaattcggcattccttggggaaagttatgggcctctaaaccaacatggtgaaaagtcagattctgcggcgccgttagcgacctacaagatatctcatggatttttcccacaaacatcaccagctacccgataaagttcctcggcctcccgctggtgatctcctaattcgaaaagatacatgtccaaccattgctcgataaatgcaagacgcggttggtgcctttgcaaggaaggatgatcacggcggaaggaagagcgactcttactaaatatgtcctcacggtgtaactaatctactatctaacagctttaaagatcctagacgagatactacactcgatcgataagatgaggcggaagttcttctgggcaagaagagacgacacatcgtggggatgtgcaaagcaaatagggataaagcctgcagagtgcagacctaagaacctgggtggccttggtgtgcttaacctagaccagttcgccagagcactgagaataagatggctgtggtacaaatggactaaaccggataaaccttggaacagcactgcgatcccctgtggtcaattggacagaaacctcttcatggcgcgacgataatcactctagggttgggaaaacggcaaccttctagaactcacactagctagaaaacaagatgcccaaagagatcgcaccagtaatttttgtggcttccaagcgcaaaactaggacggtgcacgatgccctagcatccaaaacatgggtccgagacatcaacctccccttcggattaaggcagcggatcatctacgacaatacgtccatttgtggactatgatacaacgtgtgggtcccatgagtgagcaaagggacaccatttacctaaaagctgatggctaatgcagtctgctcggccaaatctgcgtatagactacaattcgttggagcgaccgaaacgatctacaactagactatctcaaaatgttaggcctcgcctaagtgcaagttcttatcaattatatactaaaagtccattaaactttctagaaacgctcttaagccgccacgtgacgttcttacaaatacaattagaccgccacatggcactatttaatcttaccgttaatttccatttaaattagtggacctaatattctagaccgttatattagatatattattttgagaaggtaataatttcctctcataatggggccgagaaaagaaaccaaacataagtatacttcgtatacttcgtgtacggacttacgtgctggaaaagaatcaactaagcttaaaaaaaacctaagtacgaactgacgataaaatcaataaagtaaaaaacaattacgtaacatcaacgaagcttaattaaaagaaaacctacgtacgaactgacgataaaatcaataaagtaaaaaacaattacgtaacatagttagtacgtagtgccataaaaaaaatcgatggtccataatatacgattttctactatttaaaaataaaaatataatactctataaacttacgcaaatatacatagttaaactagatcttctataatataaaaaaatatcctatctttaaattattttaaaattatatatctaatttgtgatccagtcggattcctttaattaaataaactattgatgtctatcttcctaaatacatcataacacatgaggctgacatataataaataatattatgataatatttttaaggaaaaatgacgaattacccttaaactgttatggtcgaccgaattacccccataaacctaaaagctagacatttttcacactcaactattaatatcggatgaaatacctcgctgacacagcttggagtggtggcagtccagtcagtattttcttaaaaagaaattgatgggacccacctatcgtatctctccctcacccatcccctccctctttcttctccctccatatctatcaataggcaaggctagaggcagtgagcaggtcctcctcagtctccgccgacgcgcacctccttgatggccgtgtggcttctcctcaacatccactggcccgtgaagaggacaacagcggtggaggcgactaagggcggtgagcagcagaggcggctcctcctcgactatctcgggcgccacatctgcactccgatggagattgttttctccatcctttctatcacatctcatcgtcacgtgatggctgccagaggcgagcacctgcgttggtcctccatggccaggttcggctgcgccccgtagctctgtctacaactgcatgccatcccaccatagttcttaatcgatccccaccaccaatgcctctctcctgacgagacagaaagcaccaatcaatcaaagaacgacaaggtagatcaattaagagagcaagtgcaggggaatggatgaaggagaaaggaaaagagcgacggggtagtggcgtgcctgctggttggcccctgtagcaaggagaaggagaagagagagagaggctgaggaatgggattgaggaagagagggagagagatagagagggtagagagtgtgacaggtaggcccccacctaatttattttttaaaaagtgctaattggactgtcatgtaggaacaagaccactccaggttgagttaggggtaattcgtccggtattaatagttgagggtgaaagatgtttggtttttgggtttagggggtaattagtacttttttttcctattttaaataatttcacatcatatttcaggtgtcaaatatcacttgacgactatacaatgctaatttaaatctatatacgaaaaataaatgaaaataacacaatttagttgtgtatttttaagtatttgatttaatttaatttgtttgggattaagattctcaattttttttcggaatctttacaactatttatcagtatgtaataagtgggcaacataaatgttgcatagatgtaaaaaaaattgtgaaaaaaatatttcataccaatgatcttgctataatacaaccatttaatccaccatgagatttatggtcatatatctatgtttttctctttgtcaaatagttttggcaacaaatgaacaatcaaataatatgtgtaataaactactcatgatatattttcttatagttgaggaattccaacacatcaagtatcaatttgatggacgtatgttatacaccctattgaagtaactataaagtatacttcaataaattagttattgtaaataagtttgggaaaatagattcattatctaaattaattagtaaaagtgtctcatgtgattatgaataataggtgttgcaaaaaatcaaacgcaaaattatagatatttctcaaaatataaccaacaatgtgatgctttagagattattgcggtagttttttcaaaataaccctttatcttggttaaaaaaatcatgtatagtacaaatagaaacaactccagcattccattattgttccattatcgtgacacatgttcttaattaaatttaaggttatacggttccaagtaatatatccaaaccagatattaacgaaaacatatttaaaatagagtcaagatctattttaaaaatatcatctacatataaacattcataaaaaaattcaagcaatattaaatatgtgtccgcgcatatgcgcggtctatcttcctagctatggctaacaatccaaaacaagcaaacttcaaaagaggggatggatgaaccagcagctttgccctccatgccacgcctcgaccgaatcagcattacacctgctggcaaagcgtgggctgcccaaaaggatctgggcagagatagagatagacaactgtggacctctagttacaggagtgggattgtgggaagcttgctcatctatatatggaggattggtggtacaaaatctcatagtaacctcagtacctcacaccctgaggaaggccctaaaattgatcattatcctggtggcctgggagctctggtgtgaaagaaacgtcaggatttgtgtggcatatagcaaccatgccaaccaccatcatcaccaagatcaacgaggcataaactttgatcgaggagggggctacaaagctcacagagattatcccctccggagagtagtccccattgttctttttgtgggtttgtgttgttttaacatagacctagtaaatatttcgggccccttagaatcacaggaatgaaaaaacggaggaattggaaaaacatataatcttgacaggaatacaaatgtaaaacagaggattgcaaaatacaggaaaaacataggaatgaccgttttattgagccggaagaaaaacataggaatttgaggagagataaaagactcaaattcttaacatgaggaacctcatgttaaatttcctccaaaacttgctgggaagaggcattccatagaaatttcatgggattacataggattcattcctttgattcaaagggctatttaggaaaaattcctatagaaataaaattctttaaaattcctatgaatttcctttgaatcaaagaggggccttcgtgttgacggtttttttcctccttctctatcaatataaaagtgacattaaagcttttggccgtccttaagaaaaaaggtgaaggttacattttggagttatacttggaataactactactcctgtcgtaagtatttgacattgagaacttgagatagttggttaaaattttaaaacttttatactgaaattgttatacacatatacatcttataaaaatgctacataattttgtaaacctattatattttataaatttattttcatataaaatttatgatcaaagtatttataaccggtaggagtttatacacttacctattaaaattgtacatatgcattccttttaaaattggtgaatattggagcacaaaaaaatggcttgaaagttggtaggcagagtgcatccgacattcaatagtcctaatcatttaaaccagcctaccttccaagaagaatataatctattaacttaataaaaaaatataagaaagtataccacgtttgctcttacgtcttagaaattcgtacattaattgaaataaaaaaatagagtacatgtacaatacaatttagaaaatactgaaatgtattaaaaataagaaataattaatattgtgataagactacatatagaaaaatacaatttaggaaaaaatctaaagcttggataaaaacaagtaatattaagagaaagagtccacgtagaaatacaatttagaagtagctagtgtttacattaaaaataattttttatggagaaaagaattcatgtaggagtccaatttgaaatttttttaaactcggactaaaataaacaatatatatatatatatatatagagagagagagagtccacatagaagcataatatcaaaatatcttaaattttggttaattattattagaggagatagctctttgaggagtataatttagaaaaaaaatagtcagtgaagaaatacaatttaaaatatttattaaaaaatcggaatataaataaaaaagattaaaagaagagtcacgtagaaatacaaggtcgaaaaaacattaattttggattaaaaattgaagaaataattaatattccgatgagagttaatctagaaatacaaatacaatttagggagactataaaatgcagattaaagatttaaaaatgattactattgtgcggtaaggaccaaagaacaaaatccaattccatcttccgaggtcctggcagccaaccggagatatacttattctttcatttctttggtccagaaagggctccaaaccttgttcaacccatgctttggtacatattctactaatctcgtgtcgtgtggtgcagcccagatggattgaacttgagagcacagaagagttcctgtaggttacccaacctgctactacatatttcaagactagctaagattggtttaagattgcatttatatcagtgtttagttttgcaagtaggccatctgcttattgttctaaaagatttcatgtcatctgctccagcatatttagttgctatccacctgcatctatgaaaaaagttgccaatgctaaattaatctagccttaattaaatataaagttgcaaacggcattttcttcccatcttaatacaatctgtcagcttgtattcagccgatacggctaaaagaatttcattttctcagagatccggcgcagcagcatacgaattgaatgcacgcgtctaaacaaatactccatataacagtaaataccggaaatcgtatagtaagaacttatatatacataattataaaccattcatttagtaagaagactgccccagcagctgcttgtttaagtcttttaggaaacatatacaagtcagtaacaagaaatctaaaatgagtaacttattaattacaagtgcagtaatcgcagaaaaaaatagtattttgtactccctccgtcccagtacagtggacgtttttgactttgtactttcaacgtttgaccattcgttttatttgaaaaattagtgtaaatataaaaaaagataagtcatatgtaaagtacttttgataataaagcaattgacaaacaaaataaataataatttcaaaattttttgaataagacgaatgatcaaaaaactataaacaaaaacttaaaaagacaagtatgggacggaggtagtaactctattactctatcaccaccaatagtaacacactgctgatataggtgcatgaacctcggtccttgtgaagcatatccccagtaactcagaatgaggagcattatatatgcatgctgagcccggatgatatataattgcacgcatggcatttcatgatgcctagtggggcacatgcgtgcaggtccaacaaatgtctccctcctatgcagggagagggtgcagacagaagcatctccattgccacaattatacctgtagatcgatgcatcatgatgaatttgacatttttattcgatgggcatgtatttgagatattgacattatgcaacatcagaatctacatttgaaagaaagcacttatatcttgccatcttggaatcgaccgagatacgatatacacccttcccttcttgtgggtcctcaacagagagcatcagaatctcactcacctctcaatcttccaagccaataacaagtgtgtacagtagagctcacacaaccacacacttatgaacacgagtacagccgatgccctataaatagccgccaccggagcacaacagatatcatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatggggggcaccaagacagccgacgaggtgcgcctccacttcgagatcctcgtggacgatatcaagctgattgaggcaaggcgagtcccgttccccaagtacaatacacagggagcatggaactgaccgactgaggtaatataattaactactcatcctgattcaatgctctcacgtccagtaataataaccgcgtgttgctaattaacttgctatagctcttcaaagggagtagtcagcacgtgttgtgataagtttagaatcctgctgcttagcaacacaatctgcagtttcaatctagcttaattgtaagctgatagctactgtaacatctcataagaacacatatgcagggagcatattagatgtcagccatggaaatcatgccctagatggttgaacttgagcactataagctaggggttagtcagttgtcgttttctttgttgttctaatttccaaatgcactgcaacatgagagtatctgtactttctgtaacagataaatctggtgaaactaacagctagctcataatttgagcctgtggcaaaccatcatgcacacaaaattagcatgcagttctacgcactatagtatatatgcaccatttcgtgatttgttggtttgcacataggccggtataggaacacgagctagccctaatttggatatatagtgacggtttttcccctaatgccaattattcacgtgtgatctacaaccagaagaataattctctgataccaaagaaaagaaagtttgaatcatgcagtctaagcaccttgagcagtacgttgtgcttaaatcagttccagactagctaacagccaacaggtgctttaaacatctctttttcatgtcagttcatctggcaaattaaaaggtgatttctgtcttttcaagaggcacaagtgtgatgtgtccataggaaaaggcaatttattcaaagttatcctgtactctcttggaaaggggacacaaccattgtacgtaaccctagaagagggagctatatatgcgtacctcattcttctcaaaataatttaatttgtactaaatagataagtaacctcaatataccacacctagctagcatgcctacatagaaagtaaatctattatatactaaaaatccattaaacttcctacaaacgctcataagctgccacatagcgctcctacaaacactcctaggccgccacgtggcactatctaatctcaccgttgattttcacttaaattgatagacccgttaatttagaccattagattagatctattattaaaaaggtgatagtttttcctaaaaaaaaaatgcaactggtgtccctacgcaagtataattgaaaaaaaaaaataaagcttcctgctgttaggcggaagaaaaagaaataaacatctatgtacgataaaaaataataaagccaaaaaaatgtgtagttagtacccttggaaaaaacgaagatctaatgtaggactttgtataatataaaatataatattacataatatatggaagtataggcttgtaaactatatctataatataaatatcaaatatcaaatcaacggtctctacgcattatgttttaaattatttttaattatatgcccaatttatgatccattgtattcgttaaattatataaatatcggtatataaaagtaatgttgtggtcttaaatacatcatgatacatcggatcgacatacaataggtaactttagagactaaaaatctagctatgtggcgctcctacgatcggttctatccaccacgtggtgctctaataaattagagaaaaccttatgaattgtgagaaaaaaacatgcaatcatttttattggtggacctactatttttaaattattagattagatttatttaaaatacatctaacctgctcgaataaaaaaaaccgcgtgaatagttgtacgtatatatacgtacttccgtactttgctactcacttaaaaaaaggaaaaatatgtaattacgattgaaaaaaaaagattagccctaccacggtcccacctaattgttacgagttacacgtacatatgtactgttcacccaaaaaagtgaaaaaatatctcaaatgtgccatacctactactactcaccggattgagaaaaaaattctcctgggcatgtacaaaccccatcatcgactttcacttaaatcatttagagaaattagaaaaataaaatctccacc

SEQ ID NO: 71678 - DNA, 699 bp, Oryza sativa
ctactgtattagcatccgcagtttgctcaagtttttcaccagatcaggtttttcaccagaaaaacctgagctcgccaaacatccaaaagaaccgccgatttgttgtggcgttgatcccgagtcccgcaaaacaccaaatgaatccccttcccatcataataaaaagaaaaagaaaaggcaatgaaattactaagaaaacaagttgtctaccaaaagtcctcacttgtatgcatgttttcccaaacaacaaacgctatttatcaaagtaaacggaaatttggttaaaaaaacattagttgcacaaaattattacacgacttgcacgaaaattcaaaatggctactacaatagtcagggagcgcaactagcgtagatacataattttcagaaaaagaaataatgaaaatttagggccatgtgctgatcgaaagcataggttttagtttgaggccatatttaaagcagtaaataagtgaatcacttatacaacataactgtacgtagcatatgaagagatatgctttatactgtccatttatacagtactatcgtaaattatattgtccatttattctctatattttagtttcagattaatcttactgtttccattaatctcaccctcgtttgcgtttgccactgtcatttgctgagttgctaatgacacagaccgatgcttttgcgaattgcgattactct

SEQ ID NO: 71679 - DNA, 603 bp, Oryza sativa
ttcctaaatataaagcatggatggatttaatttttattaaattctccatgattaagtctactctctgaaattttctcggatttttcggagctcaattcctaaatgatacaaagaacagttcagtaattatttgatcattaatgatctaattataagtgttaagagcttttcttgtttaaaaatccttaaattataaattgttgtttaaaaggaattattagaaatgatcttaaaagcctaaaagagaagatctaattttaatttgttaaatctcaatataaaattgggctagataaaattttgttaaatactttacttgattctatagttcctagatttttctgggatttatttgagccaaggaagtatttcatgaataatttaaattgaaaaaggtttttaaaagtctcttttggctttgggccgaaagccggcccaaaacctctctttttctctctccctccccggcccagtcggcccaatccgccgcgccccttcctcctctctctcagccgctgacaggtgggccccacctatcaggcccgtcttcctccccgcgccgctgccggccgaaaccctagccgccgccgctttccaatccgg

SEQ ID NO: 71680 - DNA, 16107 bp, Oryza sativa
ttacaaaagattgatacattgtaagggggaggagaagatctgtttccaaacagagattacaaatcgatcatcttccgttaagttctctgcccaaagagttgcctcggtaatgcatcgttgtaggcaggctcttaggagactccagtgtgtttttctttaatttgtgctagcgtcatccatcctttcaacatccagattattgtcctagctcagctttctgttaatttcccactgtcaatatgcgtaattcctctagaacaactgcgttttcagcgaagaatttgaccagacgaactccaaaagacttggagttatcattggccaacttgaattgcaggctaactctcctcaaactgttcttcaagcatgcgaatgagtagtaactcaatccagggaggaatccatcgtcgtcatcgcaatgatctcgcaagaaatgatcgataaacgagtcaaaaaccaacctgagaatttcttcgaaagaaatgctgcactcgtttggagttcttggaggtgccgacgagattcagcttgagctcgcgaagcaccgggcagcaatggaggatgctcgcgaccgccgccgccgtcttgttccaggtgtcgtaagctccgtcgagctcgaggtgctcgatgttggggaacactctcacgaacgccatgtcgctgaggtggcgcgacgccggcgccttcagcttgagcaccttgatcgccatggtgaagttgtggatgaagtgtaggtagtcgtgtcgacagaaggcgtgggtgaagtggaggttcaccaatgccatgtccggcggcggcgccggcgagatctgcaggtcgaacggctgaacggcatcccccttgtatgtgaaggatcgcagcctcggcgcgtagatctccatggcgccggtggtgtcgcagttgatcagcacgagcacggtggccgccgggaagcggaggcgggtggaccagactgtccagacatcggagctgtggccatcggacacgaggtagacggactcgaggtgcacggtggcgagcactggcgcggcgtcgatgacgcggtggagatcgtcgatgttcgccgtacaatgcaatgccgcagccgtagcgtgtccagccacgggaaggcggtggcggcggcggcggcggaggccggcgtgaggttgcggcagttggtgaggtccagcacgcggagggttttcgacggaagggaggcgagcttgatgtcgtagatcctgacgctgccgctactgatcatggtattaatcttgtcgtgcccgaaagggtgcacggcgacggcgacgcggagctcctcgacgcggcgcgccgccgggtgggagaccacggcgtcgaccacgtcgtgatctctgagcaagttgtacatggaggtgcagtagccgctgtgatctccgtcgtcgacgtgtaaggtgagcctcgtgacgacgcggccggcggcggcgagcgccgcatcagcggcacggacgaaggcgtctctgccgccggcgccggggacgcgcgcggcgaggttgaccgcgccggatgagcgccagagcgcgccgaaccgccgcgagagcaagctggtggacgcggcctccacggcgttcgcgaagtggaggacgcggaggaggaggtcgtcggggagggcggacaggcggtcgccgccagcgccgattgccatgggtgtcgtcacctcgtcggcatgcaccgccggcgattctacacgacgcggcgacggagatcagatcgatcttgctgtcgaagatgacatgtatcgatcgggtaagtattgtggcggcgaatcggccgaataaatcgtccgcgtctacgttcagatcgctcgatcaccagatcgagctctggcacatctttcgcatccctaggtccacatatcgctcatgctcgcacttcgcggatcagaattaacaccagctgctttattaaagcggagctagcaccaaaacaagagtggtgcactatttttttcggacgcgcaaaaagattacatgttaatatattagaagaatagaggttttgttacaacgcaatcggccagacagacctatgctgtgagggagaaaaccactctaacaaccagctgcgaaaagagaaaaggactactacagaaagaaaaactactccaacaaacaaaagggagggggggagggggggtggtgccacactatgctctcagcaaatccccagaaacggcaatgcctgtggcagagcacggacagccttccgagtggatggaatcaatgacaacggggactgaggagagagcagagtcgaaaaccctggagttctgctccttttcacagcagccaaagagactaggaggaccaaggagttaaagctagagcgaagatactcgggccctagaagacagccaccagtccagaagcaaactgccgtgggaaggggagagggcagtccaaccatgaggcgacaacaaacggtgtcaagtctgctgagcgaacacgcaatcgaggaggatatggttcgctgtctcaagctcttaagcgcaaaaggggcaaagcagagtgactatcgatgcctcgcttatggagaagatgtaacatcctgatttttcgtttattttaaaaacctattttaaatacaatctttgaaagtcctaatacaacgaaatgactattcaataaattttaaaaagaattatgtgtaaaactagataattttgtggatgctagccgcgtaattacgtgggtcacccagctagtttgtttatgacttgagttttccatttaaagatgagagtgtatcatagcatgttcctccaacgagtagcagatctgctcgaaagcttgtgcgtgatcgtcggccaatgcgacgaacaggtcgacgccgccgccgtcgccgcccaccggcacgaggatcatcagcccctcgatgggcaggtccggcgacaggacggcggccggcggcccggtgccgaggtccatctcgtggaacctgaacccgagccagctgtccacctccaggtccgggcacagcgtctcccccggctccgccgccgtcgcggcgagctcctcgccgcgcgcgtccgccacctcgacgtagtcgacgaacgactggatgtactcggcgtcgacgcgcgccacggcggcgcggatggcgccgaccacgtcgcggtagctcgagctgagcaggcgccggacctggagcctcgggaacgcccagagcaccatgttgccgaacaggtccgccggcgccggcgggttggccctgcgcctgcagttgacggccaccctcacccgcgtgaactcctccggcttcaggccgcgcgccgccgtgatcttcttccacgcgtgcgcgagaacgcactcgaacgtgctgcaccggccgccgacgcgggccttgagctcggcgacgaacttggccgtgaagcgcacgccgatgtttgcgatcttctccacggcggcggcggcggcggcgccagacgaatcgctggatttattacctaccttgaactcgattgaccggtggtcgaacaccggcgccggcgggctgcgtggcacgccggtgatggcgcggtcgagggatggagacgggacgatgaatgcctcgctgtcgcgcaccgccctcgcccacgtggcgcagaaggtgctcatggagtgtccgtcgaagacgtggtggtggccgatgaggccgacgacgaggccgccgcacccgaagcgggtgagctgtacctgcagaagcgccgccccgaagctatgctccggtagtgcggggtacaggtcggtggcgacgttggcggcgagcacggcgtccaggtcgacctcgacggtcgcatcgaggaccagcacgccctcgttgttgacgtgcaggacacgacgacggcgccggcgcccctggccgtcgacggcgatgcggccagacacgagagggtacgcggcgacggccacccggaggccctccttgaccgcctcgctggacggcgccggcgcgcggtaggcgaacaccaaggggacgaagacgtcgaaggccgcgcggtcgaaggcggagaggggaaccttctcgccggcgagcgggtgcggcggcgtcgtcgtcgtcttcagcatcgcgctgctcgtgatctccattagtgaactgtacgttctcttgatcttttgcttgttggtgctcttcgagaggcaccaatggcatcacatatatagagagcggaggtaggtagctagctagctagcttcgagagatgataagaattaatcgattcccatttttaaaagtgttaaattatcgaatctctcgtagaaggctaggggcttggaaaaccattgccagttatcagcggaaactagtggaaattagacaaattttggtaaaaccttaaaaacgagacattaataagaaactactatatattaagagagtcgtaggtgaagaaataaaagtaagatgattatgattggttgagataagactctaaatagagaagttagtatattgtgagagttatatcttgtgacggtgcatgaggtagtatttcaaaacttttcgtaaggacaaatctagctaaagcatttttcaatagtttaatttaaatactaaaagacattttatgaggcacagtataaaataattgactacatctatgtatatacacaaaacataaaatttcttgcgtgcctatgattttttctcaatcccttttatgtttttgaattttgtcttatctccttcgtattcttgagttttcattttaataccccatatacccccttcatttgttgaatgtgagttggttcttagatttttttccctaaaataaaacgaagcacgtattattgcatgattaattaagtattaactattttttttgaaaaattagattaatataatttttttaaacaactttcatataaactttttttttacaaaaaaaacacaccgactaacagtttgaaaaccgtccatacagaaaacgagagaggtgggttgagaaaactggggaagaacacagcctatattgcctctctcatacttatgtgctagattacagagaaaatacgtacaattctcaatgtgatttttttaacaaactcaaatgggacggaattatttgaacccatacctgaataacaaaatttaaattctcaaacataacttttaaacaaatgatgagttccatacgaaagtttcaccggaattgaaaatcaaaattattttatatttgggcttaattttcgttgaaaatgttatatgaatatcattgaatatgatttgaaatttcattttaaaatattaaattttagttttaaaattgtgctcaaataaatataatccctttattttctttttataaatgaatcttatcgcattgagaattttgttcttctcaataaattagcacagaagctagtatgagagaagaacacgtacataacattttttgaagatactagctatcaattcatggtcaacaactcaggacataaaagatgcggaaaaatgcagaggcataggagggatacagcgaaaactcataggtacgtaagaattttcttctatacaaaatgtaattttttcaaccggaggtacgtatcgtgtgtatatttttacagctcagaaaagtcaactatgtagaacttaactaagcctgatcgatgcttgacttttacactagggacatgaggttgtcaatttggtgctccctaggtgcaagttggtagggttgggtacgacgtacgtacgtgctgcatgcttccagtagacttggcatgtggaccctgtgcctgtactagtcttatactcccttcgtactcgtaaaagaagtcgttgaggacagcgacacggtcttcaaaacacaattttgacttcttgtatctataaaaatatttatgtaaaagtaatatatgtatatacttttatgaaagtatttttcaagacaaatctattcatataatttttaccttttcaaaggtttgacttaaatattgccctaaacgacttcctttacgagtatggagggagtacgattcaatttagtatggattaattgcttcaagtcttgttcattcttcacaggcatatatgtacaaactcaattcaacggtctaatattattcgacttttgagtattacaaaaatttcggctgttgaattgtggaagttttttctgaattcgcacgcgggcatctgctaattattagcacgtggcgtggcgtttcagttataccctattactatgcatgtgttaatgtgaatgcacgtatggcaagactaactaacggctaacggaagaattttgttacttttcattccgagtacgtctccaaattaagaccaacctagctagaatatcttagacttatactacctccggtttttaatagatgacgccggcgactttttctcacatgtttgaccattcatcttattcaaaaattttatgtaaatgtatatgatataaatcacacttaaagtactatgagtgataaaacaactcataacaaaataaattataattatgtaaattttttgaataagacgaatagtcaaacatgtgagaaaaagtcaacggcgtcatctattaaaaaacggagggagtatatgtttgtgcacgtctgaactttctttcaaatccggataatgaaattgcctgttctcttgaaagagagtctcttctctaaactacctgagttttttttttctcccgtgatcccatcccaacataacattgatcatagactgcacatatagaacatcttatgtcacatgcatgacacattacttagaatataatgttgtagagttgaacatataagtatatgtgtttgcaattccatgttctcacctcatctccctcatttttcacgcacacgctttttaaactattaaatggtgtgtgttttacaaaaaaaattctatatgaaagttatttaaaaaatcatattgatcctttttttaaaaaaaagcaaatacttaattaatcacgcgctaatagaccgctctgttttccgtgcggggagtttagttcccaacttcccatatctgaacacagcccaaacaaatcatctttctcatattattttcacaaaatttcaaaattcattatttctataatatttaacgtatattcatctattaatttcgcaacaattgcagagtgaacttttacaacctactactccgtccccaacgctgccgcgacaaggcgtcgaccacgtcgtgaacgggctccgccgccgccgcctgcccgtacgttctccctgccgtggacgaaacctgtacatcaggtattggccaaatggccatcatgatcatgttcgtcgctctcgacgtggaagctaagccgcgtgacgcggtcgtcggcggcggcagcggcacgggcgaaggcgtcgcggcggggcgagcagagctgtggttccgatgtacggagtatatgctgccgtaagggacgcgcgcggcgaggttgacggcgcccgtggagcgccagagccagtgtttgaaatttcagttcgaaattttcgccccccaccaaaatgttcatatctcatccgaaactttcggttttttacaattttcttgtgaatttagtcaaattttattcaaatccattcaaaatcagtcaaaattttaaaaaatttcgtacgaaaaaaattccgaaatttcggttctatcgctccccctcggcagaaacctaatttcgaaatttgaaaccctggccggagcgcgccgaacgcgccgcaagagcacgctgtggtggtggcggcctccacggcggaggaggaggtcgtcggggagttcggacaggccgggcggtcgtcgccggtcgccatcggtcgtcgatgccggcggccggggggaggctatagataattaaatcgaatcggcgaaagataattaaatcgacctttgattcgctgataatttggatcgggacgtttaagcgctgataattagttgcggcaaataggctgtgttttttctcccgccggaaaaaaaacacggattacggcaaaccgtagtctcggttttaattatatttttttcggttaagcatagattttaggtgcatgcttttcgatcgcattacagtcaattttttttcgatcgcagaaggattatttaaatatagtataaacacggacactcacttatttctataaaagtacaaacgtatatttatctctctataagtatctctaaaatactaggttaggtttgtagtggtattttatatgagtgtcttagttctactgatagagtaggaaaaaattacaagattaagggttgtaaccaggaaaaaggaaaaaaaatataccaccaccgacacaccgacagcgccaacacacaaatacgggagaaggctatcaccggaccggccgccgttaagcgtgaccgaccgctgctagaccaaaaaaggaacacaggcgagatcgcccccgaggggatgccaaaacgacgtcttcaagaagagaaacgacggaaaaactgccgccgccgtccgtcggggctcaataaagccatgattgggcttacgcccggcaaacacccttgaggggtggaacagcatgacaacgcctttaagagggggaacgaaccatcgttgtcggtccgggcaaagccgggctgggttttcacctgctgctcaacatctgtgaatccacgactgacgctccgatgctccaccaccgctcaagctctgccgacatgtgggacccctgcaccggcgccccccgccggccagccttcgtgcgccgaagaccacgccacacccaccggcagctccaggtcgcctcctccaccgccggctgcgcctctcgcgccaagccagcctcctccaccggacgcgcctctcgcgccagtccgacctccctccatcgaccgcgcctctcgcgccaagccggcctccatctttgccactcgggcctctcgcgtcgagccggcctccgcggccatcggctgcgcttctctgcgccaagccgatctccaacccctcctccaaacgatgccgcaccggccaattgcagccgtctaccacgccctcggctagccgtccgagaccgtcatgcctcctgtggccgcagtcatggtcaccgccaccgcagccgctgctgctgaacgcccagccacctcgtcgtcgccatcctcaattactcgacctcctcagccgccgccaccattgccaccgtcgtcgtcgcgcctttgccgccgacgccgacgccgcgggctccgcagcgctaccactgccacgaggtcgccccgcaccagatccactgtccagggggccggatctgcccccggcgcgaccgggtcctgcccgccgtcgccctcctagccgctgccttccatccccgccgccgctggcctgcaccccgccgcctccaccaccattcgccgccgccgccgcccctcaaccccgccgtcgtcacctcgtctgcctcttccgcctgcgctgcaaccacctccgctggcgtcacgacctcctccaccggtagctcgacctcctctaccggccttcgaaacgacgcggccggttctgctccctcccgacctggccacgcgggggggccagatccgcctgcgtcagatccatcgcctccggccgccagcggcaccgaagacccccgcctccgtccctccatctgttccccttcagagctccatctgtcaggtagaggcgcgagggagaaagaaggccccgccgctgctgtccttaccgccgcccggctttgccggcggcgaggcagagaaggcaagggaggggggctggcggcggtggctggcgtcgccgccctagttgccctagagcgaggcgacacgggcacaggattcactccaccattatatacacgtaaacttgtagaggtaaaaaatctcattggcatatggatattcttggtctatcatttgttattttggactgatcgatgtacaatagatgtgttattgtggacttttgtgtgacgccgatgaatccaaactacagaattgtgccaatgaatccatgtattcctgatcatttaccttttaagagatgagactataaatcgggacgaactattacaacaaccaggcatatataattttcgaaactaaattcccataaactttcttcaagtatgtgctccgaagtccaaaccaataatcttggtctcttggatgatttgggcgcaatccatcattcaacattcagatctatgtactttcactgatttcggtttccgctgtcaaaacgtgcagttcttcgagaaacattgcgttttcagcgaagaatttgatcagacgaactccaaaacaatcggaatcctctcccaacctgaactgcagactgactcttctcaaactactcttcaagcatgcgaaggagcaatcactcagtccacggatatccaatctctgattcgattcgaatttgatgaggcgcatgaaatcatcgatcgacttcccgaaatccgcatcacatttcttctgaaacaaatgcttcacttgcttggagttcttgcaggaatcaggtggcaaatcgctgatgaaattgagctcgagttgacgaagcaccgggcagcaatggagcaggctggcgatcgtcgccgccgccgtctccgccgccatgctccagccgctgtaagctccgtcgagctcgaggcggaggtgttccagttcggggaacacctcggcgacggccatgtcgtcgaggtggttcgccttgagcctgagcaccttggcgttggtgaagttgtggatgaaatgcgagtagtcgacgcatcgccccatgccatgggtgaagtggaggtcggcggcgaccaccgtcgtcgtgtccggcgacggcggcgaggttaggtcgaacagcaccgcttctcccttgtacgtgaaggatcgcagcctcagcgcggtgatctccattgatctgcccggtgcgccttcttcgccgcggcagtggatcagcgcgagcacggtggccgacgggaagcggaggccggtgttccatgttacggggccgaagcggcgatggcgatcggacgagaggaggacgaactcgaggtgcacggtggcgagctccggcgcggcgtcgacgatgccgtggaggtgtttgacgctatacgtgcagtgtcgcagccgtagcgtcgttagcctcgggaaggcgacggcggcggaggcggtgcgcggcggcggcggcggcgagaagttgtggcacctggtgaggtccagcacgcggagggtgttcgacgggagggaggagaacctgaggatgtagaggaagacgtcgtcgtccatcacggcgtcgtcgtgttcgtccggctggccacggtggacggcggcgacgcggagctcctcgacgcggcgcgccgccgggtgggcgaccacggcgtcgagcacgtcgtgatctccgactctgagcgagttgtacgtggagcactcgtcgtctccctcgacgtgcagggtgagcctcgtgacggcgcggtccgcggcggcgagagccgcctcggcggcacggacgaaggcgtccctgccgtcggggacgcacgcggcgaggttgacggcgccggaggagcgccagagcgcgccgaaccgccgcgacagcaagctggtggacgcggcctccttggcgggcgcgaagtggaggacgcgaatgaggaggtcgtcggggagggcggacaggcggtcgtctccggccgacatcggtcgtggacgacggtggcggccgcggcggcggcggcgagacgtgacgatgatgggggagatcgatcttggttcgggctaaggtatggatcggagtcggtggcgaggcgggctttggaccaaatggggcttggcccatcaggctaaatgggctgggcagtagtttttttcaaaggaaatagtgggtcgtaattttaggtctaatttaaatttcatcaatcaatcagagattttccagacgatggcaaatcagaatctggtttcctaccattaatgtcactatgaatggttcgattttgaagagttaaaaacagattataattaaacattggtcaaattacagataaaaattgatccaatgagcctatatatatttttaaagtgtttcctaaggccattcacagtgcggtgaggtgacgttcaacctcacctcacgagcgcatagattctaaaccacgtcagcatggagggaggagcagccaagaacggggagcttcatttggccatccgaacctcctcaaaatttgtaagagaaagctagaatttatcaggagaaagcagggaggagagaaggagggattgatgaaaagtgacttgtgacctgtgacgggacccgctaaaaatagtctgcacaggatctcgaatcttgtgacttgtgaagtttctcatcctatctagctagcagttgtgacttactacgtacctagcagcctagaaccagcaaaattatccggcacattgtaaacgccctaaggaatttgacttttcgaactgcaggcttactcctgcaatgtcagaaacctcgctcgtcgtgatcattgccttcatcatcatccaagaaccccttgctctcctctctctctccacggcaataatccaagctcgattatcacattcacaccgatagagcatcaaaatctaaatcttagttatatgaaaaaaaaaactctcaagataaatccacatgtttaatcttcgtagatgagattagacattaaaaatgcaattgctcaactttgaaaggtttgatgatgtttaatgacgagaaacgtacacgggtcctctgtctagctccatcagtctaggttcgaagacttaacctttctatttactccctccgtctaagaatatagtaatctaggaccggatgtgacgtccaattcagtcctaagttgctatattctggtacggagggagtattcgatattaggtcatttcttaatattcgtgtttttttatgttcaatgataatttttcatgactgaagagagctttttttttttaatttggaagtattataaattagatagaattatgtatgagtcgaaaatgtcaaaaatattgcatctaatacaagtctactaaaatcaattatactataattattatatacttcatcagcgaaagcatgttttggccgacttattcatcaaccatcctcttagctcttgcttcagctgttccagcatgaacaatggcccctcggcggacacgcagaacagctcggcgatcgccggcgcgttgcagagcaagaacttggccagcgaccgctgcgccatgccgccctggtagtgcaccaggttgatctccctcaccgtgctcctcaggcaaggcaccaccatggcgcccgccgccgcggcgagcacggcgtgcgggttgtacctgagctggtgcgcgtcgcggagctcattctgcgagtacgagtcgccgtcgccgttgccgtgcgggtggaacaccagcgacagggcctccagccccggcgtgctgttgaggatcgtggtgaccgtggtcaccgcggcggcggcgtcgtcgtcgggaaggcttccccagagctcgaggtggcggaggttggggaaggtggggaagctggccagcgcgtccttgtcggcgccggcgccgaggcgggcggattggaggtggaggtgcgtggcgtcgtcggcgaacagctgcaggaaccgcctcaggccggtgagctcctcctccgaggtcgcctccttgccgcagatgtcgacgtggcagcacgcgatgccgcgccgccgtctggcgtccgcgtcgccgtggtggagcgtgaggaagtcgcggctgcgcggcacggcgcccctgtactcgaaggtgtggagctccgacgcgtcgacggcgacggcggcgaggcggtggcagcagcggatggccagcctgcggaggcgcgcgccgccgaggatggtgaccgcggtcaccgcgccgcaggcctcgagcgtcaggtcggcgaggcgcgggcagccggagaccagccgctgcacgtcgctcgctgggcccttgacgtgggagaggaccagcgtctcgacggaagggagggcgacggtggccgggagcgcgaagccgcaggagccgagggtgagcgaccgcagcacggcgcaggagaagagcatgctcgggatggtgtgcaccggccgccatggacgaaagacaggagtgtagccacggaccttcttgtcgtcggaggaggcgacgtcgtcgtcgtagtccgagctagaggggctatgactaggagcccgtctcgccggcgacggcgagcgatctctcgcttcttgtttctcgtcgtcgtcgtcggcggcgttgtcatgttgctcgtcctcggcattgtcatcgtcgtcgtcgtcgtcgtcgtcctcggcgatgttctcgccgtcgcggagagagtaggcgcggtcgcagatcgcggggcggccgaggcggagatcgatctcgaggccgtggtcggcggccgcctgctgcacggcgtaggagacccactgatcgacggcggcggagtcggcgcgcacgtagcccatcatgtcgacgcggagcgcgcgcagcgggacggggcggcggtggaggcggcggtggcgcgagaggagcgcggtggtgacgacggcggagaagaccggcggcgcgagggggtcgaggccgcggcggtacgacgggctgacgtagccgcggatcgcggggtggtcggcgtcggtctcggccatggacaccgtgtgcacggcggcgaacacgtggcgccaccgcgacgagagcgacgacgcgcgcgccgcctccctagccgggaggaaggagaggatgtggccgagcacctcgtcctccagcttgctcaggcgatcgccgccggcggccatctccagcggcggcggcggcggcgcgtggcgatccatggcgcgatcggtgtacggatcgatgtagtggaggtttatatcgcggcggcgattgcgggaatacaagtcggtttaagattggagagcacaactgggccaaattcgtgccaaactgttaaaattgggcataatttattctctttttgataaaagcccattagtgcccgactcttttttttatcatatcttattaagcctgttgtatttggtgcaacaatgtttacctcgatactaaaaataataagaattattatgatatttcatagtattaaagttaactaatgagcaaatggcaggaactattgcctctcatgaagttgtgttatgcaactcatacataaattttacataacttttgtgctggaaattgtccaacaagtaaatcagctaatttctttcagtcatagatgatgtaatgctcataatctttcagtgatagatgaatagatgatgttcgtaagaatgagaatgcgcacgtgtatacatgaatatgcgtctgtattatgttaaaaaaacataattttcaggcacaaatagattaccctctcaagggtgccattttatgactattaatgaacaaacataacacatattcctattttcttgggctatgctgatccacacgtttctttttcgcgggtggacaaataaaagagtggtgcgctatgagactgacttccaagctttacgagtagaactatcggataagctcaattagcttttgtaaggcatgattgaccctactcttaaaacattgccggacatgtatgaccataggaaagaaattaagtgtcgaccataacactgcgatgacatgagatcgactcactggattaaatatcagtgtggagattatggataccccatatctacacggcgatgatatttggactgaatataggataccgaatatagatagaatatcttatttgtatctcgggtttgtttctcaacttgtacatcaaggaaacaccttgagacttagtcggttacgactgtattttatctgtatctgcatattccgttagggatatagattatcttttgtaacacggactccttcccatatataaggggggtccgggtgcctctaggggcagatgttgattttctccaaatcatacaattaataatacaatcggcggattcatccccggacaggagtagggtattacttcttgaataagaaggcctgaacctgtataaatcctttgtctccaaacccatacactttttcagcttgatagccaccccttttattattgccgaaatctagtttcgacagttggcgcgccaggtaggggtagcg

SEQ ID NO: 71681 - DNA, 9815 bp, Oryza sativa
gttcccataggttgagacatcatgcccccctgctgctccactctgtgcaaccaggatgttgagttccgccaccacgtcgtcatcgtcgcagccgtcatcagtgaaccaacgctgctccttcgtcacccccttccaaaccaacttctgtcaccattaacaccacctgcaggcaaagaagtcatcgccgtccttggaacccaagccgctgctaccatgccgtcatcttgttgagaccacgtctacaggtgagctcttgatgttcatcctccattatttccttccatttttatcacccggtggtagcgctatgtgttgttgtttcgtccatcacgaaagcagcccctgtcaaccttcctcctttatatgtatttaacagagcccttgccttcttttcttttcattcacacatgtccaaaagctatcgtactgctgctttgcctcggccaccatgcccacagtgtgcatgtgcgtgcaccactgttaatctctctctttagatgacatatgaaccatagcagttggtacacaaaataactccaatcaacctgaaaacacgagagaatattcctttctatcttctattaattcaattttccattcttgctgccacctctctattgtgatcgtaaaggcggccgtcagtcatcaccgatctgtttgcgcaccatgatggtcgctgtcgcaatggaacccgagctgaaccacattgtcgccatcacgttcctatgaatgtcgctgcggtcggtaatctccaatgccctagcagcaccgctgctcttatcctccacttccatcgtcttcacctgcctccggcatggtctctcatcaagttgctattgtctgccggtgccaccgcctcactgttaaacgatccggtgttcctaccacttgtctgtttgtggtcatcacggttccattccaaaattactacaccgccatcactgttttcttcaccggagtagtccatgccagcaggagcacaatcggtgcatacaccatgctctgctctatcttctctcgtggcttgttcctggcgttgataacaacctcgagctcaagcaatagttgttgcataagcatcgcctccgttttcgcccttctatttccccggtgttgtctctacaatattcctcccctcctacgtccaacgttgtcatcctctaccatgaacccggtgtctcttcttcatcccagtgccggtgcccctttaatttttattcccacatgctgagatgccgtcgcattgtttctatgctcccattgctaccgaactactagtgaccatgtcgtcgtcatcatatcgtccactctggagggccaacacagctgctgtcctctcgctgccttaggtcggcaagcacgtcacaccgtcacctctatcattgtctcggagtctggcatggcatgttcgctatctcactcccatcaatcagtgaaccccatcctttagccacgaaaatgattctaataaaatccacaaatgccggaaaatatttcttattttccattcttccaattcaatcttttgtcgatcatatcttcactaatcagcatcaccgctctctttcatgagcctgccatcatcttctcccggtatgctcttgcttctttcacctacttcaatccgaagttttgccatcaccatgccgttgacgtccacgctgcgaggcattatgtcacacacattctggtcaggccagcctcttaaaacccaaaatcaatccaagttgtctatccccacaaataaatctcagccatccacataatcattccacaactctcctccttataaacaattctccattgatcatcctactaacgagtggaccccacccgttagtccaccaaaaataattgttttgtctcataaattccagataatattttctaaatatttctctttctttattcacagttctctaataattgaaacttcgagaggtcacatctcttccatccaaactccaaatcgacccgttgtttttcctaaataattctaaaattgagctctacttcctgatttatttggttatttcatttgatgttatttttctattttttttcttttgtttgtttgttttctcctttttcgatcgtgtagatgttgttgccgaggaggttactgttgcaggtgaaggtttcgtctgaagatctcgtgggtaaaggcaagtgtacccttgaacatgttgatcccaattttaaaaattatcttattttaaattatatgcattgttttgttttacaaattatcgtgtgggtagttataacctacttgttaattatttcatgccttgaattattgttgattatccttgattatttgtcacctagactgtatgagagtcaaacatggggtattggctcagggtagtagatttgcttagccctgctcacacttttacaaagcaaaatataatattgactaatgatctacttatcactattttttttatataaactgtgtggctgtgtgctatcttcttggtggcatgtgttgcacggtgtagtaatgatctggtggaaaatgttttagaccggggtgatggtggatctgtgtgaacctaggaggtaagccatctgtgtgcgtgcttaccgatgacctgtgtggtcgattgagctgtgtgctccatttttgttgtgtgcttgaggtccttagtttagacaagtcgcccaggtcagttaaggactttacttcatgcgccattgatctgagccttaccgtgcaaccacatgtccttatgggaaggacctagctgagtacactgcttagctcttgcactggcggcccaggtggctagatgataggtttttggattgtaccatgggacctttcacctgtgtggtgaaaggaggaccgcccatgggggaagccggtgttagggcgaggtagaggaaacgctttgttactctttggtgtttagcggcactgaactgtatcttgtgggtaaagttgtacaacctctgcagagtgtcaatctattcgaatagtcgcgtcctcggttatggacatgctcggtgatttcacatgaggggtagatttgtgaaagttttacttttgggaaagagctgtgtgcaggataaattaatgaatatagctgtgtggtcctgtgtggacgcaatatcctttttgggttggttggttggttaaaaataccgtgattgcaaatgttgtttaaatgaaatttatatctatttattgtatttaaattcacaaatgcctttacgcaaatgaaccctagctttcctttgaagccttgtatcatatattacatattcccgtacacttgtgagtactttatgtactcacccttgttgtctcacaaaatttcagagaatgccagttgtttctagaagttctgttgctaaggatgtcgaataggttgcgtgccccagttgattgcctatggtgtgtcgttggtgcctctcgcttcttgtcccactgtttatctctgtttggccctgcgtggcaaagaaattgtaaaatctggtcataagaccaatgtaaaaattatatttgtttcctatttattaatataatcgtgatgtggttgtgatattatcttttgttactgtgtgtgctagcgttgatctgggactagcacattatacacagagggatcctagttggggtcccgacatgccgaatccacttcgattccaatgttgaacttggttcatggtttaccaaatttggtcattaacagaggtgtaccagtttacctaccagacacatctctctcacacgttaccatgtgctacatgccaccacgtcatttggacggaagtcataacaaacccatcgcttaagaccgccctaggtcaataagacaatctatgccctcgtgcatcttaaacccgtctaggacttcatttgcgccctggctaggaccttatatgtcccaatccgtgtcttatttgtttataattgtggtaaacgatgtattaagccttacccattagacatgtggttgtacggagtatactttgcaacagagtcctaaagactggtccttatgattgccaatgtgcaactaacaaaaccaaacacctcgagctaagttgaaaacaagtttgagaatattgaggtagagtccatcaggtccaggctaacaagcctctaatccatcattaatcaagattatagtgtcaatcctaaagtctatatcattacaaattaattactccttcgtttcatattataagtcattttgactttttaaagttaaacttttgaaagtttcaccaagtttacagaaaaataaagtaacatttatagcaccaatttagtttcgttacatctaacattgaacatatttttgttagtttctttgttctgtgttaaaaatattactatatttttttatagacttgatcaaatctaaagaaaattaacttagaaaaaagtcaaagtgacttataatatgaaatagaggaagtaaatgtttctaatagagcattgctgagtataatgtaagcaccccatacagagttcttactagttgtttttttacttaggattgtcaaacgtaattagataatatcaattaaatcagatcataacaaggaaatataggaaaggctaagtaaaatagttataacgtggtatatttaataaagcgaatacaataatttaaattaaaatatttttcacaaattagcattcaatatgattaaggagagcctgacttaccttgctcaacgaacggacttaggagactcatgcaatggactggacttgcacttcaggaacctccgaacgacagcaactgcatgaacgacaaaacaaggctatagctctgagaaaaaatggtaacagcacatcaaagcaacatacatgtattctttaagttacaacaaaattaagcaatttaaacaaggctatagctctgagatatggctatctgaagtttatatacagtttaattggatatttccgaattgtttaattattattataccattaaattatgtgtaatgcattagccctcgaggagagaaacgatcaaacgactggcatgtgagacccacaggtcaaacggtagttcaccatggaccggtttaccaagacggtccacgggaaagcagagtgagacccacgtataagttttggagaagagaccgacgagtggatcccacgggacaccatctaagcagccacatgtgtgaacacccagctacacaagggagggatgcgacaaccggcaccggcggcccagcagtgcaccgtatggcgaggaccataggagtgagggatcggagagcagaacctcaccacggacacaacgacagttgacgcagcgaggaggtgacaggcggcgaggtcatgaccacggcgagcgcgagcaacaatgacggcgatgttcagcttgacggaaaatccctgtacgggactttttctaataatttagaattcaaaattaataaatatgaagtcggatctatatatctaagactctcaccttcgtattccatcaacataattaaaaaattatattaataattataaagcttccataattccatatataactaacatatttataagagtactgctacacgtactaaaatttttttacaaaacttttactaacaaatttctcaaccgtttaatttaactagatggaagttgcaagaaatctagatttactcacagcttgacacatcagagtttgtaaacattttgtaagaaaaaattagtacgtatagacttttcctatttagaatataatcataattttaatatttattgtatctggtaataatagcacgtaataatagctctcaccttcgtattccatcatcataattaaaaaattgtattaataattataaagcttccataattccatatataactaacatatttagaatataatcataattttaatatttattgtatctggtaataatagcacgtgcaacgcacaggttagtgactagttttattaattctataagcctactctcactctttaaaattataacaaaatttggtaaggctttaaaccaaacacgtctaccaaaatttcataaggccaaaatttagtaaaatttagcattggtagggttgaaagtagctgcaaagtaaacaagcccgtatagtaaaaattctgatatttgacattgcccaacatatgtagtaactatatacatatataaatctgtacagtattataatacaagattatgatcactcacaactgcatgcagggggcaccacaaataagagaagacggagcagtgcctttcttcttcgaacatgtacaggaaattcactaggaacatcagtgatcacagttaaaacaccattcctctaataatcatcacatcagcattcgcagttagacgagctgctcccgaagcagctgttcttgggcgtcatcttcctgacgctgtcctgcaggaactggagcgtgctgggcgagatgtaggaggtcctgtccatggtgttcaccttcggcgcctcgagtatggttcttggaggagacaatgcatactgcattgcccagattgcaaggggccgcatgtatatcagcgacctgtagtggccgtcgatcgtccatgcttcaggggtttggaaccagtacctggttatgtcgaaaattcgtggttagcagaagcggagtaaataattgcatctttttttaaaaaaaaagtagagtggggattagagggatatattaaaggttatggctcgttttcttttacatatgccaccagtatatcattttcatggaaatagaaatcgataaatttacgatggaagttcttataggaagttaagaactagcatttcgatatgactttgatcttaggcaattaagcagctgcagcaagaaaagcgaataaactctaagaatagtccccaaactcacttcctaaaagatgaggtacagtgatttgtatgattatatctggcaatcactgaaaatataactgtcttatataggttaagatagggcatcatcttacatctatcagcagaaaaacacaaagcgtgttattggccacagatgctaggacaggaaacataaatatagtgaaacaagagggcatacccatagccttcttcggaccatcctgcggtgaaaatgccttctgcagtagtgaaagcctgatcgtccattccatggagcagcatagtagcagctaaactgtacgttactcctgtccagatttctcttgactgcatacaagtctcgtctaccttaccatttggatgcataccgttcacagctcccatacgccctccttttaccctcatcacattatagtcaaatattttctgaagggtgcattttatcctaccctcatcaaacagaggcggcaaacctgacgatgcagtataccattgtccagccagttgatccgcatggatggagcgactgttgtaacttgttccgctgtcataattaaaatatgaaccattccataactttgcttcaaatacgggcttagcttttgcaaacttcaacatgcacctctcagcataatcatggtgtccaagggtgcgggccagcgctgctgcagtttgaagggcagcaagccaaaggcaaccacagtaggcacttactccacgaactgtccaagcatcatatgtttgatcaggaaagccatcattctcaatcataccatcatcgtcatggtcaaactgttccatgtactccatagcagtacaaaccgcaggccagacatccttgccaaatgacatgtcacctgttgccgcgaaatctctgtaaacctgtagcacgaacttgggattgagatctttccatctacttgtgtcatgtatgttgtacgcattcaattcatgccaaggatcatgggccccaaggtcatgggcaacagcaccgattactttgcgagtgccccaagtaccatcagcaagaaacctgactctacttttatcttcgcgcagaacagctgtagcaaaatcacgttgaatgctcagctcaatcttaggaaacagttccagaagagcaaaagaggcatagaagtgtacatcataagtgcaccacatgaagtactctattccttccaggtataaaaacttccctacattttccctgtcatcaattatatgtgggctaaaaccaatgagtggaactgcagaattgcgactgctatgatgaagtggcaaatcattgtcctcagatagccttgagttcatcatttcatcagcatcagccatcaaagatgcactatctgtgagtaaaaagatacatatgccaaaaaactaacatcattacataagtaattaagatgctatataacgtacgcatacagaaaactattctaagtaccatcaccttcccaagtgaagatataatgggacaaaaagaaattcatgtgctagacaaagaactgtattaacgttttccccaactgagcaagcttttagaacgattttccttcttgttccagagtaacttgcatgaagcaactatcttgctacataaaacaatgagagctagttcatgaggaactatgcaatgtctttgtttgttccaaaacagctgcacattgcaatagtactatatttgtatggaccaataaatagaaataatcgtgttgtacttcattgcaaattttgtatgaatatagatccacacattgacaattgaactttttatcctttatactattctctctccagatgggaaaattgaaaattgaaagcagggagaaacaaaaaaacaaaatgttaggatggtttgctgttgacactcgcagttgggatgcagataaggacatttccgtaagaaaccattgacataaacaacttgctttctatctccaaaaaaaaaatgaaaaactgaatagtaattctattccattggtttttatgttcaaatccctcgagtttactatgtggcttgcaaaaataatttgcctaagagaagggaaaatgaaaacagtactagtaggaagcctatgcaagacatacatacctatccaaacagttcctccagcaactaggaagtacagctcattgaagagagtaaccttgtacctgcaagaatttaagcaccagaaagcacaaggatattatcttttgtgtagactaaagaaaactaagaacttaacacaaagctctataacttaacacaaggataatactgccttgcagcagccaactggtaagtcatgtacaagtacacaccactccggaaacctctcatcatggagaattggcctctgccacttatcaatttcctcttcccagtgcttatactctggcaatcatatcaataggcatattttcataagggcgtaacaggataaagaaataaatatcaaatgggatgaaagtagcagctggatgaatcaatcaatcaaatcagggtcttcaagaatgagaagacaactataatcaccataatgctaaatccatctcaatatttgcaaagatgtgtatataatgtataatagaagtttatggaaaacatactcatcaaagaatcttgcaccaagtttatagctgaccttggagaagttccataaaattttgtatacctcctgccagcagggaatgaaatagaattttatttaactagtggaccttgtaaaaaaacagatattttcgatatagaaatataaatgcacatcatttggaccagcttagaagaccaaaaaaaaaaaaaagataacatatggaatattctgtaaaattaaataaattcagggagcaattcaagaagaatgccgtgtggcttggtgggtgatgcgccgatcccctgcatgttcaagataaaatgcatatagatatacaaaatagttaaggccatgcaatagtatacatgggctgcaggaat

SEQ ID NO: 71682 - DNA, 3182 bp, Oryza sativa
ccgaggagaaagaaaagagattttgggccgactttgggcccaaagccaaaagaagactttttaaaactttttcaatttaaattatttcttaaatgcaattccatttattaaaaacactttcttagctcaaataaatcccagaaaaatctaggaattatagaattaagcaaagtatttaatgaaattttatctggccccattttatattggaatttattaattaaacttagattttcttttcaagacttttaaaataaattctagaaattccatttaaacaacaatttatatattttgaattttcagggtgtgacagagctgcaacctaagttaaggtaaataagtcctctatttattttaaggattgctatgattcatatttgtcaccgtgggtaccagcactatatcctgggactggtaccgagatcgcggtttcgtaggaagcggttcacgccgttttccctacgacacgctcctgtcaggtgccgttgtacggcggtatcagattggggtgtgacaacaaataagggtgcatgcatacaaagaaaaggaagataatctttttctactgcttttttgtggtcgataatattttctattaatacttattgcagttcatcatatcaagtatacaaatccatcttcagtgagcaaaaatttaaatccaactatcttgatagttcttctttcaagatgagactacaaatccagatagatgtactaatactcctactacaaaaccaggtgaacttttcagaaattccagacaaactctgtgcagaattcctagtactcttggatgattaatttgggcatcatccatccttcaacgttcagattgttctactctctcaggtttcagtttccactgtcaatacgcgcaattcttcgagaaccattgcgttttcagcgaagaattttaccagacgaactccaaaattctcagaattctcatccaacctgaattgcaggctaactcttctcagattgtactgcaagcaggtgaaggagcaggcagtcaatccagggatgaatccagaaacctcatcgccgttatggcgatgatcaccacgctttgatatgctgtttcgcatgaaatcatcgatcgacctgtcgaaatcaagctgggattttctttgaaagaaatgctgaacttgcttcgagttcttgaaatagtcaggtgacaccgtgctgatgagattcaggttgaggtcgcagagcactgggcagcaatggagcatgctcgcgatcgcggcggccttcgccgtcttgctccaacggttgaaacctccgtcgagctcgaggcgagcaatgttggggaagaatacgccatggacagccatgctccgcctttagcttgagcaccttgaccttggtgaagttatggatgaaacgaaggtaatcacgttgatggaagtagtggttgaagtggaggtgcaccatcttcatgtccggcgccggcgaggttagctcgaactgcgacctcgccgcccccttgtatgtcaaggatcgtagcctcggcgcgtcgataacgctgccgctcatgccgccgttggtgaggcagttgatcagcgtgagcgcggtggcagccgggaagcggaggcgggtggtggaggacattgccagctgcaccaggaagtggacatcgcggatgttggatatgagatggacgaactcgaggcgcacggcggcgagctccggcgcggcgtcgatgatgcggtggagatcgtcgatgttcgtcgtgcagtgtcgcagccgcagcgtctccagccgcgggaacgcggcggcggcggcggcggccgccgacggcgcgaggctgcggcagttggtgaggtccagaacgcggagggtgttcgacggaaggttggcgggattgatgctgtagatcccgacgccgtggctgctcacgatgttgcccttgtcgccccagtgagggtggacggcggcgacgctgagctcctcgacgcggcgcgccgccgggtgggagaggacggcgtcgaacacgtcgcggtggccgcggcgctcgtcgttctcgctgctgaggaggaagctggcgatcgagcctttgtcctccttgtcgcactcgatgtggacggtgagcctcgtgacgcggtggtcggcggcggcggcggcggagagcgccgcctcggccgcacggacgaaggcgtcgcggcgggcgatcagagccgctcttccgatgtatctgctgccgcaggggacgcgcgcggcgaggttgacggcgccggaggagcgccagagcgcgccgaacggccgcgagagcaagctggtggacgcggcctccttggcgttcgcgaagtggaggatgcggaggacgagttcgtcggggaggtcagacaggcggtcatcgccggtggccatcggtcgtcgacgtcggcggcggcggcgatcggttgttgagatcgatcttggttcgggttatagatagtctctgtagcgaggcggcgttgggccaaatcgggctgggcccattaggctaaaatgggctaggccgtaatttttatgaaaaaaaaggttaagatggactgtaatttcagttttaatttaaaagaaaaaatgagaaggttaagaaggactgtaatttcagttttaatttaaaagaaaaaaacgagatttgaagagagagacatcctcaaaatatttttttaagacgaaattatgagggtgatgggtttgttttttttttaaaaaaaacaactcacatcacacggtgtgaagtttatattgatagagcaggaaaaaaaattgcaaacaagtttatatttaaaccacacacgccttgccacaagttgattgccacaagtttactgatatttaatttgaattactaaacactgcaccttttttttcaaaaaatggagctagtatgacagtcaaaaggttgattgtcataggtttactcatatttaatttgaattcccaaacactgcactttattttatttttttacaaaaccacgtgtttccactttccacaagatgctaaaaatataaccgcaacaataaccgtaaattagccatcaaatccacatgagaacactacattaatccaacttcagtgagcaaacatgcaatccatacgtatcttgatcattcacctttcacacgttgtgtgaggcacacacaaatccagatgtactcaataccctacaaaaatattacctg

SEQ ID NO: 71683 - DNA, 26092 bp, Oryza sativa
ccgtgaaagggggttgcccatccaactgatcgtaatcctcgtcagtcttgtcctcaactccgatgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggtgcgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgagagacattgcaccacttcattctgaagggcttctaatctatccggatcgatgaccttctgcgaaattgcgttcatgaatgcacatagctttgttattgttgcccggacattgtctggaaagataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccataccgggtggtttgctgcaaggaatcgacgatgacccatgtatacaaccttcctacagtgcttaaggtacgtactttctgtttcatccatacagtgagtgcaagccttgtaccccttgttggactgtccggataggttgctaagtgcagaccaatcgttgatggttacgtacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattatgccatccgtactcaaaccaaaccgtatgtttcgtgcgtcatttccaaattctttaaattttctgtccatgtttccccactgccaaccatccgcggggtgtctcaacatcccgtcctgttgaccctcttcagcgtgccatcccaacattctagcattcccctcttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttctcgacgagtttcaataaatcgccaaatgccttgtcactaaccctattttttgccttccattgcaacaactccagagtggtatccaactttttgtcgcctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtctgccacttcatcttcttccatttcaacaccttgctctccgtgggatgtccaacaattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattaccgatccatctacatgagtcaaaaaaaccgcacacaaataattattcttacaataatgacagtcatacaataattataagatatctttattcatacaaaaatcataaaatattacaccaaataattcttaaaaactagttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaacccgggctaaagatcccgggggggcctgacaggtcctgacagcattcgaaccgggactaaagatgatctttagtcccggttggtaacacaaaccgggactaaagatcaaatatgcccgttacccttttgaactgggactaaagatcatctttagccccggtttttattgcatccgggactattgtggaaatcggccgaccgacgaaagatggtttctccaccggtgttaatttgttgatggctactagcttgttggatctaaatactgatccttgtttcaaacatgggtcgttttatagcgtatactcactttgttttgttttattgtataagacgtttacgtttattataagttaaacttctttaaatttataaaaaatagtgtaataagtacaatactaaattagtttcattaaattaaccattaaatacatatatttatagtctaagtaatttgttttttgttagaaactgtagtacatttttctataaattattgcttgatcaaatttgaaaaggagaaaaattagaaacattttatgatatagaacggtggaagcattaatcaataagaaaattgtgttgccatgcaattattacttactattatctccgttccaaagaggctaaagctgtagcattgtaaagataaattaataggaaaggaaaggactgagatgtccccggcctcatgaatttagagatggttgagagtgaggaggttgaggttaaaatgggaagatatataaattctagaggtaattggagtggaagaatattagagtagaagttatattttgaaataaattctagaggttagaagttagcttttagttaagtgtatattctttgcaccacgtggtacgaaatattcgagtattctttactggagttccccttgactgttactactagtagactgttttatagctgatgttattttgatatgcagtagaaattgtctgccattccacggacaggtgggcccatgaaattgaagtcaaaggtcaagcaaatatgttttgggggcaaatgttcatgcaattttccttgtctatttcgtgtcccctcgacaattattcttgcatatggtacgtatactcttccacatcttcaattaattaattcaacacatacatataattacgcaggaataatatacgacctcttaaacattactaagtctaactaatatataaaaataacattatattcagtcaattttccagtacatatgttcttgataattatggacttgtcggcggcatctgtaacaaaccaatatttcctccgtttcatattataagactttctagtattgtctatatgtgcctagattcactaacatctatatgaatgtggacaatgctagaaagtttagtatgtgttaaacaattaagcatagaatttgtcatttgatattgttccagctgggttttgaattattcaacattaacatggacaggttaatataggatcgaatcataagaactaagccaaccagagaggggtgaatggttgatataccccaaaacccaaacttttagcggaaataaaagttactctcaaattcgatgtagatcagtctgaccgaggttgatccgccggtctgaccgagctcgtgccgccggtctgaccggtgttgatccgccggtccaaccgcctgaagattgcttgctgcgtgtgaagtcaccgccggtctgaccgcctttcctccgttggtctgaccgctgcctgccgccgctctgaccgccggtatgtcgccggttagactgccgaacccgatgaaacacaaatcgaagaactcttaaagtagatgacaactttattgcttctctctgtgtttacaaagtgcaccaacaatactccttacaaaaatctcgactaaactcgaaaccctaactaaactagcaactcaattgctctcaaaagcgataccgggaagcctcacgctccccctctatttatacataaggtaggcagcctaaagccacgaaccaaactcatactaagagtcctaaataccttaggaaaccctctagtacaagacacaaactttacataaccaatcgtatcaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccaccaaaccgactcccggtccatcaccgcaaatactctcccgatgtatcgagtcacctacacatgaaacaaacaaagaaaccatattccgagaccaagctatccccaacttgactcattagtagcaaacaatagtattacatacgtatagtatccatctagaagccataaccatgaaacaatcacggatatccaaagaaacaacccgaaaccgaaaccgacacagcgtcggccggtcagaccacgggccggctggtctgaccgctcaacacaagccggtctgaccggcaacctccgcctagtctgactggtcccgacaaaacaacaaactctgttcatcacctgaaaattaattatctccaaaaccacttcgtgaataaattccaaatatcaaaaaccaataatcacagatgctaattattcatcacagaataagaatcaaaacacacattgatcttactgttaattctgagtttatctcaaggtagacgccgtgagtagcccgggctttgctagctgattgaactattcagttacatacagtgttacagacaataatgatcacaaaaagtttgtcctctccgagtgtttttctttgaaaaaattacaccaactagaaggcatcttcccagaaaggaagctgtcaatgatatatttccttgaccaaatcggcattagaaagatcattactgcgtacttgttgcatattatatagacagaaggaagtttactcctttgttcttgcatgctgtcctctaaataatactactagtctcattgtctcagttgtcacaaatacattatcaaagtcaattagggacaagaggatgtatggaattgtagatactggtgtactctcttcactgtaattacagtagaaccatgtgcagattaagactgattgctttgacgttcagacaaaattttgtcatatgcaacaaatttcaccaccatctgaatggtttgaagccaaaatttcctcttaattttggtgtgctctgtttaaaccttgatgtccatgatataacgtgcacatattttttagtgcagaggccaaaagctatacttccatattttttttaaaaaaaattgtcttaattagtagctgctgttaattaccaattccatagatgcgtaatatatgcggaggtgcttgcgcagcaagaactagcgatattgggaaaaggtaaaggttaattattttgaccaaagtaattaggtgattacgtagacaacatcgactttgaccgatttttacttctcacgtttgatttgtgctgccgccgctagcttagatcgagttatagcaataaatatctaattaattgtatcaatcacgtagtcgatcgttcaacatacagtttgtgcttgtaactaaagagtttctggtcgtattttctgctacgaatgcgtcctactaccttcgtttctaaatatttaacgccactaacttttttaaatatgtttgaccatttatcttattaaaaaaattaagtaattattaattatttttctatcatttgattcattgttaaatatacttatatgtatacatatatttttacatatttcacaaaagtttttgaataaaatgaacggtcaaacgtgtgttaaaagttaacggtgtcaaatattagaaacggaaggagtatatattcagcgatgtgacctattgatctaatccgtttagctaaattaattaactacgcatgtacgaatgaagggatttaatttgtgaagtctcgtatagttcataattttgtggtaattaaaacattgatgtcattcacagagaagaactacttgatcatttctgtggcgaaccaaaatatctttcggaaagaaaccactacaatgtcacaatatttatatacttgatatatgtatatacttttagagtaaatttccgatgttttactttggactatcctttaaccaatttttactttggaccaggtatttttacctttgagacactttggaccaccctcgattcttttatctatctatatccaacttgttatatgtcaaataaatgatcttacatacatatagctataagagctatttgacaagtaggagccgacatactcgagatcattcatatgcttttagaagagagtcgagtggtccagagtgaaataaatgtaagattacccaattcaaaatgaaaagattggttagaaggtgatctaaagtgaaacataggaaataaaatatatatggtacaaagtgaattttactcttactttttatgcagtagtatatgatgaaaaaagaccatacttggtagatatttttgcatatatatagatttatttagatgttatcaacagcttattaattactgcatatggttttgactgtcggctacaataggacaaaaataaatgttcttcagttcttgatagtccaagatatgtcattgggttgaaactagttttccaagaagaagtcccatctcatggccgactcgataatatcagcctcagacatatatgagacatgtcaaaatgcatcaaattccacatttccttatctcccgtgtgataatttttatcatttgtttagtgctggtcaattgctagtgcctggtctttgcatccgtctgccactctgttgaatagtgccatgcaatgcatgttttttttcccaaaaccaaaccatacaactttcagttataaagggaaaccagaatggtagaccatgcaattcatttatttttctgaattgaactttcagttgtaaagggaatcatgcatgcagagatagcatgtcaaaattgcatgtcaaaattacctctgcctttttatgcttgatatgcaaggccagcaagattcagaaagaaatatcttaccaatgtaaatgtcaaaatctaccagctgcatgcatattatatgtgtctgatctattctcccttcaaataatcaaccaaaatgtatatacatgtgaccaatctgaagtctgaactctcactatgtggctagattctactgcataaattctgagaagactgaaagaagggtcaaaaaaaattactgtagtatacatgaatatccatttggacttccccagcttcactgctgcagcaagaacaactaaaattgaaccacaagtcaaagcagctgatcttataaaatctcccaattgtactcatctgaatgtattaaaatcttcctaacaacacgcgacatcgatatgatctacacgtccatgtcgaagaaaatttttgcttctccctccaggctgataatacttatcgttttagataagggtgaggtcaaactttagaatctttgattatgaattatttttaaaatatttgtctttcaaatatggtgactacgtatatagattagtcttaaaagtactttaataaaatcatatatttgatatacatattataataaaaaataatggtcaaagttattttttatttttaaaatatttgtctttcaaatatggtgactacgtatatagattagtcttaaaagtactttaataaaatcatatgtttgatatatatattataataaaaaataatggtaaagttattttttttaagatcgtgttcttgtttaaaataataagtattaccaatccggacgagtattagctatcacgagcgtattattcagagtttcagacaacctctactgtacggtactatctgtcgtatggaaagacttacaaacgtagccaagagaatcagagtcagactaatgctgggttggtaggggttggtgagacgaagaagtctttgcttctatctaactagaattaatatgacttaatcctaattaattacttccatattttaatgtatgacaccgttgactttttatccaacgtttgaccgttcgtcttattcaaaaaatttatgtaattatcatttattttattgtgacttgattcattatcaaatattctttaagcataacataaacattttcatattttcaaaaaaaaattgaataaaacgaatggtcaaatattactaaaaagtcaacgacgttatacattaaaatacggagggagtatattactactacatgtcaacctcttcagggttaacaagtcaatcaaccccaggattaagctggggttgaccaacctaattggttactactccaagacaaaagttatctctgccaatgatataatattaatctccagttactctgctatgatatattgtctgatctttgatctttccatgaagtagctagctagctagctattttagcttgcgtctgcgaggcaactgggttgcgtgcctttgttgtgttggaaaagtatagcaaattagcaatgcagtgcaaatgcagcctaattttttctatctagtgttcctcgttttacccttttttccattgtgctgatctctaccgtccattttgtcatctggtctgcagcgattggcttggtcaaccattgcaaacggccatccggttcagcaaatgtacttctgtgccaactatatgcgtatggctgcatcatcagccaccttgcttctatctataaatatgaccccaaaactgtcctggaagaagcatcacttcatcacaaaacctaccaagctaattcagcatttcagcttggttctataggtaggagctggtaagatcaccatggagaagctctccatggtgacctctctcctctgcgccatcactgtcgcggttctcgccgtggcggtggtcagcggcgaggcggctgtggtggagcacaccttcgtggtgcacgagatgaacgcgacgcacctgtgcaacacgaccaagatctacgtggtgaacggacagttcccgggccccacggtggacgtgacggagggcgacacggtggttgtccatgtcatcaacaagctgccatttgggcttaccatccattggcatggtgtccgccagatgaggagctgctgggctgatggggctggttttgtcaccgagtgtcctatcccacccggaaacgagcacacctaccgcttcaacgtcaccggccaggtcggcacgctgtggtggcacgcccacgtcacctgcctccgggccaccatcaatggtgccttcatcgttcgccctcgtgatgggaagtaccccttcccgacaccggccaaggacgtgccgatcatcataggtaatgaacggtccagatcgatcgttgacctatgcaccggttgatcttgaccgttgattaattgaatttgtttggttggaataatttcggtacttacgaatccacttacttaagaaatatgtatcatcccatttgtaggagaatggtgggagcttgacctcatcgagctagatagaaggatgatggatggcaacttcgacgacaacccgttgtctgcgacgatcaatgggaagctcggcgacctcagcaactgctctcgcatggtggaggaaagcttcatcctcgacgttaagcacggggagagctaccttctccgggtcatcaacactgcactcttctctgaatactacttcagggtcgccggccacacgttcacggtggtcggcgccgatggcaactacctgacgccatttaagacggacatggtcaccgtcgcccctggcgaggccatcgacgtgatcatggtcgccgacgcgccaccggcgcactaccacatgatcgcgctggctaaccaacctccggagccggacccgcagatcccggtgttcacctctcgtggccttgtccgctacgccggcaccaccgccaacaacaacggcctcccggtaccgatgccgatcatgcccaaccaacacaacaccatgccgtcctactacttccacgccaacctcaccggccttgcccacccagagcgccatcgtgtccctatgcatgtcgacgagcgcctcttcgtcaccttggggctcggctccatatgccgtggccagaacaccacctgcaagcggcggcgcagcccggagaccatcgtggtggccaccatgaacaacgtctccttcgcccacccgaaaaccaccgcgctcctcgagcgctactacgacggcacatcgaagggcgtgtacacggaggacttccccatccggccgccgcggcctttcaactacaccaaccgtgatctcatccctcccggcccgctcgaggaggcgttggagccgacgttcaaggcgaccaagctgaagcggttcaagtacaacacatcggtggagatcatcttccagagcaccacgctgatgcagagcgactccaaccccatgcacctccatggctatgatgtcttcctccttgcacaggggctcggcaactttaacgccaagagggatgtcaggaagttcaactaccacaacccgcagcttaggaacaccgtgcaggttccacgtggcgggtgggccgccattcgcttcgtcacagacaatccaggtaaattttcggtggcatataaggaatttatgaccgcgttataagatatgatattattttttgttgttctatgttggtaggcattaaaattgggtgaaaagagaggttgatgtgtcattgttggttgtgttcttgtttgcagggatgtggtacctacactgtcactttgagttccacatcattatgggcatggcgacggcgttcatcgtggaggatgggccgacaccagagacgagcctgcctccaccaccaccggagttcaagagatgtggcaacaatggtctgagtcaaccatgagggttttgaagagaaagtccaaattttttactgctacgagtaataaaaaataaaaaatgcatggatttgtagtatgcattgtattggtgatgattattcttactgtaaaagagatttactattcttttttggtattcattgttgtaaggtggcaaagtgtaagtaaatccatttggatttaatttatgaagaagagaacaattatttatgaagaaagtcacctgtcaattctggggtacttcagaggtcagagttaactctgaactttcagacttcagagtttaaggccatgtttagattccaacttttttttttcaaacttccgacttttctgtcacatcgaactttcctacacatataaacttttaatttttccatcacatcgtttcaatttcttcaaacttctaattttggcgtggaactaaacacagcctaagactctgaacttgtgaaatctctctgaatttttctccttttggcgtgaatcggcaacccatcttccaaccctgcgattcatgtgcttgcacatttactgattcccatcatcaacgttaatctcttcaagaaccatggcgttttcggcgaagaagttggcaagctgcgatccaaagcagttggtcttcgatctccattcggaattgcaagctcactcgtttcagagtgctctgcaagcactcgaacgattggccactcaagacagcaatgtcagaaacctcttcttcttcttcatcatcgtcatccaaagaaagcttcggcttcgaactccggtgcacgaagagatcgacggacttgtcgaaatcgagtttatatctgaattgtagtagaagagatcgtgatgagtagtctctcttgtacaggtttgccatcgccacggcgctgcgctttctggaacacggtgcattgtgccgtaggtccagctcgaggcgatcgaggttgacgagagccgccaccgccgccgcgccgaggctctcctcgccggcgattgcgatggcgttgtgggtgagctgccagaacgccgtcgcgacgcgtcggctccgattgtcgacgaggcgcaggtctacctcgcgccgccatgtccggagctcacgatcgcagcgagaggtggaggacgaagccctgtagacgaagtgtcgtagcgccggcgcgtcgaggtccagggctcggagccgtcacgccgacgccgggcgttcttcatcttccagcggcagttcgccatggcgagcttggtcaccgacgccgggcagcggagacggagagacggacgcccatggcgcggcatggcgcccttggcgccgccgggttgcggggcgacccttgcggtaacaggaggaagacggagacgagagatcctgcgatctccgtcgtcttcggattcggaggacatggtggtgaggtcgttgtcgtcgtcgtcatcgatcgtcgtcgctgccgttgtccgggcaggatatgtgtgttgcgccgacgcccatgccgacgaacgctcgtcatcgagacggtgtggacgctggcgaacacgtcgcgccaccgcgtcgagagcgcggcccgcctccgtggaagccactgagatcgctgagacggtcgacgccgtcccctcgtccgtcgccggcatccatcgcggcggcggcggcggccggcggaggcgtgatggcaagttgtcatctgggctgggctcattatgtagctgggctgcatgggatgcgacaatgcagaatgaggcccacctagctaccgacgacaaacccaatgcaagttgcagtctcacaggcccagcgacggacctgcgctcatgaattgcttggtagcctttgcgttatttttacacttttgtttttcaacaaaatttcagaatttcgattgccaccaaaatttcaggaattttggaacttttttcgacgaaattattgaaaaattttaataaatttaattaaattttgactaaattcagaaaaattaaaaaaattaaaaaaaaattggacgagatatgtgctcgttggtggggggcgaaaaatttcctaattcggaaattgcaaaatcccttacgcaggtcaacttgatagggggtgacgaaccgaagtgcaccaatcgagcaggctctcgtcatcgccgctgcactgcgctggttagggccagggctgtaaatttcggaacgaaatttctgaaatttcggtcattttagacctctccgatacaatattatttcggccgaatttttttttaattttggtaatatttgtttaaattcaactaaattttgtttaaaattttggaaatttcggaccgaattggtgaggtccaatcaaatcggctaaacctggcggtggctggaacccttgtgccgtaggtccagtccagctcgaggttgacgagagccgccgcgccgaggctcttctcgccggcgatggcgttgagccggtggtcaagcctcagctagcgtcgatgtgccttctcgcgttgctgaactttgtggatgagctgccagatcgaacgccttcgcgacgcgtgcgtgtttgctcgccgcgcgtgtcgcctgtgattgtctccaaccgccggaaggaggcggtggcggtgccggcgccggcgagcggttgacatgggacatgggtggtctttggcgcagttcatgacgtgcagggcaggagattcgaaacggatgttcagtggaggagcattccgaatttgatctccaggaagagaacaccattcttctgtgctccgtcaaagttggcacggttcagggctaagcacacgggactagctatatatatttatcgacaaatttactcggaaaaaaattatcagatgtaaatgtaaaataattataatgtagttatagtgtaacctgcatgtagctacaatgtattttgtgtataactttcaaaagtcctacaacaacacgttatttgcatgaagcgaaagtcgcgagaccaaatttcctcacccgctcgcactgtgtatgatctttttctttccaacatgcacgaatcttaaattaaatctaatggtttagaactgtatgaaaagttatattcaaattaaattgtagttatatgcaacgcaacaattatattgtatttacatttaacattttttgggagaaaacttagtataatttatagcaaaatcgaaacacaacatacttgcgtcagtctccaattcagtatttctccccatatataccagcatctgaagcaaacttgaaggcctggaggcaggtctctgcctctgcctctgcctgagacggttcagaaacattttgcaggttgcccgaccccgctgagactgcgatggctatctctgatgatgaagccccagccaccagattctgtgctattcctgaaaaggctccatcaacatttatcttcaggtatccctctcccggtttcttccatctaggttgactgccaccaacattagcaaggggtgatggagaaaccgtaccaacatccatcccaaaatctgcaaattcgccaacaggcatggctggccctgattgatatctcccatatgtgaagaaatcatgaccttcggggatgcagtaggtaataaatagcgtatagcgggttgttagcggattagtgtccgtgcagcggattgcggatagtgggcgctattgcggacgctaagttccaatagcaaatataagaaaataaccataaatatatcaatattatcatcaatttcacttaaatattagaatttataatacatttttaattactcatatatttcataacataaaaatatgaaataacatatagatatataagataaataaaataaacaatgtaaagttttacaattcatatatccatatatgaagaacaacatttaagcgttataacggtccaataaagtcaatagcgatcgcgaagcgctataacgggctgctatagcggtaacgaagtgctatatcgggcgctaagttacaacatgctatcttcagtccgctaccgctattgcgggcgctacgaacgctatttattaccttgataacagtgttgctaacgccatccgatgataggggcgtaccccatatcatttttttaaaaagaaaatttatatatagtactctctccatatcaaaatatatgacgacatgttttatcatataagaaactacagccttaaagtatttatactaaatttaagaataaaatgaatggtcaaacattatgaaaaagtcaacagtatcatacattttaaaataaaatatagtatgttgcttatgtacatactctgttgtgtctaatactttcttctcatgtttcttttttcttagtaattgggcttcctttgttatttttgtaatgtgtttaaattattgagattcatataatatgaactatttctttttccacaggaaagaggtccctgttttcgggcaatgaacagttgaacctgaatctatcccgtaatcactgcttccatcatcgatgcaaaccttacatgatttgacactgacatcccttttcaaattaatcaaggtagtgtttggttgctgggatgagatgggatgggatgggacgaacccacttttaggggtgtttggttgaggggtgggtaggatggattggtccctggagaggaatattcctctcagatccgggaccaatcgatccgggaaaaagagccggacgaactcgtcccacctgggacgagcgcacggcgtcagctcatccgcgactgccgccactcgtctgcgaccgacgccgcctcatccgcgcccgccgccgccttgcccccacgaccgccgccgcctccaggaccagccgccgcttcgtctgcgaccgcctccgtctccgcgaccggccgccgcctcgtctgcaaccgcctccgcctccacgaccgactgccgccgctcgtctgcgcctctcctcgcatctgcctccgtgcgcggcctccgcctcatccgcgaccgccgccgcctccgcgtccggccgccgcctcgtccgcgaccgcctccgcctccgcgaccgactgccgccgctcgtccgcgcctctcctggcctccgcctccgtgcgcggccgccgccgcctccacgtccgacgccgcctcgtccgcaaccgcctccgcctccgcggccgactgccgccgctcatccgcgcctctcctcgcctccgcctccgtgagcggctgccgcctcgtccgcgaccgccgccacctccgcgtccggccgccgcctcgtcctcaaccgcctccgcctccgcctccgcgaccgaccgccgccgctcgtctgggcctcgcctcgcctccgcgaccgcctccgcctccgtgcgcagccgccgcctcgtccgcgaccgccgccgcgcgcgcctccgcgtccagccgccgcctcgtctgcaacctcctccgcctccgtgaacgaccgccgccgctcgtctgcgaggtagccgctgggagccagacggccctaacggtccgtgaaagttctccatcccatcccacctcaatcccttctaccaaacaaaaaactataaccatcccataccacaaaccaaacagacaactggaactatcccatcctaaaaaactgggataggtctaacccatcccactttgtccccaaaccaaacacacgccaaaatgcctgccaggctacactgtcatccatatatattatcgcacaggggaatacaatagagaggattaaattagcatcagccgtttggaaggttaattttcctaaccatctctgcatcccaatttgccgttactggatcaataagctcacatatatgctcctggtttatggatttaaggacgagggtttgaagggatcagttgcagctaaattagcttaagtgggccacaattttatcaccaggcccaactgtccgcaattggtccctctgttggattatgtgacctacctaaacatgaatattacagcgatttcatcttatatgctatttaaattactagaaaactgaaaattctaggaacatagaattatgatatatcctatataatcgagtacccacgcagcagaatttcagcacgggctatatattccgagaaaattcaacgaaatcaagtaatgatgcttattgatgttcattttataattatatagcacaccccacttcacacgcatatcaagctgaaaaaaataattgatggagactaggtacagtccgcctactgagcagcccccttccagatgaccaacatgtggacaacagactaatcaaataatgaccagctcaatcgactctaggagccgtgatttcaggaaactattttgatccctcgaggaaccatggctcttccgctcgatcgctccggctcgccatgactgcctatgtggacctgcctctgcctatcgcactcctgaatcagcgacgcaccacaatacggacgcattcatgacacgtacctgcactagaattccccttcccaaccttactaatcaatcggatgcatatatatgggcttggttgttttgcattgcaacaagaaaatgggtcacgacaggtcaggagcgccatcatgggatccactgccatcacagtgactattcacccaccaggaatacagtggcctagttgtgtctataaatatggccccaaaacctgtcctcaaagaagcatggcttcatcagaaaatccatgaagataattgagcttggttctaacagctaatagctgatcagaccaccatggtggcctctctcctttgcaccgtcgccgttgcggttctcgccgtggcagcggtcggcggcgaggcgggggtggtggagcacaccttcgtggtgcacgagatgaacgtgacgcacttgtgcaacacgaccaagatctttgtggtgaatgggcagttaccgggcccgacggtggacgtgacagagggtgacacagtggtcatccacgtcgtcaacaaaataccacatgggcttaccatccactggcacggtgttcgccaattgaggagctgctgggccgatggggcaggcttcatcaccgagtgccccatcccgcctggcagtgagcgcacctaccgcttcaatgttaccgaccaagtcggcacgctgtggtggcacgcccacgtcacctgcctccgctccaccatcaacggcgcattcatcatccgtccccgcgatgggaagtaccccttcccgacacccgtcaaggatgtaccgatcatcataggtaacggacagtcctgattgaccgttgaagtatgcatcggtcaatcttgaaagttgattgatcaaacctgtttggttggatggatggcacaactttgtgaacctactgactaaggaataccatgttattgtaggtgaatggtgggagctcgacctcgttgagctggacaggaggatgagggatggcaacttcgacgacaacccgttgtcggctacgatcaacgggaagcttggcgaccttagcaactgctccggcatagtggaggagagctttgttctcaacgtgaagcatggggagagctaccttctccgggtcatcaacactgcattcttctccgaatactatttcaaggtcgccggccacacgttcacggtggttggcgctgatggcaactacctgacgccgttcaagacagacatggtcaccgttgcccccggcgaggccattgacgtgctcatggtcgccgacgccccaccagcccactatcacatgatcgcgttggctaaccaaccaccggagccagacccacagatcccgaagtacatctctcgtggcctcgtccgctacaccggtgtcgatgccaacaacaatggcctaccggtcccaatgccgatcatgcctaaccaacacaacaccatgccatcctactacttccatgccaatcttactggcctcatgcatccgaagcatcgtcgtgtgcccatgcacgtcgacgagcgtatcttcatcatccttgggcttggtaccatctgtcgtggtcggaacaccacctgcaagcggcagcgcagcctggagaccatcgaggtggccaccatgaacaatgtctccttcacccacccaaacaccactgcgctcctcgagcgctactacgacggcactccagaaggcgtttacacggaggacttccccgttcggccaccacggccatacaactacaccaaccctgctctcatccctcctggccctctcgaagaggtgctggagccaacattcaaggcgaccaagctgaaacggttcaagtataacacatcagtggagatcatcttccaaagcagcacgttgttgatgagtgactccaaccccatgcacctccatggctatgacgtcttcctccttgcgcaggggcttggcagcttcaacgccaagagggacatcaggaagttcaactaccacaaccctcagctcaggaacaccatattggttccccgcggtggttgggccgccgtccgcttcatcacagacaatccaggtaaacgttcaatggcatataaggaattcactattatgttatataacatgatattattttgtcgttttaagttggtaggtataagaattgggtgaaaagagtggctgatgtgtcattgtttgttttgttcttgttaacagggatgtggtacttgcactgtcactttgagttccacatcattatgggcatggcgacggcgttcatcgtggaggatgggccaacaccggagacgagcctgcctccaccgccgccggagttcaagagatgtgatgcctcttgaaacaacttatcctaacaactatggcaaggaccttcctcctctttgccagtattcactagataatggcattgcctttggggcattttattcttgtattgcattagttaagacgtacatgttaaattccagcgtgcacaagccggtccaggccatgtggtcatcagcttcaggccaaggtcacgaaaagcacaacttgatcatctgcatcttgttatgtactccctccgttttttgtttgatttttttttcttgtcaaacttctttaatttaaccaaatttatagaaaaatatattagtatttccaacacaaaataaacatattatgaaaatatattaaatgttaaatttaattatactaattttatattttagatgttgttaaatttttctataaacttaatcaaacttaataaagtttgactagcattttataacatgaaatggagggagtatttattaaaaactcccttgcaaataatacaaacttcaaaatatcatagtcctctagtaattgaattaactgattgcactatttatcagatgcaaatcttatattcatcgttactaccatcaatgggtaacaattgcacgatcatcatcgtctttcaaggggtaacaccttaaagcttgttgcattcctctcgaactctggtgccgaatctggatgaattcttgaaaactcccatgaactccctgttaaattcttgtctttcaaacgaatcttggacgaatcaactccaacccatctttcaacattgagattcatgtgctcacagagttttctgttaccactgtcgatgcacatttcttccaaaaccatcgcattttgagcgaagaatctgataagccggactccaaaacagttggaggccgaacccaactgaaactgcagatttactcttctgagacttctattcaagcaggcgaatgattttccactcaatccagagatgttagaaaacttatcatcatggtgttcatcgatcaaggatgatgaaaccgctgtcatcttcgatttgtgacgcatgaacagaccaacggatttgtcgaaatctggcttgaatttcgcatgaaatgaactcaagtacatactattattcttcgaccatgcgtagttgagcatcttgagcttcagactgaggtcgaccagagcagggcagcaatggagtaggttggcgatcgccaccgccggcggcggcgccggcgccttcgtcttcgtcggcttcctcactgcttccagctcgaggcgctcgaggttgccgaacttgcagaggagctcggctcgcctcgccttgccggcgacggcgaggtggccgagctcctgcaccgtcaacttgaggatcttgacgttggtgaagttgcccaagaatcgccaaagtctgtcggcgaatctgtggtcgccgtcgatgaagtgaatgttcaccgccgtcatctccggcgccggcgactcgaggtagaatcgccggggatgccccgtgtacctgaaggagcgcagcttcggggcgtcgatgccgatgccgccgtcgaggtgggagttgatgtagctactagagccgcagaattccatggcgagctcggtggccgccgggcagcggaggaggaggcgcgattctacggcgacgaggccgccgtagaccccgtagtagtcgaggtatatgttgaactcgaagtagacggactcgaggtgcacggtggcgagcgccggcgcggcgtcgatgaggcgctgcaggtgcgccaacctcacggcgcagagccgcaggcgcagcgtgtcgagacgcgggaacgcgacgccagcgtccggcagagcgagcttgctgtcgctgaagttgcactcggtgatgtcgagcacccggagtgtcgccgacggcagggaggcgaagctgagggtgtaggtgtagatgtcgtcgctcctccatcgtctggcctcctgccaggggcgctgctcggcgccgtcggtgcggtacatgggacccgcgacgcctacgcggagctcctcgacatggcgcgccgccgggtgggagaccacggcgtcgacaatgccgatctcctcgccgccgccgccgccgccgtagttcaggaacttgtctaccccggagaggcagcgtcccgccacgttgagggtgagcctggtgacgccggcgccggcggcggcggccgcaagcgccgcctgggaggcgcggacgaaggcgtcgcggcgggatgagaaggcctcgtcgtcgccggagacatcgtcgtagacgacgcgcacggcgaggttgacggtgccggtggagcgccagagcgagccccaccgccgcgagagcaagctggtggacgcggcctccctggaggggacgaagtggaggatgcggcggaggaggtcgtcggagaggacggacaggcggtcgtcggcggccatcgtaattagtttaggtagcaattggtgtcgatctgttctaagctatgggattaacgaaccgtcaatcgtcattagtttgggcttaatggccttatacgtatgagaattggacttcaccgtcgtctacaagatctcttacaaatttctactggtacttcaccgtcgtctataagatctcttacaaatttccaaattcttttttcacggatacgttcttcttttatatgtgaacacgcaaacaaattgcacgtcgatatgttaggagaaagcaaagatttaattacacaacgcaacaggccagatggatggccatggacattgccagggaaaaaaacaaattcaaatccacaaattgaaatttcaggaaaaaaatataagtttattaaataatttcataatatcaatatctagctgtccctaaatctgtataagaactgatgcatgcttttcccccttctagaatagtttttttttcaacccaagtgtgtgatcacttgtgtatctgacctgtttgctacacaccacaaatatcaaactaatatttattagaaattataaactaaattgacaatattgatacaatgatcatatatcatctcgtaaaatttcgattccgatgtagatttacactatgacatcaacaaaatctacttctactctctctctctctctctctctttatatatatatatatatatatatagcaaaagtgcccgtgcgttgcaccgggtgattacagagtgtgtatattgaccaaaagtgttgtttggtttagcaaaagtgcccgtgcgttgcaccgggaagtttacagatcagaaaaatatgcaattaattaaaatacaaattcgctgaaatatttggtatttttaagtaggtatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggccttttgcgcatgcgcgggcgcacttttcctcccccaggccgcaacctgggcttgggccggaaaagaggcctcactctcgatccctcttgggccgatttcggcccggacgacaccggccgtccgatctctagggttttgatcggacgaccgagcgtcaatagtggggaaacaaaacccactccctctcagccgcggaaccctagcccatttccccccctcccatctcacttcgccgccctctcctccgcgcccccgagcggcggcggcgacgacggcgcccctcccccaccaccgatggcggcggcgggggcacccccaccacccacggcggcgtcgggggcatcctcccccaccaccggcggcggatctagcgggaggggaggcgccccgcgaccggggcgaggggacggcgcccttcttccgcgagcggggggggcagcaccctcccccaccaccggcggcggatctagcgggtggggaggcgccccgcgagcggcggcgacggcgcccctcctcccgcgagcggcggcggcggtggagtcctcccccaccaccgacggtggcggcggcgctctcccccaccaccggagagtgcctctgccgccgccgctggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatgcacttgttctccttgtgatgctaaccgaataggacttggtataattcaaaccaagtcctattcgcccaaacaaaaacaaagtcctaatcagctcaaacgaaaacagatgggagtttgtttcctatttttgtggaatcggacatattcttttaccgcgttgatgaatcggattcgttccggtttttttcacccggtttttttgacggacga

SEQ ID NO: 71684 - DNA, 21224 bp, Oryza sativa
taaaacttattcccgtcccggatgacacctatcagtgacgggccgtagttaggcccgattgagataacatttcatttctcaaacgggcctaaagttgcggcccgtcaagatgaccatcaactgtgacgggcaccaactttaggcccgattgagataacattgtatatcttaaacgggcctcaagttgtggcccgtcacagatgaccatcatccgtgacgtgcaccaacttgaggcccgtttgagatagcaactaggcccgtcacagatgactcatcagtgacgggctatatacttaatctctatcgggtattaactaaagcccgtcaccgatgactatttttttcatttttcatatgaaatgtttatatttgtaagttgaactatagcaaaataattaaatgcagtataataattcattttatgagtcaaaataattttacgggtagtaaatgatttcaaatggaaaaaatgtcaacaacaaagttgtataacttatcaagatttacaacttttagtttcgtcatttttctatataaaattttttttgaacactttgaatttgaatttgaaaatataacaaattcaacaacattttcaaatactaaacgatttcaattgaaaaagtcatcaacaacaaagttgaataactcatcaagatctaaaacttttatttttgttatttcttcatccgacgaaatgttagtaatattattcacaaattttacatatatgtgttatagttttataaaaccagataagagatatgtcaattttgtgaacaatgttactatcactttgtcgtatgaagaaatgaccaaaataaaagttttagatcttgatgagttatcaactttgttgttgatgactttttcagttgatataattaatatttgaaaatgttgtttgaagttgccatatttttaaattcaaatttaaacggttcaaaaaatgttatatagaacaatgaccaaaataaaagttatagatcttgatgagttatacaactttgttgttgatgaatttttcagttgaagtcgttcactgatctaaaattctatttaaacttttcaaactttgaatttcaaatttcaaattgtttaaatagagtcatatggagaaatgaccaaaataaaaattttgcacctcgatgagttctacaactttggttttggtaactttttcatttgaaatcatttaataaccccaatttgacatcctggcttagggcttaataagattaatagaataatcataccaacaagttacaactatttttccggaagccaatctccaaagaaacttgatgttaagcgtgcttggcttggagcaatttcacagtgaccgaccgggaagtttgaacttcaagtgaggacaaaaaaagactagcctaggaggcctgagactagccaaaaaataaaatttatttttttaattatactcatatgtgacgggcattaacttaggcccgattgagatgatggtcatctgtgacgggtaatgcccgttacagataagggtcatctgtgacgggcgctagttgtggcctgattgagataggtcatctgtgacgggctataatttgactggtcgtctgggtcaaagctatcggtgacgggctttaattaggacctgattgagatagatttatccgtgacggccgtttgcccgattgagataactcttcacatctgtgacttctagcctgtgacggacgccgtgcccgattaagatggggtttaccgtccaattgagatgatggtatcccttctagtgttagtttgaagcactcctgaatcctgaacttaaagcgcttatcccgtctcaaatcacaagaagttggaccagctacttccggtcttccactttattaagcacgtgaagtcgaacaaagaaagagtccatggcattattacaattatatattatataggacaatttaaaccatgccacacaaaatttgtaaaattttacaaaatttatgatatgccaccctgatccatatgtcattgactcatgtggattctacatgacattgggaacgtgtggcatatcttaaattttgtaaatatagggtggcatggttccaacaaacccttatattaatacaaactttaatatgatacatagtacagataagatgatctatgtcaccgatagctaaatttttctggtgaacgtaaagggacctagaaagtaccaaattaatatgatatcgtggtatagacatattgtgtacctgaaatgaaatgaacatatcttatatatacagctcagagcgcaaagaaaaactattatttctacaataaaaataaataattatatcactgaacaactactctctccggggccataaaaaaacaaatctagaatatgatatgatattttctagtacaataaatttagaacaccgcatctcgtttatattgttcttttaacatcatatctcgtctgagattggttttttatgggacaagggagtacacctcagtttcttaagacgtgtttagatctagtggtgaaaagtttcggcgtgtcacatcggatatacggacacatatttaaagtattaaacgtagattaataacaaaacaaattacatattccgcttgtaaactgcaagacgaatttattaagtctaaagaatccgtcattagcaaatgtttactgtagcaccacattatcaaatcatgtagcaattaagcttaaaagattcgtctcacaatttacatgtaatctatataattagtttttttctatatttaatattttatatattgtccaatcattcaatgtgacatggtaaaaaaaaattttcgtgggaattgaacagtgccttaatccgaaatctgaaacctccatcatttaccaaccaaatcttattaccgaaccccaaaaaagaagtctcctaatcattttcttcaaaaagtaaatagtacaaggatgaaatgacaaaaagcgccgcagcataaaagtataaaaccgcgcgagcacgcaaagcgcagctcactttcgcggcatttcttacatctcgccccctccaattcctcccaattcacgactcgcccccctccccttccccaccttatctccggcgatctcctcgccgtctccggcggcgggggagagatgcggggggccgacctgatcaacctcctcctcccggacgagatcctcgacgaggtgctccgccgcgtggccgtgtccggggccaagcgggacctcgacgcgtgcgccctcgtctgccgccgctggcgccgccacgaccgcgccacccgccgctccgccaagctcgccgcgtccggggcccgcgccgacgaggtgctccgcctcgtcgccgagcggttcccggcgctcgtcgaggtgtcggtggacgagcgcatcagcgtcgaggccgccgcggccgggccctcctgtgccgccgctagatcgcgccgccgcccggtgggttccctccatccctatccttgcttttgtggctccgtacgcgaattgcaggaaatgtagaggatcgtagagatgttttccgaatcgggattatgaggagatttagaattttgggagaaggttcgcatctgtcgaaggttttgtaggggaattgggggcaaactatcgatttcttatcctgttttgaaggtagtttgatcgatttggaccttacaaatccgcatttctcttggttggatgcagaatcgtgataactgataattctcctggggattgagttgtggtatccatttgtacatagttgtatgagatctgcatttccatgacttgtacaacagctgcatgcaaataagtaatgtgtgagttttgcatatgatcagtttgaaaaaccattgctatgtgtccaccagcttagtagtgattaatgattattatacggcaatatatatgaactgatgtgcctcgatgtcgtcctattacctgccgctagattctttaatgaaaactttctccttgcagtagattaacatagccttgtactgatgcactgatgcgatacagatgtatgatgttagtccttccgggcgccgtaggaggatgtcccgcagctcaaatttcggagcccacatgtccccatttccattggaccagccgggcagtgataatgagacagagcgcacttgcttgactgatgttggattaactagtcttgccaggggttgcaaagggctcgaaaaactaagtctggtatggtgttcttccataacttcgacaggcttagtaagaatatcagagaattgtaagaacttgagttcgttggatcttcaggtaatgtcatgctacccgttcctttgcttttttctcagttatttacttcatcatctctgaattctttcatgttttttttttcttgaagacttctatgcctctgtattaactgtgagtgtccaatgtaatatttacttgtaatacggtatatgaaacctcacaatacttggaacaagcattattcctggtgattagcagcagtcttctctaattatgaggaaatggtgtatctgcatgccaaatatgctgttaatgtagagactaattatgcacacaaatttttgacctgtctaaatcacaattttttttctgcaggcttgctatattggagatccaggacttattgctattggtgaaggctgcaagttacttcgtaatttgaacttgcgttttgttgaaggcacttcagatgaaggcttgattggactaataaagaactgtggacaatcacttgtctctcttggcgttgccacttgtgcttggatgactgatgcatccttgcatgctgttggatcacactgccctaacctggaattcctgtcactggaatcagatcatattaaaaatgagggagtagtatccgttgctaaaggatgccgcttgttgaaaactttgaagctgcaatgcatgggtgctggtgatgaggccctagacgctattggtttattttgttcattcttagagagtctgtcactcaacaacttcgaaaaattcacggacaggtactaagtagaattgtaaatcaatgccacaatattttatagaggcatattatccgactttgtttcacattcttgttttgcatagttctgtcaaatcattatgtgctggccagaaaggaagggtactaccaagttatatggaattagatataggatacaaaatgttggactagttattgcaccagcctgctgccctgctggaatgctaaaagttaggtgcttatcctaaggtgggaggtctgttggtccaacactcttaactatgttcaataacatgggaacatttatcaactaactggactgttgactgattaaacacactagcccattaactaacatccattgtttgcagttgtgatgtttttgttgctgcaccaacttaggaattaatttgcctttaagataagtttcgaatctactagtttgacaatttccagagtatagatattcctttatcttgacataattctcctttgctgtacattacattcttggaattgctgaacttcatcaggacattagtacattacaaatccatacctgttttctgttgaatcatttctcttgtactgtaggtgtttgtcacacattaattcttactgcttccaccttgtgctgcttcattaacttttaagttcattcaattattcacttacattttcctttggaattgcaggagcctttcttctattgcaaaagggtgcaagaatctcacagatcttattctcaatgactgccatttactaactgatagaagccttgaatttgtagctcgtagctgcaaaaaattagcacgcctgaagatcaatggttgtcagaatatggaaactgctgcactggagcacattggacgttggtgcccgtatgtttcttgctgacaactcaatatattaaaagttcctttcttcacttaaaatctatatattgcctttcctgttttaatttatttctctatagttcacataagtgagcagtattttagaatgaagggtaattcaagaaaaggttttagatgcttgatccataaataaactacaatatggtttctgattacattggcacattggcaagagtgtgggttaccctaccttttacttcagaaaaaaaaaagtagttgttgcactctggcattgttatttaattatcttacctgcatttttagagctatgtcatattgatattttgttgcactaacagtagatgatttgctttctgtcaaaacaggggtcttttggaattatctctaatttattgtccaaggatccaggacagtgcatttctggaggttggtagaggttgctcccttctcaggtctctttatttggtcgactgttccagaataagtgatgatgccttgtgctacatagctcaaggttgcaagaacttgactgaactttctattcggcgtggttatgaggtacttttgacatttgcatagatattctgcaactagcatacatggtgaaatatgtcaaatataagatttgacatgttttacaattaaagtgttagatggaatgacatgatttggttattaccatctttattcttttaccatatgcagcaatgagaaaaaaattcaaatatctttagttgattgaagttcattttgtatgcagataggagacaaagcattgatatcttttgctgagaactgtaaatcgcttagagagttaacactccaattttgtgagaggtaaatattatcatgcatttaaccatccaatttatctatcttgtccattactccatgcacatcatccccttaccgaagctcattataattcttgttacactttgttgaatgattggtattaggaaacaacttagattcatagattgattaatcatatcttagcctattaggagtgacattgaccacgttgttatgcaagacaacctaacatttgatagttgggataaggactggcctctacagtatcaaatattcgacagcatttctacagctccatcctatgcatgctgttcgaactagcacccttgggggattgtatgttctgaatgcatcactagacatatcagtttctaaattttgttgcaacttcctttccagggtatctgatgcagggctgactgcaattgctgaaggctgtcctcttcgaaagttaaacttgtgtggatgccaactaatcactgataatgggctcactgcaattgcaagaggatgccctgatctggtctacttggatataagtgttctccgggtacatcacttgtcacactgaatttcttttatgaaaaattatctgaaaattgtggtatcaatgaataaggcttactatggtccgcgcagttaggattcaggactaaaatcagctcatttcaaccaaggaacacgtaaagaacatatgatgatacaatactagatacagctgtaggttttggtatgcagagaacttcaaaattttataatttgaatagtctgtgttttagtagttgtagatcaaagagttaatactagaaatagatggtcataaagaagacgaacaaaaaggattatctctgtaagatacagcaaataacaggcctatgaataagtttttatctgcactaatatgaagttcgtcatgatatcttctccattaaccagcactcaaattattcctttgtttagttgtctggtgccttatacataaggtaccaggagtattgcggtacatatatgtgttcaaaatttatggctccagacaaaatttgcttagtgcttgtgtggcgcgtgtgcttgtcacagactctgctccaacaatcgataaatgatgtttactttacaggatttacagctatttcttagacaatcctcttatatacccatctgtcattatgcgagagcagtgtgattattttaccttattttctgatgccttgttctcttcaaccaacagtccataggagacatggcgcttgcggagatcggtgaaggttgctcgcagcttaaagatatcgcgctgtcccactgtccagaggtcactgatgttggtctaggccaccttgtcaggggctgcctgccgctgcagtcatgccagatggtgtactgcaggcgagtgagcagcacaggaatagcgactatcgtctcgggctgccccaagttgaagaagctcctcgttgaggagtggaaggtgagcgagaggacgcggcgcagagcaggatcagtcttgtcgttcctctgcaccgggctttaacctgaaaatggaaaaaaaaatctgtgttttaacaactctgttgttggtcagaaatcgtgctcatgagttgctgcaccctgtgccatagcttgtttagctgaaaaaaaggttgtattaactgcaaataaaatggtgttctatgtatgttactatgatataaaaattatgaaccaaataaacagggttcagtcaaactcaagtgaatgaattgtcgcaagttcaattatatgaacaaatgtacatttgcattacttaaccttgttgtcctgcctgtcactctaaagtagagcatgatttttttactcattctttaagtgtattagaagatgagactgattgtcacatttgggattgctttaacctgcaacattctaagcaggttgcctcctccggcatctggaatcgcttggtatcccctcatcaaacaaggatcttttttttttttttttgcttctgatcatgcaaagcaccttttagcatctgattcatgttttctcagcttcaagaaacgaatgaattctttgctcctgcataccctctgcttccttcctacgctactgtctttcttcttcttcttgagataccttatccactccaacccaaaaacatcaagttgaagcatctataaaagttcatcatcctccatttctacaccgagaatcgaaccacgaaaaacactcacacacccacgaatgcgccgctaaaaaagcgcaaataggcagcttccaatggagaaaggcactgtaggtggcattggcatgtgtgaccgtctcttgacgttcctcgccaagaacctgtccatgaaccggcagaagaccatcaccgatggcccaagaaatgacagcagcaacaacaatggcggccatgaagaggaaagaggagaagaagacgacgacgagttcaccattgagatcgagaaggccgaggtgttgctagtcgacgagaaagacgacgacgacgaccacaagagcatcacggccaccattcttgaagagaaaagcactgaagtggcgacgagcaatggaggagcaagtgtgcagaaggaggacgaagaaggtggccgtcgtaatgatcctccggtggctgcagaagctgcgacggtggcggaggcggcgccggtgaaggaggagaagaaggtgaagaagacggtggcgatcaaggaggaatccggcgcggcggcggcggcggggtcggcgtcgtcggcggtgaagaggttgctgtccaagaagaggcaggcgtcgtcgagccagctcggaggggatcacgacggcggccagcagacgaagccgccggcgaggcggccggggctccggccgaggatgccgtcgatcctgagggtgccgtccaacatcaacgagaagtcgtcgagcttcatagaggagcgcaagaagagcttcggcggcggcggtgccggcgccggcggcaagccggagaagtgaaggatgcatgtgcacgtgtgacgtgtcagctagcgtgaagtgcttgtgtgcgcgcgcgtgttggttaattaattaatttggataatcgattgttcgttctttacttctgtccaaggggcttgcttgatcatgaaattaaattcgttattgtgaaaaaaaatataaaatttataccgttgttatataccttttgctctatgtttttcttttgcctcaatatattgcttgtcgttcctggatttattttaacgacccacacaagacgtggaatttcctatatgttaatacagtaccaaaaaaatattataacattgaaagattgtaatcagaaaaaaaaatcaccatcacgtgctagcagcttctcacacaaattcaagcaacccacaagattggaacttagttccccacaaaaaaaaatattttgttgaaaaatccaaatataaagctttgttaaaaatacaggtgggtatgataatttcttaaaaaaccttttgaaacttttttttaacttgtcatgctgtaagcagaggtgctagcagacagtagtaacttgccttgagttaccgtgctaatgtccgtttacatataccatgcatggacaaaagatttgtttgtaaaaaaaataaattgtacagagagaacatgttttcttataaaggaaaaaaatattttgaaattttaaattaaagtttcaaaaataaaataaataatccaaggttcacctttctgattgagcgaccaccggcaatacgactgtttttgccaaatttgcataaatgcttatcaaattttagttaaatttattgttttaaatttgaattcggaaaagatatactaaaatttacttggaatatactttcattcatcccatactgaaacatcaaaatttcgcagttttcgatcaataactcagaccactaagagcatcaccaacagtctatctattccattcctaatcctattttttttggattttggttaaaaaaaactgatccaacagattcccaaaagaactccggacgttttggagtttccatctccaattttctcggtacgtgtatttgagggcgagagaacgactcccaatcccctccttccacatttcacctctccttcctgcgtcggggcgatctccttctgcgcacgggaaaggaaaaaaactagattttctgttggtagtttaacagaagggcccacttttagtttttgtgattgaatttaggctatctcttggaggaatgggttttttcaccacctattttcagtttaggaaacacaaaaattaaattttagagtaatgctccggtgcaatctacttgcagtattctactccaagtagaattaatcttgaccttttattttgaagggcgggtaagtaatctcctaatatcatttaggggtaattttgtcatgggatgttttcttcggttcgcatcgcattaggtccggactccatcacacgcagtcacctcgctattcctcccccggcctcgccgccttgtccgcccccaccgtcgccgtccgtatctcccgccgtcgccgccttgtccgcctcctcagtcgcatcgtccatatgggagcggacgagtgtggcggcgtccgagcgaggatcttgagcaggagttctggcggtagtaaaaattccgacgtgggcttcggcggcggcggcgtcacgcacgcacgcaacgtcatttgcgtggcggcatcgtgtcggctcattcgtcttcttgccgttccgatcactgcgttgtttcatggattatatggatcaattaagatcttgcacgaccaactccgacgaggatgacatggtgttcgatctatggattgtaaaatgataatacccctacgcgaattatttttcctagacgaaaacacctctccacatttctacttccactaattctggtgggagtagaactagatcttaaccctacaattaaatatgatcgagggtccagattactttctactccgagtagaaagcaccggagtgggactgtaaattttagggatagattattggtagactgttggtgatgctctaacacaacgatatcacatcagttatcaaatatggaaaccgaacatgagccacagcaagtgcaacccactctcttggaccttcatgtctggcaccaatatttcaactaggcacctacaaattgggcgcaatcgggcgctatttcaccaagtagattgaacatgtttcactaaatatatcgaaaatatttcagtcttttaaaaagctgaaacataatcaaatcaccttatgaaacattttgctacaatgtatgaaacagcggtttcgaaaaaaaatcagacgttgttcatcctatataaaacaatatttcagcaaatagcgaaagaatgtttcaattctttaaaaaaagtgaaagacgatcaaattgctagatgaaataatttggttcaatatatgcaacaaaagatttgaagctattgcaacacttaaaccctgtgtacatcaacaacccacgtatctatcaagatgaaattattaaacagtatcaaaactcactgcaacatttgattcatacatagttaaatatcacgagtacactagctgaaatattattggtagaaaaaaaaatgaaacagattccccttaattatagaacgtttctgttatatccgggtaaccgttgcaacggggcacactgtggtggagacacgtggtgagcgcgggtgcgcgtggtggcggcatgttggcggcggacgcgcgggtgcccgacttatattggcgcgcatcgggcacccgacgcaaaggattttccatatttcagtacgcggagaaccgctggcggcgatggatcgatcaacaacgtcgacggcgtcgtcaaatgttattggcaaacgtgacactcttcttgattttctcttttaattattttgtcccgtacattgcacaattaacatatgacgtgtccatatcagaagcgtcctcttaatctttcacatgtatttaaaaacatctgtgtcaaaggtactactttgtcaagttttatttaggaccattcggtgcatgcatgcgtgatgactgatcgacacgcaaatccatcgtcgacgatctttgtttactgttttgcatagaaatagacgatattaattagtcatcggcgtgttatgacttttaagagtcaatgtggtactaagatctttacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgactttttttttgcatgcccctgttgctgcatggtttatatatatatatatatatctagatctagaactacttaaaaagtaaaacctgcttccttcgtccgtgagaaaaaaaaatgccgagaaaaaaacaaacaaaaaaaaagaagtccgactcccttggaaattccctaaaaaaaaggaaagaaagatttctgtatggaaaaaaatcaagcgcgaataaaagtgcgaaaattttgttctgtccgataaaaaaaggtgcgacaaaacggtttccgtcttcctaaaaaagtagaataatagtgaaaaaaatatttttgtccgattaaaaaaaatctcgtcgtccgtcaaaaaaaagcgtgaacatttttttctgtccgattccaaaaagaaaagttgcgaaaaaatatttttcgtttctctttctctatctctatctcttctctactacttatatataaaaaataaaaaaataaaagtgtttccgtcgtccgtccgtgaaaaaaagcgtgaaaaagaaatcgggcgaaaaaaaatcgaatccgattatatatgacgcggtaaaaaaaattaaagacatttccgacgtccgtagtaaccaaaaaaagggcgaaaaaacatgaaaaaaagaaagtccgattctatatatacctaattaaaaaatttgtatggcttccaggttatagttttcgtccatcaaaaaaaaattccatcgcacgtgcgatcaatcccgctttaatccctctccgatggccaaaaaaaaaaagaaaagaaagaaaaaaaataatgagaggccgcatcaaaatttggacctaaattctagagaaaacactactacaagaatacaagatcagattcaacaatactaagaaaacactgacgcgtggaaggggagggtgttgccgtcgctgccgaacagccatcgccgtcgcagggatgtaggtatgccgggccgccgccatgttgttttgagagagagggggggaggagaaatgattttagggttagggtttgggatgttgaacttttatataggtcgggatcaatcaggaccatctatcacatcggacagcttcagcttctcccacgttaggctgaacgccattcccaggtcgcccacatggaataagttcactttaggtcgcttaagttgttcctccccgattctattcccatgccgcccacactattgggccacctcatggaccgcgtgtacgctctgtgtggaataagttcactttaggtcccttcagctgaacttttttttatttcattatgaatatattttcttaaagagctcatatcatgtaaaactaaaccttaatcatataatatttttatatttgttataattgcaacgcacagtcattttttctatgtaaaaaatttaccacgatgtacgagtgagaaatatatgccacacgcacccgccggctcatgtttaaacaagctggcaacagatttttcaattacagttctaattgttttatttaggtgattaaaattgtttttatttacataattagtttgttctatttaagctttttgaaaattgctaaaattcaagaataacttttcctacttcatattatattatttttagctaatggaattaacggaaaatcaattatatatttttatctttttgaccaaaggtcactgcaattttatttcattaatattattattatgattatgattcctttatcttttttcccaccagtatgcatgattaaaattaccttcacccgttgcaacgcacgggcattattgctagtatatatatatatataaaccatgcatatatatgtttcaatacatatatatgcatacatatatatatgtatatatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttatacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaacgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagtggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttgtcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatagcatggcatatgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatgttacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctaaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataaactaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatacatatatacatatatatacatatatatacatatatatatatatacatacatatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttgtcgcggcaacgtacgttgacgtgttcgttctcgctctcgttcgttcgatcgttctcgttctcgttcgtaaacggcggtgtgacggcatcggggcggcggttggcccgccggcgtgccgacggcggcggcggcgtggcgttgtggggccgtggtggcgccggcgtggcgtgacgacggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtggcgcgtcgtcgtcgtggcgcggcgtctcgtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggactaaatatcttttcccgctatttcgaaattctttttaaacccggttagggttaagaaccgggactaaagattatagcactacatatgattttcgcttacatatgtgtgtataaaatagaagttaatgcattaacattatttaaagtacaaagattaatgaaaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttgata

SEQ ID NO: 71685 - DNA, 598 bp, Oryza sativa
ccatgcttagaaacattagcacattattgggataacttatgactcattattacttaatgatggtttaaagatagttcacgatggtcaatcgtgattggttaattaattacttgccaactaaaactgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacagagggtattgtcacagcctctattcgggtactttctagtatcgcgacgcatggtagacatgatgttaaggctgtgtcttgtgggtacagtggtacacctctggccagagtaaaactattcgaatagccgtgcccgcggttatgggcgggttgagcaatgtttttcgtgattagtctcacacctctcacaataattatgg

SEQ ID NO: 71686 - DNA, 562 bp, Oryza sativa
attacttatccaacacttaatattttcatctaatacataaatcatcgctaaatctatacttcataataattaaagtactaaaatttacctctattttcttcgacttatatccctcttggcttggaccattacctcttcatttcttctctcttcctcaagctcttctcttctcttttttatggcatgagcacctcgtctggtgcaaactctcttctccttatatggcgtgaggtgagcaagaaagaggaacgaaaagagtgacgttttcaccgtgcttgattgctcaaagtttgagagcattgtattgacagcgcggattcctactctgtgcagcgcaactgtgctgcggtacgggcctagctcaattcaagagtattcagatgaatacccaagatttttagataaaaaatacaatatgaggtatatatttcgtatctgttttagatgaaactatcatcagaatggccagttttcagttagatcaatgtacttagctttaattaacaatggttacattgacagaaataagttaatttggaaacttaagatgccgcttaagatc

SEQ ID NO: 71687 - DNA, 1971 bp, Oryza sativa
agagcggcttgacgtaggggctgaagagaacgcatcccgggttgggctcggggttggggttcagatccgtgggcggcggctgctcgtagatggcctcgaagagcgcctcgtcggagaggaggaagaacccgaactgatccggctccgccttggcgagcttcgaggaggtcctcgcgccggtgatggcgatggacacgaacccacggcgggagaacccgaacttctcgaagaggatggacgcgcgggagtcgtccttgaaggactcctgcttgatctccgccgccgcgggacggaggagcgctccggcgacggcgatgaggaggaggagggcgcgcgcggcggccgcggcggtggccatcgcggcgagatctgggggagatgggggagcaggtggaggaggtgcgcgaatttggccagacgggtcggaggcggtgactttcctggaggcttatggaggtaggcgtggatctcacgtccgttggatttgcatcgagattggtgccaggtgggtgggtgactttgaccgagggtactcttagcagggaagcaacgcgtcggtttcgcgtcggttggatcgttggattgtgattggacggtggatctgattagtcgcggctcgatcagtttaggcattttttttccacgttagtttaggcatgttttggacgcagtagcaaaatgttcgtgctttcactgggctcggcctagcataataataaaattccggcgaaatttaagacgaagaagataattctagattctagaaggtttaaacaggataagggatcgatggaaaagagggcgacggcatgccgggtcaagcacggtcatctccttcgacgtgttcgagaaggctaaagtcgccgtgcttcgtacagccgcggccgtgagattatgcgcctcaaattgacccgcaggaacgaaagggtgtttgtgttttaggatatgaagcagtgaagcactgctggaggcagagcgcgtattgacaatgacataccatttcggtctgttcggattggtgctatttttaaccgtaccattttttaataaaattataaaaaataatatctacatttagtttgttgtcaaactttgataaatacatgagaaatcataccaaaattttagtaatattaacaacttgccaaaattttaatattgctaaaattttataaggtttattttagctataatctgaacagactcttcaccctggtgtttttgacgtctagagaaattggtagtaacacactagtagcccatgacaatatgacataaagtactttcagtttggctattttccccattttcgttagcacgtttttaaactattaatcagagtgttttctgtaaaatctttttatagatgagttgttttttaaaaaaataagtttttcacggttaatcatatatgtagctaataattcactcccgggaactgactttagaacacacccagagcctaacaagccaggtttaacttttcaatttcgacgtaaaccattgctcaccgatttacccaagtccaatcgaaaacgagtaaaataccaccgattttcaatcaacaccataaaaaccagctataccgatcagttatcacaaaccaaaacctaatagtttcacgagagccaaccgattttcgtgaaattccatcgattttgtgagccttgcaaacaagcgtccgtgtgtctgggagaggcacaggctgaggcggtaaacacgcctgtgttttatcccctgccgctgcaccggtttgtgcaatgccttgaagacttgaacgcacaccacctttctcttgtgggtttggccggactaatcacgcgtttgacgtgagggcatgcgtcgcggcgggaggaatcggcagccggccgcgtgttaggagtagtagctagcgagcgtcgccggcgccgcgcagcgctggctaacaaggccggagctccgagatagttactagaaaaacatcccaagcgt

SEQ ID NO: 71688 - DNA, 5367 bp, Oryza sativa
ccatcgccgccgccgccaccactggtggatccttccttgtgctgctctcgcgggatacagcgccatcgacggagccaacatcctttggtcttaatcaaagatcgccgcttgctgcctgctagtgccctcttcacatacgaaacccccaaatccggtctctggcgattaccattgccgagctcgagccgtgacttgtcgtcgcaatccatcccctctctagcaggcggcagtagggaggcgctcagtggcaggcggcgatgcggcgggaggtggaggagagggcatcggcgggcggcagcacggcgccgctcagcggcaggcagcgatgcggtgtaaggggagaaaagagagagagagaagggagagagcgaggaggaggaaggagtgaggagaggatgacatgtgggtcccacatgtcagtggaccaacaattttttgtgtgtgtggatgacaaatgggtcccacattatgtttttaactctaatgccacctaagcgccacgtcaacgccacagaccaagtcaacactgccacttagacatcacgtcagcgaaaccgccctccaaaaccaccaagggagtcaaattgcaccagttttaatagttgagctgtcgagatatctggcattgcgattgaaggataagaatcagattcggtgactagttaagggagtcaaagtgatcttattcctccaatgtctggccatatttatagaagtccaatttgactcccttaatataggtaagtcgaatctattctatatcactcaatcgccaaacctggtataacgactccaattattaaaacttaaaagtagtaaataatgactcccaagataatattaatggtggttttccttgacatggtatctacatagcacgttgatctggttttcgtcctacgtgacactgcaacccacaaaaagtacaatttaattcacgtgggacccacaagttagtgtcctacttttttcctctcttctgttcgctccttcatatatgcgctagcgctacgccacatcgtccgtcgttttaggattgagcgtgtggctagcctgtggtgggcatcaacgcccacggtagggtggtcagggtggcgcctaccgtggcgatggagagggggattgggtgcttgggatttgatatgtagctaccacgtagaatgaaaaccatgttaacgtgtcacatagaagctgcatgaccgaaaaccaccataaatactatcgtaagagttgttttgcacccattttaatagttctgaaatcgttgtacctagttatacagcaagggatacggatcaaattcaacctatattaagggagttatattgaactttttccattcatatttcatatttcaggcccaatttaagtccaccccgatcaaagtttcactgtgaatacaattttagttgtctataaacaaccggtttgaaattgccagtcggaatttccccattgacacgtacttattagagcaagtttaatagtatagccaactactggcttcaaatcatctatagccaattgaatagccaattgatacaatagttgattactatactattaatacatggtatcaccagtcatatacacattgtgtcttgtagtccgtgctacagctggctatagatatgtagtccgctgatcttctctcacttcctttatctctttaaaatatgtttatagctggcttagccttctattgtacctgctcttagtattcatatggtccggatggagcacatccttcaaaaaaaaaagaaggaaattaacccagtcccggtgctcaaactcctccttggatcaattcttcagtatactcttcaagctgaatatcctcctcggccggactgaacatgcagaacatgaacaggtagaatgcgagggcggccgcctcatccaccgccacgctcgcccaacggtaaccggaacttgcgcccacgagcaacttcaggatgaacacggccatccacgtgtggtacaggtacaccgccaccgcgaggtagagctggcggaacagcgcgagcttgccgagcctccgcgccgccttgtcgtccgtgtcggcctccttccgtagcgcccggatcgccctgcccatcggcatcagcaccgcgacgcagcaggcgagctggactaggacgaaggcgtggccccacgtccaggccacgcctccgtcgccggacaaggtggtggcgatcgccatgtagacctggagcggaaccatcgccgtcaacacgttcagctcacgggcctgcacgaacggctccgggagcgaccaccctgcgccgatcagcgcgaccacggggaagagcatggcattcttgacaagacgcaacgccaagcacggcacgttccacccgcgcgccgtcccggcgacgacgctggtgtatcgcccgtcgtgggccgccgccgtgaggcagtgcagcatgagcgcggcgaggaggccggacatgacgtcgtgcacggggcgcgccgtggagcaaccgcgggcgagcgtgcggtgcagccacgcgatcaggaacacgccgtagcacacggcgaaggagtagatcatcgcgacggggtcctcgccgccgtccgggttggagtcggacagctcgacacggacgtccatggtgacgcgcgtccccgacccgcagttggcgaagtagaggctgtactctccggcgcgggtgatggggaacgatgaggaggggaaggagatgcgccgtagaggcggccatgggttgcagaaaggaaaaatggctgtaagacgtcaagctcactctcggcgatgctggtgttttacggagcagatttatgcgtcccgagtcccgacggccggccggcgggaggcacaaggcggaatggttttgttggattggacgaggcagacaggcaggcattgtattttggcgcgttttttctactgccggcgtgatttctcacagctgtcttgcactctgaatcaagaacagagcatctccttgtctgaatgcttaacatctcaacgcagagccattagcttgggacttcaggttgaagtatcaaaagcatcagagcactctcagaaagtctgagacaatttcctacttcaacctgatttagctgaaggtcttgacgggctcctgtacgagttccaaatctctttgtactattagcagcaaaatgtatgtgctcctgaatttccagttaaggcgttcgatcaattagtttatgcaaaaaatataaccgagttacattccaggaactgatgtgtagaattaagtttcttgcttgaataaaatctcctgcctcgttgtattgtatatctaagtgcatttcagttctcattttaagaatggcatatactttgtactccattcgtcccaaaataagtttatttttcacatattacacacataccctaatacaaaacctaaaaaactataataccctcattttatcaaatctcaatgcaattagtcccccctctttatctactaccaatacatttataccctactttaacaaactccgatgcaatggttactcaaaaatgaacttatttgcttgtgaagccttatcctcctgacttattaggaaatatggaaagaacgaaatcagcaggtgttcagacataaagagctgtcggcaacaagcctggtcgccaagatcaaatagaaggcaaagacttggagcttgaaaggagcaaagggccttcgagacctagtcccttagggtttgcggttttcccctttttgtaaatatatattccatatacgctgtacattttttatcctactctattcaatgagattggcatagttttgtgccggttcattaaaaaaattaacgtattttgggacaaataggataggctaaaaatgaacttattgtttatggggcagtgggagtagtttctatggccatgttagtcttatacagaagttcatttcagatagctcaccagatacaagatggcaatcctacgactacgatattatcatatcattggcatatgaacagtcaagatgaactgtgagcttatagcaatacagaatagcacgatagcccatatgatctgctgtttcgctggttcaagatgcattacattcatgcatcaagccatcaagattaatgaagcatgtcaactagatgctactctgggccttacaagtgattcacctactatgtttatttgctacccagtctgccagtcatgcataaagaacctaagcaaccagatgttgatacaccaataagcatatattgcatagttggtgtccccttctatagttctgtcactcattcctaataacccacctataaaatcatgaacctaggtatgaagtcatatctaccaatgttatcccgatagcaacaaaattctacagctcgtaaatgataaagaacagctgataagtacgaagaagcaaacctgagtattggcaaaatggcaacattgaataaatgcccctaatttgcaacacaagcagcccaattatctttggacttctcaacaacatttgatgctagaagaaagaagtgaaaagagtgaatatatccataacacatagataaatataggctaaatcctgcatctgtatagtatgaccgacatcaatggaggagaaattgaacaggtcaggctgtatttcccatcatgtatcctctcactggatcacaacactctagagctcaaactcctcctcccggagtgccagctctgcagcttcctcctcatcctcatcaagagcgaaatattggttcctctctgctggcctgaacatgtagaacatgaacaggtagaatgccacagtggccacctcctttgcggcaacactcacccatctgtacttgtagttggtgattgtcttcagagcatacacaatgatcctagtgaagtataggtatccaatcacaacaacatagaactggcggaaaagggtgagcttggcaagggttcgggccgccttgccgtctgtcttggatgactcccgcagcgaccgcatcgaccacacaaccgggaagagcacagcacagcagcaggcgacatcaacaaacaagaagatctggttccatgttacccatccctgcaagaatggaccagtctcaccgaccacagctgcagcaatgttagctgcaacctgcaatgggatcacaaccatgaggaccttcttctccttgtcctgaaggaagggcttcaggaatgaccaaccggtcccaatcagagcaatcacagcaaacaagatcacacccttcaccagctggaacaggtagaacatcacatcccacccgtgtggtgtccctgcgatgcggatgtagtgctggtcctcggccgcggagatacagtagagcatgcgcgccgcgagcaggccggacatgaggtggtggatgcggtgcgcc

SEQ ID NO: 71689 - DNA, 10547 bp, Oryza sativa
taatatgaatattaattaactaaacacgactaaccatcatgagctatcattaattaaccatcattaatcataagtgattcattagttattcatgcataaaatgatactaatgtttctaagcatgactaagcaattatacaaagcatctagttgaaccaataaaaaatgtccaagctggttaaaaagaataaggtaatcaatacaaactagtcagcaccccacgcgttgctgcgggcaaaaaggagatctaaatttgattcatattcaagtatttcaaattgtcatatggcaaggtctatttgaattttgtaaattgagaaagaaaaacttgacaccaaatatcaagtatggcacatgaaaattcgtaagcaaacagtaatgtttcatgaaacctgaaggtatgctagttcttcaattatacacttaaccaacattagaattgatgtttctcaaatgctataccacaaagaaagattgaagcaagagtatgtccaccaatgagatattcacctacttaaaaccatagcccatatagctgcatatatgcgattgagtttgaaataatgaaacagcaactgcttttccttccattactgtcaggtcgacaggtagctcaaaaaaaggcaataacatggctaatgaatggtagtattttctgagaaggattggttccaatggaatcggtacaaatattattatgcaaaggattgttttctggaagtaaagaaactggtcaggacacatgcatgtaaatagacgcatcaagacacaatacttcttagaagtgttcgttgagggcaacacacaactcgacacaattaataggcgagaaaataatccaccaaaacagaactattagttctagaaaaagggcccaaacctgtataaagctctgtctttcaattgatctatctagcattaggtcaggtaactagcccccatcattgtcatggatagaaaacatagataagtccccatccaccatgtttcggtctaaaacttctccgctaataactagttgagccctcgcctcttcttcttgttcatccagcttaaagcgccatcgtctttgacatgaacagaagacaatcgcacagagacggagaagagctcctctcgcggttcttcgcttctccgttatcgtaccaagtgctgccggctgggcagaccataaaccttgccaaacagatttgccatgctgccctgtgcttcgcatcaaagacattaaacagggagccttagcttgaagtaagagcaaaatatatgaacacacgcaagaccattaatcgataatgttaagctctgatactattatagagtagggcgatgcatctttattggatcattatttttggtactgagatttttttctactctttaatttggtgccagtgtacagtagaataatcttgtaccatgaaaattaaaatgaattcctagcagattaactgctacacaaaaaggtacgttggtaactgataacactaagttccatatcatcctatatatcggatgatcgaacaattcaatggactgtttatgctgacagtctcaaactaaatatgattacataaatggttcattgatgactctgagattctagtattggtttcattggagaaggggatcggtccgatcgattggataaatagagatcacgctctgttctcttccgaaactgaactaagatccatgatccaagcatccaatgtgctctatgtaccagatattctgatacttggtttggccagtttagggtgttgaatcattagtaaatcaatcaacagtggtatgcaactttaagctagatattctgatacttggtttggccagtttagggtgttggaatcattggtaaatcaatcaacaatggtatgcaacttaacctagaaatagaaatactccctccgttttttaatatatgaggccgttaattttttttaaacacgtttaactattcatcttattctctttgctgaaatagaaatactccctccaactccgcctccttgggagggcttggcctgagggatagagatgacatatgggcccagataattttttattattctctttgctggcgtcacatgtgctagatcaagtcaaagccgctaaaaatagtacttggggggggtatttgtccggtacaaatagttgagggtacaaaacgtgtgttatttgagtttaaggggataattcggtcgactgcgatagttcaatagctttcgtactttttccttttattgtcacttgatttatcgtcaaatgttttttaagcataacttaaaattttatatatttgcaaaataaaatttaaataggacgaatgatgaaacatttataaaaaaatcaatggcgtcatatattaaaaaacagaggtagtactctataaccaaaacttgtacctcgcttgctttaattgataaccggctgcctgtagttagtaggaacgtatgcagagaagagaaagtcaagatagcagctcaggagtactctgaataaaacccgctcttcgcattggtaccgtctctattattgagataaaaatacaagtgatgtagatagccacattcttaaatgtagttactttgttttctttcatcgaccatctatagtatttctctccctgtaaacacaggtggaactgggtacccgtgacattgcatatctacactcctttataattctttataagtagagaaaatgtcaccccacctacttctgttttaattttacaacttactcccttacacattttaatattaaaaacaattaaatctaaatgaatagttatagaatcaaattagggtcgtattccatatgatgaaaagattggaacccatttcatagaaaaaatatttatagctattttagataactaggaaggtagcccgcgcacatgcatgggcatgtacgtaaaattttattacgaatgtccatgtgtggatggttttctatcaaaaatattctttcactttatcatacactaaaattgaacttacttaacatgctttgaacgctggttacttgcaacatataaattctgaaattaaattactttaaaccgtgttgtttctaattcatgagaaaattttgtgttgaaacaatagatgtgtttcctatgaatgtccaatttttttgttaattctgtttgaaattttaaatatattcattttattagtcctgctaaaatatttgaatatttgtatttagaatgggttataaacccaacaaaaacaaattttaaattagacaaatttcattcaattttcatttctttttatcttcattttttggataaacccactttaagaagcatcttttaaatgctttgatgtctgtaagccaggatgaaaatataagtgggttggtcctacaacctggcatggggtaaaggcatcaattataaattatctcgctccaattaagtaagaaaaattaaaatagatgtggtagtatttgctttgcaaattaccactaaactagagcatcatgtaataattatatgtttctagattggtctatgttatgtgtcacaaattcacgatgtactgtagcaagttttacaaaaaaaaaatggatatagtcttttaattcatatctgtaattggcttatatattgctgaggccacatcatgcttgtttcatacttaagatccttggtgcaaccaacacgctcagtacaatcaatcagtatgctgttcaactagccacgtgacttcatatattatatatataatttagatgctatgatcatcttgagattattgtttatctcctaaaatgatcatttattgataaaagcttcaatatcaaaatgtatggttaaatagctcctatatacaagctgagaaaaagttgatagaaagtcgttagatgtctaacggggtataagtaatgggtctaccagttttataaaagataagctgggatattttgatttttggtgagaaattttagtattttcttttatttaggttaaaatttgctaagcgacatctaaaaaacgtgtaattggccggggacacagcaagaacgtgtatttgttgtaggacaccgaaaaaactggtaattagctactggaggcctgcgagattattttataatatccaaaggaaatgcagagacaaacaataacaaaagtatgactttcccctgcctaccatggctccccggcatgcaaaacaaagctcgttttattacataattaactaagtatcaactattttttttttgaaaaatggattaataagattttttaaaacaactttcatgtagaaagttttttcataaatcacacagtttagcagtttgaaaagcgtgtgcgcagaaaacgagagagctgggttgggaaaatgggtggaagaacacagcccaagtccggctcgcatacacctttgacgctgcaaccgcagctgccgccgatgaggtagccctctaggggggaagggggggttcaaggagggcccatgcgcttaggccctgtggctccatgtcgttcccgcactcttcgccacagcagcgcaagggccatgctggcgccgagccgccgatgctccgccacacaccgcgcttggggtgagcgcaacacggactacctcctgattcatttcgagcagggcaccgcagaacacaggctattgttgtcggtctctgtaacatgccaggtattctcatacctagaatgctacacactatggtatagaaaccactaagtcctaaattcattaagaatttcgatagtttcccttgtaaatacggacttccacaacaggcaattatggggtaaactaataataatatcattcccacagtgcgatccatccttataatccatgaaaagaaactaaaatacatctaaaagattattacaagaccgaaccatgatatagtttaagtgtcattatggacctaggcaatatagattgatagtgtgcagataaaggtgtatatatgggtgctacttccagcccaagcatgtcggtctcaatgcgcacctaaaaccaaataaaacataaaagtatcaaaatactcagcaagtacaatatggaactagaaagtacatatacacataattggcaatagagcatgaacagaaagcttcctttctttgataggaaacacatttttaaacaccaagtcagagaaaaatagtagttcccattccgggcagatatgaattgaaatagtagttttcatcctggacaattgtgaatgcatcatagcatttgccggcaaagccgagtaagcgtgatcagcgcttacccataggaacatgaatagaaaatcagatagcacatccatgactcgcatggaacttgaataattgaaaccggaaacgaaaaactagattgaaaccatattgcacatccataacaagcatggaacttaaatttattttaccagaaccagaatccagaatagtgaaacaagaacaacgtcgtaaacataagataaatttgaaatctaaatagcatgaacaatagtttgaacataagcagtcacatatcaaatagaaatataacggaaatagatagatagaacaaacaatctatgaatcacacaattagttcgtcatgcacttgcctacaatgaagggttggtatcatgcacgatctgaaagaccaccacctaatcacaaacaaaacatcatcaaacacattcaaatatgactataataaattaagtggtacactgctacggcccaatcccaacctcaaaccaaacagttaacacctcacccatctaaaaacaacattgttacttcactattaattaagtttaacacagcaaatcaaaattgactgattagatttctctattttattagggtgccacgtggcgagttgagagtatttatatggtgccttgtgacgatttgagagtgttcgtacgatgtttaatggatttttagtatataatagatcgatagatagatagatagatagtatgttcatttggtttttctttttatcttatacggtagaaaattatattttatatttttctcccgattatactacttcgtatgttccttttttttttgactttatcacacaagcattttttttcttccggtgaacggaacctaagctttactcttattttccgaatcatatgtattgaacttatgattttttttgtttatgccgacggtacgtattttcccttttatacagggaaggtattatttatatacctaatgattctaaagtaatgggttcaccaatttaaataaaaatcaactatagagatctaatctaatggtctaaaataacaggtactaattaaatgaaaattgacggtgagattagatagtgctacgtggcgacataagagtgtttatagagtgccacgtggtggcttaagaacgtttttaggaagtttaacagacttttactatataatagatagatattataatatattttctttcatctcagtaaagcacgaacattcagcttgtacggcatcaaagtaatgagaatagtttccaaaacaacatagctgttttgttaaaactattacacgtaattaaaactattacacgtaatttctttcatgaaatagagtaaaaatacctatgatcacatatacatatgcatactcgcatatgaacgcacacatacgcaccatacttatataaacggcctgtaagagactaggccgcatatgagatataaataggagcacatatgtgatgaacattttaccctacctactcagtggatatatatgttccaccataaagagacataactagctaacctatgctcacactataacgaaatcattctgcagaagtatttttatagaggtgaattttaaattatctctaaaattaggtgaatttaaattgtctttaatttttctacaaaaaataaaatgtatctatctaatatttatccacatataagtgttgtagaaatgttagacacgtttgttttggattaacatgtagtgaaaataatgtgagaaatgataatttagtattcttatatgttaagggttatttcagagaagggtacgtaatttttacccggtctctatatatatatccaacgacgggatatacacagccttttaaattgggaactaaacctctcaaacaatccaatctaaaattcgctcatataaaaatttgacttagaaccttgaggtgctattaaagtctatatgcccttttacttacttgctccgtttcacaatgtaagtcatttcagcatttcccacattcatattgatgttaatgaatctagacatatatatctatctagattcattaacatcaatataaatatatgtctagattcattaacatcaatatgaatgtgggaaatgctgaaatgacttacattgtgaaacggagggagtatatgttaaggtttagaacattatagcatgcatgcatgctagttttagtttcttagtcgattgatgtggtatgtttagatgttagcttttagatatataattaatgagttttaattacaaaaaaggtactcgctccgtactcataaaggaagtcgtttaggataatatttaagtcaaaccttgggaatataaatcatgaataactttaaagttgttgagtttgaaaatgtaaaaattatatgaatagatttgtcaaagttgtgttttagagaccgtatcgttgtccaaaataacttcctttgtgagtacgaagggagtatagatttccacatacatgagcagccatgatttctccagcctctctttgccacctactcctatatagctcttgcatcggtcccgcgcctctagccgtccccatttgtacttatcaaatcttagtttatattgctctgtatacttctttggataataaataatcactactgtacatatttgcgcaacataatatatagtttgaaaatatgctaacacatattgtcaacttgttctgaaaaagttattgtttgatataggagccagactagtcgtcgactagtgaaaaactgatttatctctttcgtattttctcgtcagcaacattacaggactgtgtgtgcatgtgcacgtcgtcgttaaagttacgcccaacagtaatatgatagtcctttccgaagaaggagcacaatttgtcaaattgctagtgtcagtcaaaaccggtacggaaggtcattaatttgtcaacagtaaattaaataattcagtcgttcggtgctcccctggattactcttgtaatacgtgatttaatactcgctcagtcgagaatgttgtcaaagattaataaaaaaatctgttacatttagaaaaacggagagtttatgtgtgtgcctgtgtgtgtatatatacggtccaaactccaaactcgatagcttcgctccagcatcgtcccaggttatcactcatcaggtctccatggctctcctggttttggtcgctgtactggtgtttgaagcagcggttcgagccgacggccagacaggtcagcttattttttctattctgttgtcccttccactacaaaatactcttactatctaattttgcaaggcctggttttatcaagcatgatcttaaaaaagtgttctatgcttatacacataaatgagtaaatttcataaaagtatagatattattttatagatatttctttttgaaaaaaatataaaacacagatttaaggtggtgatgtatcacgacgtacatacatatttaacattgagttcattgtgaaaagtcactgtatatatggtaaaactataggtcgagcgttaatttgaacacaaaactgcagcttcctggctgtgctgttaacgtgatgacttcaaatgtaaacgttaaggtcatcaactataaaattacaaaactatagatcttagatgtacaattttgatatagtgtttgtgtctacttcaattcatttgaaaattttaaagcatttatcaattagatcagataatttctaacacatatatgaccatataaactatgtcaaataataaattgttcagcaaccatgttgtagatcttgtcaagaaatataactttggcataaagtttatattcatcgacttcatataaaaatattattaatttcttaataatttcacttcgatgctcagttaatggtgggccgaactatatatgtggtccattaagcatagtgtcagattctattatgaatcagcagtgatattttcaattcataccactgttaattggttggtattttcaaatcatatcattgttagttcatatcgagaaccgacagtgatagttgaagtatcattgctgtttattgttatgaaacggcaatgatacattagtgttggctaggaaggcggtttttacactttagtgaggacgtgttagtagaaaaatgaagtatagcggcgttgatgaggtgggagaaatcagtaccattgagttgagacctaacatctggagaatgtagaattagaagagtattagacctatatttgtaacattttgtacagaggctgccttaataaattgaacaaaagaacttaaacaaagaagttaccccaatggcccattaggttctatactaacaggtggagattaaaacttttctatgccatttctctttggtgcacacaataggtttcctaagtatcgactgcggcctggaggcagatgacagctacccagacgatctcaccggcatcacttacgtcccagatggccattacaccgacgccggcgagaatcacaaggtgaccaccgtataccgcaatgcttggtggggccctgaccgtactctctacacggtcaggagcttcccatctgccgagggtcagcgcaactgctactcgctacccaacgacgtccggtccaagtacttggtcaggctgaagttcttgtatggcaactacgacggcttggacagctcgtcgctaaaattcaaccttacccttggtgtcaaacactgggacaccgtgagtatagacaccaccgacggaaatgatggttataatgttcacgaagcggtgttcgtggcatgggcgagctgggcgccggtttgcctcatcaacatcggccaaggcacgccgttcatgtccatggtggagttgaggcctctcggtatcttgccctacccggctgtcatgggcaatgtgtcactctccctctatgttcggagcaacgtgggatcgagccctgatgatgacaaattagtaaggtatatatgttctgaatttccttggatcttgtacatcttgcagctcagctagccagttatacgtgaaccaatatatcacttgaagctgttttctgattttattaatttagctaaacaacgcactacaaactggggattactgccggttccacacattaattaccagctatatatgtttgggagacgaccagcagcgatactgaattttacaaaagaaaataaaatgattttaattcgtacagacaaaaaaaaaacaaatgcacactgattcaaaaatagattcaacatgaaattaaagtatcagtcccgttttttcgtgtgaaactgtagttgcacttcgtttgaatcattacatatgtcatcttgatttaataa

SEQ ID NO: 71690 - DNA, 8483 bp, Oryza sativa
gccctccgcgccggctgccgccaagaagacaggggagaggggaaggggaggagaataaggaggaagaggagaaggactgagaaggagaactagtggaggggcagaaaagctaaggataagactgaggagggacagacagatcgacgcgccaagagataaacatcgcgccggcttggggtgatttttagtcccggttggtataatcaatcgggactaaaaatctatctgtagtcccggttgtttataccaactgcgactaaaaataatagggagctgacacgacctgacaacttcttcaaccgggactaaaaatgatctttgtcccggttggtaacaccaaccgagactaaagatcaaaaaatacccctcagcttttaaaccgggactaaagatgctttttattcccggtttttattggaactgggactattgtggaatttggccgaccgaccaatgatggtttctccaccagtgaatactatatataaaaaatatttaaatttaaatttaaatttgaaacgggtatgtaaacttttgacttataaacttttggtctataaactaatatttgaattcaaaatcaaatttgaatcgggtatgtaaactttttgacttataaactttgggtctataaactttatgtgtataaactttatgtgtataaactttagatgtataggaatactatatataaaaatatttgaattcaaattcaaatttgaataggatataattcaaattgaaatttgaatcgaatatgtaaacttttgacttataaacttttgttctataaactttagctgtataaactttaaatgtatagaaatactatatataaaaaatatttgaattcaaattcaaaattgaatcagatataattcaaattcaaatttgaatcgggtatataaacttgacttataaactttgggtctataaactttagttctataaactttagatgtatagaaatactgtatataaaaaatatttggatttaaattcaaatttgaatcggatatataaacttttgatttataaactttgaatctctaaactttagatgtgtaaacttgaggtgtacaaactttaggtgtataataattttattaaaatagaaaagtaatgcggtgccaaaaaaaaggaaaccacgtcgaggagagggaggcgacccgatcgctaggggcgatcgcccattaggagtttcgatcaacagatgcactagtgaaaaaaaaaaggaagtggaagaagagacctgctggctggtcgactgcaagaacccctgattccagcacgagtagtacaacaacgagagccaagagccccatggagtcttgaattcctgataattaacccaggagcgatctatcggagtttcgaccatgaccaataactagctatatctccactgcatacactaagtatgttgagacatgccgactggcgtacgtttacttgttacaagccacagcgtacatctcggtcactatatatattggctgcatccattattggttcaagccctgggccgggtatacttcactgtcgacctgtcgttggtgccctaagctgattggcttttgatttcttggagtttttgtcaaagcattaattctccggactttggcagacgtgactctttctttctacttcctccgttccacaatgtaagaattcccagcattattcaaattcatagagatactaatgaatctagacacatataaaaaagatatacatcaatcaaaaaacatatacatcaatcaacacataaatctaggtaagacaaaaggtcttacaatatgaaacggagggagtactgcatatggcaaatggtgttactctatgtcacaaagtcgagcaatgcatgtgagacaataattttttttaggtttttacacaggagggatgagattgttcgcgtggtcctaggataggaacgatgttaccaggacaagtaacgtggtatatgtcacaaagccaagtccaaccgaatcgcgacccagttatgcacccaatgtctctttgacactacttagcaagaatccgccctagactgctaccgcctactcgagaccgttgtcgtgcagatctcctctatcttctgcttggatctatgaaaggagaaggtatagagtggagagagataagaaaaaggtgagaaaaatcatgggacttatgttgccaccggtttcatggttgacgaatccctagtttcatggttgatggatctagccgtccccgaccttgcgtaggctgaatctagaggcgtccacaccaccgaccttactcctcttcctcctagatctatcagagagggagagaggagaaggttttaaagggacagaggggaggaggaacagaacgagaatagaccatcctaagccatcctccatttcccgctacccactccctacatcttcgtgtggatgagcaaatttgacacttggacaagataatatcaagcttaagccaaatttggaaagtaacctctacgttagtgtctagtccgatcacctatacaggcctgatgtgaccgcctacaaatgactggtctaactagataaaacagagtttgactggcagactccaacagcaggatgctccatggcagtggattaggcggcggggagctcgttggaggcggcagatctggcaagggggaccttgacgggtgcagatttgctgcaagtacctcctcacccaatgaggcaacagcgggctcgggctctggtggaggcaggctcgggtgagaggcaccctaccgccgacaacggcgcgaggggcggatccggcacccccttcccttccgcacagatactgctgcctctccacacccacccccaccccaccccccaagcatgcggatctgccaacggcttcgagtcaggctagctaacctcaggagcattgatccaccacccaccggcctcggaagcacggatccacttgctagcctgtgattttactctttgatctctttttgtgatgaatttattgaatggattttgaggattgtgataagtttgtgaatggattatgagtgtcaaggggattaggggaatttggatataccgtagggggatattttggaatctgcaggatttctttttagacactaaaaacattttcttaggcatatcactttacgtcttaaattacagtcgtcgcttttagtcgtcgcttttggtaattcttgcaaccacaaataaatctgcaagcgcacgaaatactgttgtagcacttcaccttcgggtgaccccaaaaggatatcgaatacacctgtgtaatctatctaaagctaagactatccaaggacaacaactataggtaggctagttaggctaaagatgactttctatgtattttaattatctaagctaagttaaaggtaatttcctatctgttgtttcgggcgccgacccctgctgttctgccagtgtggtttcggctatagctctatgatatatcctaacgtggaggattactacctctaacaaatccatgggatacacaacaaatataggtaatttctgacctagacaccacgcctaagttcttaattactactctaatacttacacatgaacttccttctttatccagagtcctagtaatagagcacttagaacgaatactaaacaatgaacacgcaaagatggaaatatatctcacttatactaagtaaagtttctccgaacccatagcagagtgtaccgagctccggtactcctcctgaattcctcctacaaagctacactcgtcgaggtagaagtccaagaaagcaccaaacttccgggcattcctcgagagcttccactcactctgtacctatattctaatatacaaaagatacaatagagcatcttataattcagctcaaagttgtgtgtgatgaatgagagtgagctcctccttttataggctccaaatgatggttacagctatgggaaatgaccaaactaccatccaaccgtcgttgggatgaaattaggagcgtccacgtggaaggtggcaatcaacggcctacaaataggttcggccgaacccgagatggctccgttgaccctgttttccctcatggacactaattttgaggcccttagtccatgggcatggtggttgggcccatttggaggtgtttaattgggcttttgggtccaaaactacctttagtttggatatgtgtttggttctcctctttcttcttgtttattccctctcaactttagttgtttgttgcatgcatccaaatatataccaacgctagtggaaatgattagtaataaaccctaccactcagttgaataccatattttattctattatatgtaggtattgatggtcatatactatgatttaaggatcgtcgatagtcacgactagccgtatgtcaaaaaatgttcaagccatgttttggccgactatgaaaatgtttttctagtagtgttttggagtgcagatccggcgggcggcggtgtcaatgaaatgggaatggggggtccccatttccccgtcaaagcaattaatcaagtaccaaagaatttccgaaggggtaggctgtaagaacagagtttcgaaattcaatattatactttagtgttttaattaaggaaaattgttgcgtctttcgacaacaaaggtcaatctttcctatccatgagccatagctcccccaagctgccattggctatgcgggtgcactgtttctactttgttccttactcttgctgatgcgaaaaacacacactggcctgggagatctacttagctccagtgcaggaccaaaggttggtgaggtgtaggcgtgccagtcagtttgatcctacaactaacaagatacaaaaatagcagatcaatgagccgatcggctgacaagccgatgggataattctaaccgatgccgataccagctgatagcaatagggttttaaacaaccggctatatatccaatgtatataatgatataaagacaatcagctaatgatggtaaaatataacaacaatataatccaatagaaaccaatcgcctaataatgatatgatagaataagcactgatccgaaggttaaagcatgcatcggctggaggtccgattcataaaatccacaagattatattaaacaatgaaatctttgttgccatcggctaaatccaacttgtatgcaatccttgtaagccgaagcaacatctagataactcgtcggctgaaaccccgatgaaacccttattggcagtaaaaaaagcaggctaggtattatggttctaaacatgacttagcagataaacttaactgatgcagcactaagtatgaaaagaaacataatatctagacaatcaagccgttgactgatttttcagggtggtagatgccttaagtaatctaatatagtaaaacaatttagccgataccagcagaaaccctaaagcgagagacaaccaataaagctaaattgagatactaagactagattaacgaagacatatgataaataggcagacaaatatatcatccaaacaggagcatccaagaggttgaatgcactgatgcagcattgaacgacaccgacatagacgagacaattgcctgggccggcggaacgtagaacttaccccttcgccggagatcgatttgaaccgatgcagccccgcgtcaggtgcctaattccactggttgataagtaaaaacctcagaatagagggtggcgatgcgccgagagtagtattgatcaagagatagtttacaatgatcccggatgtacatatttatacccatggggacatactagtccttgtaggacaagaaagaaactttcctaaaagataaaaggaaagcataaagtccttataggacactaaacacacgtttctaaagataaaagaaactaacaaattgtgcctaattaatagataaactgtcatgtcgcatcttacttgaactcggtgactcctagataagctttctttaacagattaatttccttaaccgaatataacagtaatccgactattggcgacgtgataactctcttaggggcttaccaaatttcactgttaacaactctctagaaaaagtagaattatcatctatacgggtcaatatcgctattaaataggtgaaagatatttttttaatagttttcagcgaggtttactcatttttataccgactagataaaaaggggcaataaattgtatttttctatcttatatttagagctgttgacacagattactccgccaacacctctgcctttacgaagtaatcattgatcatatattgccgtgtaaattaagaagcatcgtcgctgcccaaaaccatcaaatggagaggtcacgcatactcaacaaccaattacgcagagccaagagctgaccgattacaatttacacacaccgcaagtaagcaagctacaacaaaaactgaactccctcttatctaaaacatattttgatatcggtgagaattatatatatatatatatataattacttaaatctgggaatttgatcgtatttgtgttcacatttaaagtggacatcttagatgttaattaatggagaacttgacgatcaagctaaggatggattacatagagattacgtacccctgttcagattcgttgtactaggatgtgtcccatccactacaaagtttgctatatatattttgggacggagagagtaattcggtttgtcaccaagctccgaaggcccctgcaccacactgggagaaaccaaaaaggagatcgagatgaagctaaatatcgatggctcttttgatccagtggaagagcggggggaatcggtatgatcctgagagatgacaatggggccatggtcttttctgcctgcagatttatggagcgctgtaatggggcgcttgaggcagagatccttgcctgcgtggaaggaattgcattagcgcttcactggactatgctcccttttgaagtggaaacagattggttaacgctgacacagatgctgcaatcaagagaaaaagacctgtcggcctctgcgcacctagtcagggagataaggaggctcattgacggggacagggaaatctctgtcaggaagatccatcacgctcagaaccaggttagtcatagcttagccaataaagcctggtctgaggttctaaatgaattctggctggaaggtggttgtaattgttggaaatatggtcatgaatcggcatattttaatccaaaactttaaagcaataatcatgacataagcagtgtatggtgatcttaatataaccagtagcatactatacgcatcatgaatgtcaagaacaggaacattacaataacgcaataacatgctagaggcatcatgaatatcaggaacaggaacatagcgcacatagcagtaaagcgctaacagtggaaacaggaacaggagaaggatataccccgagaatggacctccgctagactgtgaggcagaattgcctccattgatgttgttgttcgcgccatcggctccagctcctagcgcaccacctccggctccagctcccggcggcgcaccacctccgccatctcctccagcagcggtggcggcaactccagacatggcgagcagtcgtgcgggaggtactccccaaaaacctgatcacccgcttacccggtgtagatctcaggcgaaggtgtggtttcggaggcactgctacttccaatctctcgtgcgtgcaagagatcagaagcgaggaagcgagaacagtacaggcgcggaggaggaggaactaacaccgggaaagaagcaagcgatcagaatagatcggactcgcggcctccttatctatcaggagagagaggcagtcgtgggaacgtggacgcgctgttgtgaagagagtcgtgggaacgtgggttagtggctgcaaaagaatagcgacgtgacgcacgcacgccgccgccagccagccacgcctcgcctcgccctcgcccacgcccacgcccttcggcctcagcccggcgcgcacgcgcgcgcgtgtagcattccgacccccacctcaaccagtcaacagggagcctccaataactccctatttaggttgagatattcctcacttaaatcctgagatagtattattatccttaacacttattatgggcctttgagatttaataggataagttgggcctagcccaattattctaacaatccccaccaaatttcaaggctcataagaaatgttctcaatgttgtggctgtttgatataccagggttttggtggagactgttgagttgaacttccacctaggaaatgagctacatcagaccacaactgaacaatggactgtgccttgaattgtcagttttgtgtgatcaggtttcactcagaaccttgactggtactgggctgccgttcgcatcccctctgtttggagcatataagtcaaactccaggcctttcatgagtatcttgagatcgcccaaacctcatagactgtgactacagtcgaactcata

SEQ ID NO: 71691 - DNA, 18786 bp, Oryza sativa
  unsure (1)..(18786): unsure at all n locations
tctgaacagggtaacaagcagagtggatagaagtagttttaggaaagggttaatttgatgcatgccactataaatattataaatatgacatattaaaaaaatagcgtactagaggagctggtctgaacagggtaacaagcagagtggatagaagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcaggtcgccttcctcaccgtgacatcatgcacagggctccaacggcaaggtagggacatcgtgcaccgggctccaatggtgagcttcccaaggagggcggcggcgtacatgcgcgccatcaaaccacggcccgccggagcacgaagcactcaaggtagggtaccatgaaggccacgcgcgaagcactggttcctctcatagccggacaggtcactcccaatcagctccttgatttgggacaggccgtgcgacgggccggacaccgaggtggtaagcacgtccaggtccacggtcgccgtcttcctgacattggtgagctcggcggcgagccccgcggcaatgtccgccgcctcggcggcgctcgacagggtcatctcctgcactacgaagtggagcagcgtggcttcccgtcggtgccctcgacataggtgaatttgagcagcgcttcgagcttgaacgccatggcgccgccgcaggaggtcccaacgttcatcctgttcccggtcttgagcatagcctccagcagcttcaggaataacttgctggacattagctccctgcacgcgtccttccagacaccaagaacagcatgccattaaacctcgagtttaataaattacanatacaagcaggatcgctgagaccggcggccattgcgacgaacacccaagattcacctcgagcatctcgaacgacttcctgatgtgtccgacctcgtcggcgaaggtctcccggtacatcatcgtgattaccaccttcagcagcctttccgccgagaccaggccgtcgacgtcgccgtcatagccggacaatgtcgacctcgtccttccagctgctgtgccgacaggccgttccctgcgaacaattgttatgtggggaattccctttcagcggcacgggcgaacggacgaacgccgtgcctgacgggtgatctagcgccaactgaattcggtggattcggatttgcttcacagtttgtttctgttatcccttttaattagcaagtttgttagcatgtaaggctactattgacgtaaaacacgtggcctgggagatatgcttaactctagtgcaggtccaaaactcgccttcgggtatgctagcgtgccagttgatttgatcctgcaatcaataagaaataaagacaaagaaaccgcggttaaacctataaacgatagccgatcggcttgagtgccgatgacatatcatttatctttgagccgatgtcatataggtatcgatcgacaatcatgaataaataagaaggaactaaatcaactcgatcggatgtagatattaacaatatatactccttatattgatatatacttaaatcaagtgattgggatagatcggtcgccatgccgagacaatataaatcgctttgatcgaaatatatattgataatgggactatatatgttcatagcatagccgatcagatagatctaacatgtatcggctaatactccgataccactctatattaagatattaaagcaagtagaatatatcaaacaaaggcctaataaacttaaatgcaacgagatcttaacataaaggacagatttaacatatcaacgaagcatatagagtaaatatagttaaatcaggtaagatctgatgaaaccctgatatatactatcctaatcggcaaccaagaagcaggccagatattggaattttaatcacgacttataagatcaaactcaactgatgcagctatcgagttttatagagtggtggataccttatataatctaagtcaacatcgatatctaacctaatcggctgccctctaccgacaaatgttagccttttgtaggttagatagcaatattgccagagattatgatatatgataactcgatgaattacataaacaagattagagtatcataaagatggaagcactaatcccgagaacgcaagccgccataacaagttttacctcttgttgaagatcgaaaccgatgcagctcaacctgaaagcaaaaactcgtcgaaacacaacaaaagtaaaagggtggcgatgcgcagagattgtattgaacatgtattaattaattacatggggttcggggtctatttatacccgagaattacaaactatgtccatatcagacacgactcttatctctaacaaactctaagataccataagtctttacggcagacttttgcccaaacatatctctaaggaaattacataaaatatcctaattaatagatacaactgccttctcaggactctatccatgcacagcaatcatcatgaagctcatcaacctaaaccgacaacgtttgctgtgtcatatcgtcggattcagctcaatcggctaacctcgtccaactcgaactctgtcgatcttagccgtagccgattcggactacagccgatcttactatgttctccgatcaatttccatctcgaattctactttgattccatctccatctctgatacttagattaccaaatttggtcgttaacacatgccccccaagtccggaatattggataatgttttggatttgccatacgtcaattccgagaaaactccgttctcgccgtttcccgaccgttattcaagcgctttaaatactaaccattacccccaagaaatctcacaccgtcttcttccgtttccaccgctgaggccaacactgtcctctctctcttcggcgatttctccgacgcacaaggcgatccccaagcgacttcatctccggctagatctccgcccgcggcgatgtcatcctctgccggcccgtctaccgcatcgtcggccgagtatgctgaggtaagttctcatcggctagatcccttttcttcgcaacagattcattttccaactcatcttgttttctccttctcggttcctttggatttgtagcatctctccaacctagttgcaattcccaacctgtcgcatgaaaattactatttcctcggcgcagtcggcaaccctgatcctaccgagttcattatcagcaaaaccaataggattcctttcagattggccaacccaaatctaggtcactagaaaaataccttcaaatcttggccatctctcgataaaactccacccgagaaaagttggactacatggtataagcgcgtatcggctagcaagaaagttcactaggacgagattggaatcggccaagcgcttgcccttaccatagccaattcagctaaagatgaacctctgatggccgccgccacttatatttggtccaacactatcaatgcctttttgttcaaccaagggccgatgactccaaccctgatcgacatcaccatgatcactggattagatgtaacctcatcggctaaccctatgagtatgaacaccaagaaccaatttgatttcaagaccaaaagcatagggggttagtctggctatatagcggcatatatgggcaaagggcctgtcactcctcgggagcatgtagctttcttgctaatgtggctagagaagttcctcttctgtggatccagttgtggtcctacaaccaattggtaatttgtagccgaagccctagaatcgaaaaagcaatttcctctaggcaaaatccttctcggctatctataccaaatgttgaataatgcatcagctaagatagctatcagatcagtagttggagcaggtggaccatggtggctattgcagacttcgttaaatctgatggtcatgaaagttgtcaatcggccatctttgacagaagccgaattcccaagactggagccgattgtagaagatgatggagaagagcgcactcatcgcagatgcatgtcatatggagaatatgcatccacaccaaccgatgccggagcaaaattatcggctgaactgctcaaggactggttctgcagtttctatgatggctttcaaaaagatgttcgagtttggtttccttatgaagattcagcaaaccttgagctcccatcggactttagatttgaagatatcaatcatgaaagataccaaaagtccagggaagttttctcagctgcaatcagcccatgcatgctttctgtcggcatccatcaggggaaaaacatccaagtctcttatgagttctatcatccaatgagcttagctagacaacttggaatgggccaactcctaatcagcttattctttgccgataagatcctgtgccgaggggaaatctcatcagccttgatgatggatcggctgctcaatctccaaggacctcctctgggcagcattgaaaatatagggctggcaaagttcaggagcaaaaactttgacagatggtagggtgaatggaaactgcatctattccatcaatcggcttctatgtacatgacagatctctttccagatgttatcccttaggtatgccttcatttaattaactccgtttaaataattgcttagccgattcataacgtaattaattttctttcctgacttgcagataagggagttcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgtggatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcagccgattttgtctaacacttgtctcttttacagcctcctcctcctccttcttctcctgtacaacaatcatcgagtgaccaaactccatcggccgtagagagccatcatattgaagaagaagaacaaccaactgcttctgctatcccagtaagtttccttttgacacaagaatttagatcggccatgtctatttagctctaactccctttaaataattattgcaggtcttagccaatcttttctcttttgacataagggactatcttgacgagacagaagaggataccacaagcaaagctttagcccccttatccgatgatgtgaagaaaattcttgaagatatctctcatcggctagaggcaacatcgttagacagcttagtggttgattgtggctcaattagaactcggctacatgaggttcaagctctgatcccagatgagctagccgatgtccttactccagccgtctatcttgagcagcatcaattcaagctggagaaagccaagcaaagattagctgaacgtcaggggcgcaaggatatcgaggccacaatccaggcaaatcgacagcttgttcataaagagaaggccaaacatgatcagctatttgagggcccgattaaatctaatattgatcggctcgaagctcgtaagattgagctcttggcacaacttgaagaatgcaacgccgagctggatatggaacataaaaagctagccgatctcccaaaatctatcgaagaacataaggcaagactaaaatcggctatcaagaatgttgctgatcttaccaagtctttaaaagtcatccccagaaccaacgctcaagatccaaaagccattgaagaagtagaacaaatcaggcaaagggctatttcagctatccagcaatatttgtctcagtgatatcttgtgtaatatgtcctagaaatgttttgtaatcggctaagaaactttggctctttatcgaacttatcttaataacttttatgtcgattcaatagaactccatattgtgctcaaaaatctgcagttttcatatatatgctgtcgggtcccaaaactattaacttggatccgattgagattaatatatcaatccctggatcagtaaatattgatacatgtaatacagctggttcttcattgcatacgataaagtttacaatactaggggttttacaagggtaggtactcacctaattaaacatagatgctaatattacacagcggaagttctagtacattctaactaggaaggtataacctctaaggattttctaagttatcagggtcatcatagtaatagtcataggggtcctcctcttcacccaaatctgaaaaagggttaataagagcaagggtgagtattcgcaatactcagcaagttaccataaaaatatgttatgcgttggcaaggagtgaagttctttgcagaaagcaataatagacaatctggaaatattaaagcaagagtttgtaaaatatatactttaggtttctaaccagggtaccatatgagtcccggtactcaattccgtgagtacggctattcgaatagtttcaaagatattctactgcagcagatgtaagctttacccgcagtccatgacttgctgataatcatcagctttagttatggcccagtattaggttattaacaattgtggcacctattccatgaacttatatcctcatatgctctgaacgtaatgttaacagcagcaagaggagttctggcgttcccgaggtatttaagaggaactggtcgtatgacaccacgtcatctcggtcagggtttagaaatataccatataatttatagtcgagtatcacaaaccattcacctgtacatggtaatggttaaatttgcctttcgcggctatagttgcctcctgcgcgaggacttaaaaataagaaccactatacagaggtaccacattgctaattaacataataactaggtctgtccccattctacaaactgcgttgtacccgttcgttcgacataagtacctggtgataactatatcgatcgagacagtactagccacccgaaaattatccaattcttacgtactgtcccaatctaagtataaaatattttaaccagattgtaagcaagataagcaatactaaattatctaggtttctatggttgaattatgcatataaaatagagtattgaatagaaggctataaataaataatttgtaaaatataggcttaaaagatcaaaaggtagatagtaacttgccttgctcgatatcctgagattgattgagattatctaataggttaggagactcctcaagatttagggttaaacatgtaaaattcaaattcaaaagagattcgaataaaatccaaaaataagcaaaataaaataaaataataaaatagcaaaagtagcctcaaaagatagagaaagattttggtccaagtttcattggaattgggtttatattttaaaagatatgggcttctaaagattgaatttgaattaaattgagaaattagaaaggttactgtagaggggcccacccgtcaatcttcctttctttttcttattttcttcttcttcttccttcgtttcttctcttctgtttcttccagggagctgagtggagcgagagaagggcgccggtgttctagttgacgggggacggcaacgtcggcggtgaaacatgttcctgagcgacgcgcatccagggagggtggtgatcaggagagggagtgagggaggaggccggaacggcgatggctagggcttagctccggccggtatgggaggtggcggtggtggctagtctcagagggggaaaggcaggggaaggttaggaaatggatttgcctcgtcgaggcgaaggtattggcgagagggcttggccggtaatgctccgataagggagatcgaccgacggccggcattggaggagagagagagctcggtttgatttggggaaaagaggagggatggccggctacttataggcggcggacgtcggtttgcgaaggtcggttcgccggaggaggacgaggaaggcacgacgatgaccttagtgaaggaaaaggggacggtgccggcttccgctcgtgattggctggtgatggcggctgcgtacacgcggcgacgccagggatgttgggcggcagaggaggagaagcacggcacaatgatgacgtcggcgcgactcggtggcgtgaggaagagggacacagcgacggctgcttaggggagaagaaaacggcgccggcggcggcgcgcgtgttggacacggcgacgcgcgcccagagagggggcggctgcttctgccagtgggaccggctgggccaattgagccgaagggagagaaaaggattcggcccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcttataaggagggacttggatcgatccatgacaagccatccgataagaccacaatgcttcggccaaacgagtatgccactgccgaggataatcagaaatctttcttttaattaatttgatcaagctcttgttagatgcctcggcctgcccattagcttgtgcataatatggtgaagaattcaacaatttgatacccatgctataggcaaactaaacaaattcatcggacacaaaaattgaaccttgatcagttgtaatggtttgaggaataccaaatcgatagattatatgttcttgaacaaattgtatagcatccccagaatcaaccttcttcgaaggaatcgcttctacccacttgctaaaataatcagtcgccaccaatataaacttatgccctttactcaatggtggattaatcatgccgattatatcaattccccaacctctaaatggccatggcttaatgatgggattcatagccgacgccgatgccctctggatcgccccaaatttcttacaatcttgacatcccttgtaatttttgaaacaatccttcagcatcgtcggccaaaaatactctgcacgtcaaagcaaccacttcatcttatgagccgattgatgagtaccacaaattccttcatgaacttctccgatggcaaccttagcctgatcagcactcacacacttaagtaacaccccatcaatcgtccgataatagagctcatcatccaataaagtatacttcaacgctttatatcttaatctccgagaagccgactgagatggattctgtaaatattgatgcacatcatatctccaatcatcggctgttattgcagcaacttcaaccttaacatctttgatcatcggcttataccctgatgccccttgggccaaatcattagcttcaatattctgctctcgagatacatgcctcaaggtaaccagccaaaattccatcattagttcttggcacttctcattataaaccattaatgtatcatttttgcactcatattctcctgccaattgactgattactagcaaagaatcccccataatttcgatagcatcggcttcaacttccttgagtaactgcaaccctttaagaactgcctcatattcagcttgattattggtcgcataaggtttaatagtgtaagcaaactcaaaacatgccccacgaggggaaattataactaagccgataccacaaccatgagtatatactgatccatcaaagaaaaaagtccatggcacgatctcaattgagccgattaaatcatcacgatgatcaacaatgaaatcggctatagcttgccctttgatcgccttcggtgactcataccgaagatcgaactcagttaaggaaaatatccactttccaacccttcctttcaaaattggagccgataacatgtatttaacaacatcggctttgcatatgacagtgcattcgttggacaatagataatgccttaaccttgtacatgaaaaatataagcacaagcacaacttctccacaggggaatatctagtctctgcatccaagagccgacgactcaagtagaatacaactctatctttcccttcgagctcctgaatcatgaccgagccgattgacttctcaccggccgacagatataacctaaaaggtatccccttctgtggaggaatcaaaactagaggagagctaagatattccttaatactgtccaacgctttctgttgctctgccccccaagtaaactgttgatcggctttcaacctcaataatggtgtaaaaggctctaacattccagacaaattaaaaataaaccttctcacaaaatttatcttgccgatcatctcctgcaactctgtcttgttctttggagactgaatcttcttgattgcattaacactcctttgagttatctcaattcccctctcatgaacaagaaatcccaaaaactggccagccgatacgccgaaagcacactttgttgggttcattttcaagccatatttcctggttctctcaaaaaccttcctcagatcagctatatggtcctctatctttttagacttaacaaccacatcatcaatgtagaccccaaccaaccagcagatcagatcatgatatatataattcatggctctttgatatgtagccccagcatttttcaaaccaaaagacattacaacccagtcaaataagccaattgtaccaggacacataaaagctatcttatgaatatcttcttcggccataaagatctgattgtaccctgcattaccatccataaaactcaaaatcttgtgtcctgaggcagcatcaaccagttgatcggctactggctttggatattcatcctttggggtagctttgttcaaatctctgaaatcaatgcataccctcaccttgctgtttttcttgataacaggaactatactagaaacccactcggtatatcggcaaggacgaataaaaccagcatcatataaacgtttaatctcagctttgacaggttcgagcatatcggctttgcatcttctcggaggttgttggtgtggcctgacccctggtttgataggtagccgatgttcaacaatcgatcggctgagtccgggcatctcataatactcccaagcgaagcaatctctgaattcctttaatagctctatcaacttggttctgaattccgaagataaattcttactaataaatgtcggccttggtcgatcaactggacctatatcaatctcttccaaatcatcggccgacatgaaaccctgtccttgtttgtcatcgagattttctactgtgtccttggtgtagacatttgaaccctccacgacgccctcaaaataataggttgggttctccatctacaattggttgtatatcaaaatcggacacttttagaaaatctccatcccaaacttttccagataaacaatcaagaccatccatctcccaaagagctaaatctgcactggcaacattgactgacctgtcggctggcacaatttcaatcttgtcgccttgccactgaatcaagcattgatgcatggttgaaggaatacaacaattggcatgaatccaatccattccaagcaacaagctgtaggaacccttcccatcgatgacaaagaacgttgtaggtatagttttactgccgacggttagttccacattcaaaactcctttggtttctgatggattgccaccaaaatccttgagcaccatgtttgtcttgatgagatcttcagtgtttctgcccaacttcctgaatgtagcataaggcatagaattcactgcagccccaccatcgaccatcatcttggacatcggcttcccattgacctagccatttatatacaatggtttaagatgccgattctctgttccttccggcttttcgaagactgcttgctctggtgacaaaatcaatttagccggttcttcttcaacttcgtcaacatgggcttgcttgaccccaaattcagtaggcaacgtgaaaaccatgttaaccgatgtagttacaaaacttttccctttagccaatctctttgcttcatcggctacaggagcttgattcttaacgcgccactcctgcttcggctttgttttttcagtcgatgattgatttcttgctcaacctcctaaaatcattctctgttcctcaacctctgaacacttctcttttgattctttgtaaagataccagaaggacaccattgattctgcatgtcttcattgtcctcttggttataatcttggttcaccgggcccaacctttgatgaacaggaactcttgtttgctttagccgattgcttctattacacgatcggcttgaactttctacaacattaccgcacccaggacagtcctcgatagatggcagcctcttgcccaattcttcagccgatgggattgtatgaccagcaggaagttgaatctgtttctctcggagtaacaaatcaaaaatcttatcagccttggtaatatcaaagtcatacctctccacttttccagaattctttacccattggcatggtataacctttttgcttctcacccattctatctcagagtcatcatcatcatcatcatccgatccatatatgtaaggacagacatgattaacctttttaaagttcttcctgacttctgcaaacctctgttcatgcaaggttaccttctgtccaagatgtgacaggctatcaaagtcttgagacgagaatttctccttgatcggagcaatcataccctgaaaagccaaatcggctaactgggcatcaattaaactcaagctgtagcacttgctcctcatctctctaaatctctgaatatactcatgcacaggctcatcatatctctgcttgatcgctgttaaatcggacaatttcaactcatgaatctcactgtagaaatagctatgaaaatgcttctccaaatcggcccaactgttgattgatccacatggcaaagaagaaagccaagtgaaagccgatccagacaatgacaaccggaacaacctaaccctcaaagcatccatgataaaaatcggctaacgtgttcataagttgacatactatcctgccctgagaattttgaaaagtctggaaccttgaaccggttaggtagagggactttctcaaaccatttaggggaaggttgccgatataagtttccagcgtctttcggcttaagcccaaactgctccttcatcacatccgcaatcatatcggcccatggtcgttgctgaggtactccttgaggttgttgtggaatgagttcgaattgattgtattgaggagcaaactggggttgagccgatcctccctgctgatattaaatttgcggtgaaggaggctgatactgataattcaaattgcccccctggtaattttgaaacttcggctgaatattgcgcaccaaatgctcgggatcaacttgaggtatcatcgtttgatctggctgtacatgatgaaccaagtgctctggcacaacttgattagcagcatgctgccttggctgattgtcaggtgttacaaacccagtcgatgcattcatcaaaccttgctacagaatcggctgaacaacctactgccttaacagcgtttgctgaatcggttgcaaaacctgctgcctacgtggcgtctactgaattggctacacaacctgttggattcgtggcgtttgttgaatcgactgcagaacttgctgccttggtggtatttgctgaatcgacttctgctgggttggatcaacggtaggttgaggaggtaagaacatagctgcaacctgatcttgctttagccgattcacattctgtccactatgctgtgattgctctctcaccaacaatcaaggattcactaattgacctggcgctgatgatggtgcagcaggtgcaggagccgatactggtgccgccggctgagccgatggtgcattaagaggaattgattgaacaactggctgattatcagtgactaatggccgataattcgggaatacccctcctagtagataaacttgtcctgtagcctgatattcagccattgaaccatcaaccattgtcttcaccatgtttgacaaagtgttgactaatattctagattgattgatcaaagcatagtgcacggcatagtcaacctgatcctggaagttgttaaactgtaattgtgctgcattgccgtcatgattaagacctccaccttgaactccctgaacaccatcaccttgaatttcttgagagccatcaccttgatctccttgaaagtcatctgcagcacctttaatactcggttgagccgcgtcatctggagcttgtttcacttctccaaccttagaagaacctgtcccaggaacatcggcaattacttttactttgtacttctgaacaagtgttcccttgcgagtcttcgtgaatgagctcaagaactgattccgtgcttgctgcatcattacctcaagatccttttgctgttcaggtgtcaatttgtccatagtgacgagcacaatgttggcttcatcaacctcagatagacccagcttgtggaccttagctttaacagaaccaagttcaccagccgaggatggcgatgctggcggtttctcggccatgggaaaaactgctgttgtgattttgacttctgatcggtcccactgggtgtgccaaaagcgtgttgacgtaaaacacgaggcctaggagatctgtttaactccagtgcaggtccaaaactcgccttcgggtatgctagtgtgccagttcatttgatcctgcaatcaacaagaaacaaagacaaagaaaccgcggttaaacctataaacgatagccgatcggctgagcgctgatgacatatcttttatctttgagccgatgtcatatatgtatcgatcggcagtcatgaataaataagaaggaactaaatctactcgaacgactgtagatattaacaatatatactccttatatcgatatatacttaaatcaagtgattgggatagatcgatcgccatgccgagacagtataaatcacttagatcgaaatatatattaataatgggactatatatgttcatagcatagccgatcagatagatctagcatgtatcggctaatactccgataccactctatattaagatattaaaccaagtagaatatatcaaacaaaggcctaatatactcaaatgcaacgagatcttaacataaagggcagatttaacatatcaacgaagcatatagagtaaatatagttaaatcaggaaagatcggctgaaaccccgatactaccctaatcggtaaccaagaagcaggctagagattgaaattctaatcacgacttataagatcaaactcaactgatgcagctataagtatggaaagaaggacaatatcaagacaaccaagccattggaagtttcatagagttgtggataccttatataatctaagtcaacatcgatatctaacctaatcagctgccctctaccgatagatgttagccgattgtagattagatagcgatattgccagagattatgtaagacatataataactcaacaaattacataaacaagattagagtatcataaagatggaagcactaatcccgagaacgcaagccgccataacaagttttacctcttgttgaagatcaaaaccgatgcagctcaacccgaaagcaagaacttgtcgaaacaaaacgaaagtaaaagggtggcgatgcacggtcacgcacagaaattcactagtaatttccgaactaatttgtgtattaaaatcctcgtttaggaatcaaccgactaatttgtgtgttaaaaaactcgtttaggaatcaaccgaggtacacaaactgacaatttaatatacagattcatcaaaaatacaacattacatacttacaaaagaaaggagaaaacagcagcggaattacggtctagcgaagctccggctccactcccacgggcagctcaactggggtataagccaaacgtcttctccttcgcaacttttcttcaactgaggtttgattgattattgcaaggtgagcatatgacatagtcagcaagccacacagcaaatatgcaagtgcacaaggataccaaagaatggcgtaatatagggctcatttgcgaatgcagcatttagcaaacatatgagaattgtaaaacagcagagtaattaatcatcaatattaatcaacactgaacaacacacccatgctgcacaggcccaaccatcctgaacaaccatacccggctgtacagatctatctccgaaccaggaatgtaccattccaaaccaggagcaaatcaaattattaccagttatcgcatcatttattatggtgaaaagtgtgagactaatcacgaaagacattgttatacccgctcataaccgcaggcacggctattcgaatagttttactctggctagaagtgtaccactatacccacaagacatgattccacacatgttaccatgccttgaagtaccaccacggcactacaaagggggaaatcgtgacagtacccttcgcacaacacaactcaaagcagtgcaccgtacctggatcataatcacctccttatagacaaggcatggactccccagcgacccccgtgggcttatctccgccacttctcagtctggtgccccgcaataaatcatgctatataaaaggtaaagtcgttgcccatgctggcttgtggttggcacggttaatgtttcacaactgaaactcgtgaaccgtctttaattgtcatgagcacgaccatcaaaaccatgtgctcacaatccaccattatcaagttttagttggcacattaattaattaaccaatcacgattagccatcatgagctacaattaaatatccatcattaagtgatagtgaaacattagttatcccaatcatgtgctaatgtttctaagcatggctaagcaattatatttaatatctagctgaaccaatatataagtccaactagtcaaattgtcacccatggtatcaaagaattaagtaagcaatgcaaagtggtcataacaaaggaataggttcacaccacccggtgacattccaaaaataaatgcatggttgaaataaatagagaatttaaatataggatcaacatgctcaaaggaattgtgtttgggatccgtgtgacttgccttgcaatattcggtcttcaattaatcttcttggatacttccaacgcactcacgaaccttcaaaacgacggaaacgacaagctaacctgcagaacgaggaaaacactaagaaactccaaataaacagtacatataaagtaaacaaacatgtagatcatgattttagatgaattagagtcaaactagtcccggttcggatgacttatctctatcgggtgtattctaaaagcccgtcacggatgactaatctctaatgggtaggactctatagcccgtcacgggatgagtatctctttccggca

SEQ ID NO: 71692 - DNA, 9278 bp, Oryza sativa
atccattttttccaattccctcagccaccttcaattatccaatcaaaatctcgttctctcctcccactgatcaaatatcttcctctcccatgaatcaaacttttcccctccctaatcaatttctttctttaacaccaaaaattaaatcgccattatgagctgaattcattttttttccaaacacccaatgacttgtcatctcctagctactcaccttcctcctccctcaaacggccacgttcctgctcaaccttgaagcagtgccatctcttccaattcctccctcccattaatcaattcctatacttaatgccaaaaactgaatctctatgataatttggatccgtttttctaattaccttgggctctccatctcccgatcatcatctacccttcttcttcctctggccagcagcaggccaaaagcccccctgtccctcatattcccgcctgcagcgccgccagaacagaagtgcattctccatgaaggctatgccgcctcctccaactcccttcactgatcctttcctctccttcatcaattttcgtcaccaacactaaaaattgaatcaacttgttgatctaaatccgtttttgcaattcccggtgacttctcatctccaggacactataacctttccccgccatctctctccatcttcctccaccggggcatcgtcaactacgtcgtcttgctgctgccgctgctcaccacagtgtggtctccagagatcacaaactgctgcaggggaaccaaaatcgtcttcatcatcgtctcgttcttgctcgccacccaagcgtgccaccgtcgtggttggtaagcacatccctattcatagcctgatgcctctctttttcccctgatgctgtcaaacatcgagtggttgcgcgactcgtcgccatcctaacgtcccatttgcagtgccgccactgtcgccgggagttctaactgatgtgccatcttctccgtgcgtctcgttgccaagacatcgctgcgaccacatctccattatcgaggttggtaagcgcctgcaccacatccactccattagtagttttatccttcccgttcatcgcctagtgtcatgcgtggatcattgtggatccattattgagatcaccacgcaccatgtgcaaatgccgttgcagaggaacataagagctccaccttgttctccctgtcctatttttgagactatcgtggctgtccggaagatgagacttggcatgtcctcatctctggcaccatcttctgtcaaactacagtcgtacctcggtgcctccatccctcatgcccagcgtctccacttctaactccttagacagtctcgccatcgaccagccgccaaggtgctgttgcctctgctccatgcaagcatgacgccatcaccagcccaaaccgcacatgctttttctatcgccaaaccaagtcttagcctcattgtttcggtttctccacggaagcaacaccagctcatccaatcccctctcttccttcaaaatttctccatcaacactaaaaattaaatcctttccaatggttggagttgttgtcccaatttctgcagtcacctctccatctcttagctgttcatctctcatctgctcccctacaaatagcagccttgtgttcttcgaacagacaccaagatgccgctgcattagagctctaccacttagcctacttatgtcgctcataggaagctcaagcagcactgctacaatcatcgacttgatcacaagctgctgcccttggagatcgagctggcatcatcgttgtctcgttgtgagcggtgctaccgctgttgggagctcaagccgatgtagttgtctcctctgtgctcattgtcggaacaaatcttctcccggcatttcctttgttctttttttttcatacaccactgctgtccttggtgagtctcggtgccacatcctcttccttcccctatgtcaactagcaccattgctctctttctcgagcccgatgtttctcttcttccaggtgccatcgaattactagtgaccatgtcgtcgtcatcatatcgtccactccggagggccaacgcagctgttgtcctctcgctgccttaggttggcaaccacgtcacaccgtcacttctgtcattgtctaagagtctggcatggcatgttcgttgtctcacacccatcgatcagtagactcaatccttcggccataaaatttattccaataaaattcaaaaatgccggagaatatttcttattcttttcctttgaattttcttccaatttaatattttgtcagtcatatctcggtcctcgacaagcatcaccgctccatttcacgatcatggcatcgtcctcttacccactatgcccttgcttctctcctttttcgatccggtgtttctcctatgatatccatgttgtgtggcactatgtcgcacaagtcctggacaagccggtcccctaaaacccaaaaccaatccaagtcatcgattttcacaaataaatctcagcctccatataatcagtccacaactctcatccttgtaaccaattaactgttgatcatcccaatgacaggtggaccaccccgtcagtccaccaaaaataattcctttgtttccttaacttcagagaatattttataaatatttctctttctttattcacggtttccgaataattcaatcttccgaaggtcacatctcttccatccaaactccgattcggcccattctttttcctaaattcttctaaaattgagctctacctcctgatttaattggttatttcatttgttgttattttgctgccttttcttttttttatttgttttctcctttttgcaatcgtgtagacgccgttgccgaggaggttgctgttgcaggtgaaggttcagtctgaagatcccgtgggtaaaggcaagtgtacccttgaacatgttgatcctaacttgcaaaattatcttgttttaaattatatgcatgatttgtttcacaaattatcgtgtgggtagttatgacctacttgttaattattccatgccttgaattattgttgattatccttaattatttgtcacctagactgtatgagagtcaaacatggggtattggctcagggcagtagatttgcttaccctgctcacacttatacaaattaaaatataatattgactaatgatctacttatcactgttttttttatataaactgtgtggttgtgtgctatcttcttggtggcatgtgttgcaccgtgtagtaatgatctggtggaaaatgttttagaccggggcgatggtggatctgtgtgaacctaggaggtaagccatctgtgtgcgtgcttaccgttgacctgtgtggtcgattgagctgtgtgctcctaagctgtgtgctccatttttgctgtgtgcttgaggtacttagtttaggcaagtcgccctggtcagttaaggacttcacttcgtgcgccatctgagccttaccgtgcaaccacatgtccttatgggaaggacctagcttagtacactacttagctctggcactggcggcccaggtggctagatgataggtttttggattgtaccataggacctttcacttgtgtggtgaaaggaggaccacccaagggggaagccggtgttagggcgaggtagaggaaacgctttgttactctttggtgtttagcggcactgaactgtatcttgtgggtaaagttgtacaacctttgcagagtgtcaatccattcgaatagccacatcctcggttatggatatgctcggtgatttcacatgaggggtagatttgtgaaagttttacttttgggaaagagctatgtgcaggataaattaatgaatatagctgtgtggtcctgtgtgcagtatcctttttgaattggttggttggttaaaaatatcgtaattgcaaatgttgtttaaattaaatttacatctatttattgtatttaaattcgcaaatgcctttatacaaatgaaccataaccttgctttgaagccttgtatcatatattgcatattcccgtacacttgtgagtactttatgtactcacccttgttgtctcacaaaatttcagagaaggccagttgtttccagaagttctgttgctgaggatgtcgaataggttgcgtgccccagtcgattgcctgtggtgtgtcattggtgcctctcgcttctttttccgctgcttatctttgtttggccctgtgtggcaaagaaattgtaaaatatggtcataagaccaatgtaaaaattatatttgtttcctatttattaatgtaatcgtgatgtggttgtgatattatcttttgttactgtgtgtgcaagcgttgatttgggactagcacattatacatagagggatcctagttggggtcccgacaaggtgccaaattcaaattggcttcaagatattaattttatcgaatgggcatctcaaaaataaaaaaatgacaagaaaggtaactcgatgatccatatcttgttatttaaattggtatgatttggaacacttgccttgtctgtgcatctaggccaagtttcattccttgctaattagcctaatttgcaaaatgttgtgacgacatgcttgttttgtcaataagagagtattagtcacaaagttgttctaagtgaatcaatgtgcttggagacctcgttctatgtgaatttttggtcttagcacaaactatgagattcatacatgcgaaactcatttgtgaaatgttttgtgaaaatcttgggtaagattttttttaaaaaaaaactcttgaatctcactcgaatttgtgacaaagtggtttggcaagttcaaatctcgatgatcctcttcattgtatatcatgtcctctccttaccatgcttaagtgccaaagtaggagagaatgactaaaggggagacttcttctatgctttaaacccttggcatgtgagctttctatgcgcaaaatttgtatcaatgcttattgatttacttgtgatctttatgtaaaattgatcttcatttcctaaccacaagtgatgaaatataaaattgaaaggtaagaactcgatgatccctcatcaagaatccctttgcttttctttccctacttatgccctttttggtgttagatgtcaaagggggagaagtatactaaaggggttaaagaaaagattaatcaaagggtgagatatttgtgagaacttatcaaaatgcatgctttaaagatgccaaagagtaaatgagaaagggggagagaatattttttttgaaagaaccacggtaggggaagcccccaccgttaagattttatattaataaaggagaaaaaattacaacaaatttaaccactgtaacaatgtatatctctcagaatttttgactctatgaactaaaagggagagatcattcctaaagagaactctccaagagggaacagaggaaacaatgttttcaaaaattaaactattcctctgcttccaaatggtccaagcagcataaagcaccttctcaacaaaatgggtagagttatatgaatttctggccatgaccaacatttcaccaaagcttaaagaaagattccaaaccacaccaaattgcgcccaacattgagtgctaaaaggacactggaaaaataagtggagagttgtttcccttgatcctgttgaacaaagtacacagagcaaggaagcattttgaggggagcaatgccttctgtctaacatgtcataagtatttaaccgattaatcaagagtagccaaccaaacaccttgactttcatagtacaactgctcttccaaatccatttaatataaacaggcacatggacatgagaaaaattcatggcataaattttctgtgaggaaaagataccgttgccccaaacatatgtccaacgatcactctcatcattaagatgctccaaggtatctgcagctgacattgccaaatattcctgaaaagcttgctctgatagtggcaaggcaaagagctgaggtagatcagaagtaaagaacatcagaactaagagatttgaattcctggcaaaagaatatattctgagataaaccaaggccctgactttattgttccacaaatcttcccaaaacaaacaagattttccatcttgcacagtacaggccgagatgcctctaaaaatatccacaaattgcaaaatatccctccaccaaaaagatcctttaggagtaacaacatgaggaggttctgcagtgtagtaagtattccaaatcaaactgacccagggaacaggatatctattatagaacttatgcagattcttcaagagaagggcattaggggtgtgaatgtttgaaagtgtttatcaatgggtgtgaatgtttattatttgatcaccatgcctcatgcaattgagattatcttttgttacttgaaattgtttacaaacttgattactcatgctttctcaatcggtaccggaatcaattgcatagaataaagtttttgcaattggcatcgagaatttcatttgatacattttgaatcggtgccaagatttgagttgtgtgtgttgttataattttggtatctccttcacacacaatacaccccatggatgcaaagagttagggggagctctcacattttcaaaaatatgtgcctatgtgttcactttataaacttgtatgcaccgatttaggggagctcaaactaacctttggattcaaaatcatttattatcaatcttctgtaagctttaaacgtgttgtcataaatcaccaaaagggggagattgaaagaacatttatgcccctagtgggttttggtttattgatgacaaacgattaaaggactaatgcacttgaagatgaagaagctaggaaaatggacttatagatggatgagaattaaagagaagatattgaagatgcggtatgaagtgactacctatgtcaagatggtgaagcgcaagcgacactcaactgcgatggaccatgcggtggtgaagggcaagtgaggggcttggcgccgacgaaccgaaaccggtggtgaagggcgagtgaggattgtgtcgtgatgaaccgtgcgaggccatttgaagccatggattatccgcatcaatcatttgagaaaaagaagataaaatgtcaaagatcaagaagatgagatcttcccgatgatcaaatgaccttgacgttggtaaccctccaagtgaagaaacaatatggtgtgaaggtactcctattggtataactttgccttttaaatttgagtttaggatgccgtactattaagagggataccacatgcatataattggttgaatactagtgctcaaaatgcttcatttttatgtgagttgaaaaacctaagccaaaatttcaatcccgagttgtttcacttgtcacaacacttacactgggtttctttgcaagtttttcaacatctcttgaaggttttggaccatgttttatgttgggtttgatagcccatgaaactagctttccatagagtacaagatcttcgaaatcggagttcggagtaaaaagttattgcatttttacttgagcaacatcacactatccgatttgaaatcagactatccgatgtatcggactatccgatttttaacacaacttcactctctgtctttgtttgaaaaatcctttcgagtgagtttttctaagtgtcggagtattcgatgttggatcagatagttcgatgatacagagactccgaaaattcatgaaacatcagtctctgtttgacgacgaagtttttgcttctaaaatatcggatactccgatttaacatcagatagtccgatgtctcggaaagtccgaaatttcatggaacttcgttctctgtttctcgttgccttggaggtttaaaatatcgaactatctgatcttgtatcatttgagaaagattcccctccaacggtcacattttgggggatctatataaacccccaccaacccttttctagggttgcccaaactgatttcattccaatcttgctttgggttgagctttgtgctaagtgctttggatttttgagctctctccctccctatctcaaatcccccttgttctttgtgacttgggtctttgtgtgtggatttggagtttgggagcctagtgtgtgtttctcttaatcttgagcactaggatttgtccaagagttgtgcggtgtttattactcttggaggttgaggactcctaagcggctaagtgtcgttcttgggccaccgatctacgtgtggttgtccaagagaagtttgagaaggctggatctcgcctccgcaaggaagttgatacccttagtggaaggaggagtgtatttgtgcaacctcacgaggatagggttgaaaaagacccagctttttgcgagcccttcaacggagactagaattccctcaagtatttgaactccgggaaatacatcagcacataaacctcggtgatatcctcactctccttaccttcttgttccattgctttgtactacgctaatattgttgttggtcgagctcacctctttgcttgtggattgaatctaaagctcttaggttgttctcttgtttgtattgttgttgtgcaggtcagatagtctgatctcagttcagactatccgatcacttaggactatccgacctaatatcagacaatccaaccctgttttgttttagctttcgcatttatttttaaaaaccgcctattcatcccccccctctaggcaacatcaaggtcctttcatacccttcaaacaagaagatgcacatcgtgagggatggaaagcaccgaattgtaggagttgacaacgtcgtcgatgaagaagaatacaaccagaatcttcatgtaagaccttacattgaccttgacgatgatccccaagagcctgtgtcatatgctcgttcagatcatacggaaggcataaccttgtgatcgatatgatgcatttgtacttatctattgtaatgaatgaagtatgttgttttattacaatgacttgatatgtgtagtcatttatatgtctaattttgttttattacaaatgttgtttaaatatgtcatacattcaaattggaaatgttgtgtagtcatttaaatatgttgtgtagtcatttatatggctaatttaaatgttgtttacattattgtacagcagctatgtattttgcattcacaaatataaagacttgatgggaaaaatggaaaaatagtcatcggtgacaggccttagtttaaggccgatagagattaatctatctcaatcgggcattgtcgtagggcccgtcacagatgagtcatc

SEQ ID NO: 71693 - DNA, 13176 bp, Oryza sativa
catgatttatataacgaaacagagcgagcctctagtattagaccgtagtcggcctaatatagaaaacactcacacaacagatatcgtataaaaagcatgctctaggtaaacataataaattacagatatgataatatcatatagatctgaaaaataggtatgttaaattacatataaaatattgcatacctttgtagatacatgccggatgtatctacaaaggtatgcaatattttatatgtatatatatatatatatatatatatatgaaatcttctggtacgccacatgtcttgaagtttggatgatcttgatagatcaaattgttgacgatgatgattcccgatctcgtcgggggacgtaccctggtcgggtcaaatctcctagggccaaattagttgaagtatactgtaataccccatatattaaaagattcttaggttttttagtttgggttgacttgtttaaaataaagatgttaacagaaataaataaaagaaaatatctttagatgtgggccaacatgagaaggcccataaacccagcccattagttcttccctaaaacctagagagaggggaaccgaatcccaccttccctcatagtgcggccacccatctccctggccggcgcctcctacctcccctcctcctgtgttcgcatctctcccatctacagcaaattgctctccctagatctccaccttcatagcttggatcaagaagcgaagtagaaaaacggaacgaggaggaggagaggagtaaaaggaggggttagatcggagtctcccctattgtctcctcacaagtcctctaacgaaaccctaggtgaggcttatcccctttttgtattagttgttgtagcatggctttagtgctttaattcgtggttagagaaggctagagaaggagtttgggtagttgcggtttggtttgttgcagttctgcatgtgggcagatttgcagtgcttcagtgtttcgatgtttcggggctctaaatgttattttctatgaaagtatataactaagaagttgtagataatgtttatatgtatcttctgaacaaagggcgtgattttatctcaagtggtttaggagatataatttttttagtacgattgttgtttttgtgtcataatctggatagtagtagattgaactgtttttggacaggttaaacagtggaatcagctaggccgcctatagacaaagttgtagaggtttttcttagctttccatattggtaaagtacaccctgaatcggtgagtggaactctagttatggttgttttagtgtggacagtctgaaattctggacagattctgaagcctgctttcaagcgcaagttagaccatctaaatggcagaataaaaatatgatttccacaaaagagttgtaggccttgttctgtagatttcgaaaatgtatttatttgttgtcatagccttttcatatttcaagatataaaggtttgaagcagcagtcttgtttatagtccaagcggtgttccttattattgcgttgtgatgggatggggaagtaggttcacctttttcattgttttatatgcatgtttgaatgtgtttgctgaggttttgtttgtgattaggtggtggtccttcagatcgtgaatgataccaacccttcattggaagcaagtgcatgacgaactaattgtatgattcatggattgtttgctctatctatttatttccgatatatttctatgtgacatgtgaccgcttatattcatattgttgttcgcgccatttaggttttcatgtctatcctatgtttacgacgttattcttgtttcaatattccggattctggttctgcttaaataattcaaattccctgcttgccatggatgtgcaatatggtttcaatttggttctttgattccggtttcaattattcaagtaccatgcgtagtcatgggagtgcaatttggttctttattcaagttcctatgggtaagtgctgatcacgcttactcggctttgccggcaaatgctaggatgtattcactattgtccgggatggaaactactatttcaattcatgcctgcccgggatgggaaatactatcttctttgacttggtgtttgaaaatgtgtttcctatcaacgaaagaaaggcttctgttcatgctttattgccaatgttgtgtatatgtgttttctagttccatattgtacttgctgagtatttttatactcactcttgtgtttcatttggttttaggtacatactgagaccgacatgcatggacgggaagtagcacccttatatacacatctacttgcacactattaaactatattgcttaggtccataatgacacttaaattatatcatggtttggtcttgtaataatcttttagatttctaatagtttcttccccatggattataaggatggatcgtattttgggaatgatattgttattagtttaacttacaattgcctatcgtggatctccgtattaacaggggagactgccgaaatttctaataattttggaagttagtggtttgagtgttttttttagtgtggcactccaagtacgtggctacctagggcattacatataccttgtcacaaaatccacagcgatgatgacttgacgaagcttgaggtgatgcggggcccaatccatcagataacgcacttcattcgggtcgtatccccctacagccgaagtcatcaagtagtgtgttgtcggagaatccatttcttgaacccatctcgtcgaaaccttgaagaaccaaaacccctatctggcatgccactgtcgatgttttagatcacgactacggtatttgcatggtatggggattgttggtatcaggatatatgcgagattgaggtagaagagacagagacaaggattttatttacaggtttgggccccttcaccggaaggtaataaccctactcttgttggccgaagccggtgttgctcttattcatttgaattccacaagtataatatttgggataacctatctagtcatcgtcgacttggtggcatggaacaccaacaagtagtcgacgacggggtagtcttcctccttgaatacatactcggcaagatcagggatagtgctagatccctcttgtcgtcctctgatgctagatccctcttgtcgtcctctgatggcaccagattgggtctgtctaggctgatctttgatgttgatgtctggtggcctgtattggtatctattctgactgagcttgttgatttgtttgggcttgtcttcccctccctaaggggtcttatattgataaccatagatgtctccttgtctaagtagaactagggagataagtatggatacaatccaagtagtgcttatagtttccatgtagaactatgcttgttcttccttatccagaactccttctatataagaggtatgattccgtataagacttggtatatggtgggctccaccgagcttaatcgactactattgggtatgtattatccctaaccctgacaataccatctacgttgagtgcaaaccttacatcatatgaaaaatactttatgtacttgtcgtctacctttctccattgagatccatcatatgagtgctattccatctctcttacgctcatcgtggtgctaatgcatcaactgagcatggttcttgtttgcgcacatatgtttcaaacgagggaagataggaaaataccacaacaacttctaaggtactcttttcttcttcattgtaccattatttccaccatcaccatctccacaattatattgagattccttgcacacgggacaatcatccaaatcagcatactcaccctggtacaatatgcaatgatttcaacaagcgtgaatttttcgtgtttcaaagccaaggggacagataatcttcttcgcttggtacgctgttttcagcattacattacccgctgaaagaatgtctgccaagagctgtaacaactcactgaagctcttatccgaccatccattggttgccttcaattgaattagagataggaccacaggcaacttgttgtgctccaccttagaaccattgtaaactatagttttgagttcaccatggtattgaacttggaatagtccctattatcagtgtaagccctctccccgtcgtgcaatatctggtttagatcagcttcaccgtgatcaattcatgtttggtcatcatgctcatagcccacatcctcattcggaacgtcggtcttgcctgcacttccctcgttcatcatgattgtaaggacatctgaagtttgtcataagagcccttgtaagtagatgtgcatggactagttgtgctagaaattgtcagtctttcttgcaattaatgcatagacactacaggcaataatccggaccattcacttattttgtgctcgtcacctcggcaacaagagatgttactccccttatatactccatagagtagtgcgtcgcatcaaacacccatcgttgatccattaaaaccgatgagtacctatggaatgatttaatttacgtacgtgtcataatctgaataatatggcaagaagagttcaacaataatatatttttaacctagttcatgaatcatttatcgtttattaaaagcagtgtagaataaatacaataaggattttataggcaaattggaataacaagatcttcagtaatgtattataacattgtgatttactgaaacaagggtacgattgtcattcacaaattacaatatcattttcttcaattccttcgtttaattcgaaatttccgggcccacctaactaccgtcaaaaccaaggacagacggttgcttcatttcaaaaaagtaggggcaaaatcacaaaacctaaaaaacaaacaggggtaaaatcataattaaactggaaagcaaggaaaataacacaatttccccatgaaaaacatacataaaagaaacgacacaatatagcaaacaattgatttccataaacaagagagaaatgaagtgagaaattatataaactaaccttctagaaatcaaaattaaatatctccaagaaaaccaaaagaaaattaagcaaaaccatttccctctaaagcaactggttgaggaagaacaaaaggcaccgatgtattctatacccgatcagctcaagaaggatggaaagagcttatatatatatggtggatcaaaggtgccagttctgaaccctaaccgacatctttatgtgggccccaccatcggtcacgactaagtaactattggcgaggctcacataatgatgccggttgtctccttcggcgccccgcaggcacgcacttgagtgggaaaatcactatactgtcagttctaatatttttggcatctatagagccatcccctatttactgttctgtattagtgattgctggtaaataagtggcatcagtgatggctttgaataggcaatgacaaagtggaagcaataatcagttaaccagcagaaacaatagcgtcactgtcggtttgtttgtagtggggttcttgattcaaattttgtggcgcagataaccgagaagcgaagctagaaattaaaccccacaaaattatttttttatatcaatggacatgctactagaatcgatgtatcacaagtcatgcaatatgctggatttgagctcagcagaaccgtaattaccattcatgtgaaacctccttaattaccgtctccttatgatgtcatgttaggaagtagctatacgacattgatagttttttagtaggaaatgtagagtctcatcggtggcacatatgcatcgataaaattaatttaaagacccgaaacgtcttattagaaaataaaaataatttatagataaaacttttatgtatctgttcatagcgacttaaaatctagcgttaaaaaaattacgttgaaaatatcataaaatcaacatcaaaatcaagtttgaaaaattatatttggcttttgctttggcttattaggccaaccgataaggctcttaaactaccaataagttgggtactactttttcagatgttcttagtttagtgtagctttatggtatggttttttctgtgtattgtttaacctattttttctcgggtgttcctttttgtcctagaattactatacaattgtcaacaatttttctccaaaaagccttcactttttggacccttagatcatccttgagattcatgtaaaacctaggatgaaagtttcgacaccacacgcttgaggcagggatcgaccccctgtcacctcacaacgcacataaatatgcacagctaaccaactggcccttcagggtagttattatacaacagttacacataagttacaatacaattgtacagttataagttataatacagttacaatgtaactataccacaattatagtacagttatattgtatttgaaagttttccatcaaacacggtcaaaattcagaggcggagccagggcccggcaaccctggcagctgcccaggctccgccggcttcatgcaatcatgccccattgtattaaacctaattaccttgctaatcatctttcttaatcaccgtatgaattgaagcagcagtagtatacatgtatatatacttaagtaacggcttaacgtagaatagcaaagcaaatgctcactctaaaatgatactccctccttccctaaatgtttgacgccgttaacttttttaaatatgtttgaccgttcgtcttatttaaaaacttttgtaaaatgtgtaaaactatatgtatacataaaagtatatttaacaataaatcaaatgataggaaaagaattaataattacttaattttttttaaataagacgtacggtcaaacatgtttaaaaaagtcaacgacgtcaaatattttaggatggagggagtatatggatttgtctactatgtatttgttgttaaaacttgtccagactcacaaaaatttctggatccgcgtcactgtgtcaaatgttatatagccactgttccccttttgtttgtatgccacgttgcgttacgtgagctagccaagctagctcttgctcttccctataaattaagccatgcaaacccccatgaccacatcagccaacgcaaggtggtagcgcgcacacactatacaaaaacacatccaatatattgtcattagaagtgaccttaatttcatggcagaactactgatcatctcctcgctgatgatgctgcttgctcttgtcttgtacttgtgcataggctggccaattctcagcaccctcgagctcccgtccatcgccgccaacctacacaacctccacgaccacctcgccggcgtcctcgccgcgtcgggacacaccgtcatggcgcgcggcacggcggcgaccagcagcatccggttcttcatcacatgtgaccctgaaaatgtccggcacatcttcacctccaaccatggcaactaccccaagggccacgagttcgccgagatcttcgacatcatggccggcgtctccttcaccctcgacggcgagccctacctccggctgcgtgccaagatgctgagcatcctcggcgacccacggttggttgcctccatggccgcctcctgcctcgacaaggtgcgggatggtgttctccccttcttggcccgcgtggcgaccgccggggcgccgttcgatatgcaggatcttaccgggaggctcatgttcgacgtgacgtccatggcggtgttcggcgtccaccctggctacctgtcccctggccctgacatgccgcccgcgcacgccgccgccgccatggacaccgtcatggaggtgggcttgatccggcacgccgtgccggcgtcctggtggaagtcgatgagaaggctcaacatcggcccggagaggaggctcgccgcggcgcacagggtgctccatggcttcgtcggtgagatgatgggggcgaggacgaaggcaacgcagtcgccgcaccgcgacgccgacgccgacgcctgctgcaaacgacggccatcgcctacatggtcgccgggcgtgacaccatcggcacgaccttgccgtggttcttctacaacctcgccgtgaacccgcgcgtcgtgtccggcatccgcgaagagctgaagcccatcgccgcgtcgcgcagagctgcttctcccagtcccagtcccagcaatggcgatcgcacgacgacggtgatgttctcgccggaggacaccaagccgctcgtctacctgcaggccgcgctgttcgagaccctgaggctgtacccgccggggcatatggagcggaagacggcggtcgccgacgacgtgatgccgagcggccacgaggtgcgcgccggcgacgcggcgacgccgtgctcatctcgctctactccatgggcaggatggagagcctatgggggaaggattgccgggagtacaggccggagaggtggctcaccggtggcgacggcggcggcagcggtggcgcccagctgcggcacgtgccgtcgcacaagttcctggcgttcaactccggggcgaggatgtgccccggcaagagcatcgccgtgatgctgatgaagaccatcgccgccgcggtggtgtggaacttcgacgtggagatggtggaagggcaggccgtggagccgaagatgtcgtgtcttttccagatgaagaatgggctcatgctcaaggtgaagaagcggcaaatctgaagaaaagctcttgcatgcacgtatacgcatcttgtctcaatcgtcagatttgtgcaagtcatctacataacatacaaggaataataatatccttaaataataatatcccactagctacttgaataaagaataaagtgtgtttttaataatttgcaattcctgcaatcatctcacacccggaaataataacatctattgagataaatcttttaaaatgttaatttgttactgtagaatgcatgtaatgaaagtggtaatgtggtatagtacgtacttattatacaaaggcagtttaggtttcacaaacagaaaatgcagtacgtcgcgaagaacttgttcgatgtattagtttgctttatattaatgtattgctactagttttgttgtttgtacttactttacacgtacttagctaaacaaaatgaaatatatgacttttggagtaaactaggactgacaaagtcagctggccaagccaacacaaacggccagttgaccccatcttctaaagggataggcggcatggaggccaagccaggccattcgaccatttttgtcagggtagccagagtgccagacacgaagatatttggaaatatactttatatttaacgtttttgcaagggtgaatagctaaagtggtcctccaagtttcatgcaaggatcagtttagtccttagtccttaatgtttcaatgtgtccatattagtccttcaagtttttattttaattcaaacttatctttcaacccacataaccaacaactctcttgataaatgacacttataccccctcattcacatatataaaagaaaaaattgcatgcaatgaattctttttatagataaaacaaaaataaattatgtacttacaagtgtatacgatagccattaggctcaattttcatgtgcacatattaaaataatgagaagtacatatccaatgttgtttattcattttggttttcttttttctagtgtatagttatatacaaattaagggcaaaagggacattttctaacataattgtggactaaaaatagtcatatggcatattaagtaggtccaaggatgattttagaccaaaataaatacttaaaggacctatgtgaacaaaataaaacctgaaggaccaaattgagccttcggtaaaacttgaaagactaaattagctattcaccctttttgcaattacatacatatttttcaaaaaattataaaaatatatgtgtgccgcgggcaccgatagtatagtttagcgtggcacgaagatgcaggaccagacaatcccacaccgctaacacgtggtaccgcacgtccgctgcacaggattctccggcccgatagtctcgcatcttcacattgcactaaacaattggtcccgcgtttttatccgatggtacatgtatatttttattttatatttcaaaaatatgtatataacagcaaaacctctaaaaataaagtatattttcaaaaataaaaggctagacaactactcacctggccttctcctcctcactactacaaaaaccgtttttgcaaacgggcggtttacattttcgcatgtggttggctggaccgcatgagcgagaaggtctgcaaagatcatgatcttcgcatgcggccggcgcaaccgcatgtgaaaagccggccgcatgcgaaaatgaaaaatcgtgaaaaaaataaaaatccccaaaaaaaaccctagccccaggcgcccgagctcgctgccgccgctcacccccacgccggatctgccgcgcccgagctcaccgcccgccgccgtcgtcgtcaccgaggtcgtcgtcgccgcacccgagctcgccgccgccacccgtcgcctttgtcgttgccgaggtcgtcgtcgccgcggggaggtcatcgtcgctgcacccgagccggatccgccgcgcccgagctcgccgccgccacccgccgccatcgtcgtcgccgcggggaggtcatcgtcgccgcacccgagccggatccgccgcccccgagctcgtcgtcgccgcgggggagggcgccggcgccggatccgcgtgggaggagggcagccgaccccggatccgctcgggggagggccgccgtccccagatccgctttggccgccgccgccgccgccccccgtgtgccgcctctcgagctcaccaccgccgcctctcgagcccgccgtagctgcctctcgagccccgggccgccggcctccgtgcgtgtgagaagaggatttgagagagagagggctgagaggagaggatttgtgagagaggagatgaggagatgactgagagagagagaagaagaagaagtagataaggccgccggctagtgtgagttgaagaggaaaataggaggcccgcatgtaaaaatggagcacttatttttacatgcggaccacttaagcgtctgcattcaaaaatcgtgtgttttttcaacttcaaattgatttttatgacattaaattaactcatgtcaaaaggttgtaaaaaacaaacttgtagaattcattgagatctaccaattttattttggtcatttctccatccgagtttgattggactatacaaaatttgaattttaaaatataagaaattcaaataatttttcgggtagtaaatgatttcaaatggaaaagtcattaataacaaagttgtataactcatcaagatctacaacttttgtttttgttatttttatatttgactttgtttgaatagtttgaatttgaatttcaaaatatgacagcttcaaacaacattttcaaatactaaatgatttcaactgaaaaagtcatcaataacaaagttgtataaatcatcaagatctataacttttattttggtcatttcttcatccgataaagtgatttgtaaaattgttcagaaaatgtacatatctcttatatagtttataaaactataagagagatgtacattttgtaaacaatcttataaataacttcgtcggatgaagaaatgactaaaatagaagttatatatattgatgagttatacaactttgttgttgatgactttttcagctaaaatcaattactgcttcaaaatattatttgaagttttgaaattcaaaattttaattgataaaactaagtcacaagaaaaaaaatggccaaataataatagtaagaatacaataacatgatagagcatgattttagaaacatttagaaaaaagaatcatctaatttggagttcatatgagtgggatacactagtttcaaatttttcaaatttttcaaattttatttttacatacgcctccttaagtggtccgtatggaaaattcgatttttccatgcaggcgcttaagtgagccgcatgcaccctcttaagaggccggtatgggaaaatcgatttttccatatgggccacttaaggggccgcatgtaaaaatgaccctcgatttttgcagacaccactagttatggtccgtttgcaaaaatcaaggtgtctcgtacagtaaaatcgcttttgtagtagtgcctatttcggtccaagagcctaaaatgactttgtaagggggtcgaccgacctatgactaggctagccggcccaatccactccgctccaaccaacttcaaagctgcagcaaacttcaaagccgcaacatccaatgctcgcaaccgcaattagaaagtgataaggactaaactagaaaaagcattttctctgacgtgagggttttattttcgcaggcggacatgaccatcggagccaaatgaccgcctataaaaatataaactagggtgaagctcgctgtctgcctgcgaaaatttattttcgcaggcggaccacttaagcggttcgcctgcaaatatacctggtccgcctgtcaaaataggtgtgtaatataaatagacgtggcatctcttagattttttttctaggtcctcacctctcctctcctctccttctgccggccctcacctctcctctccctcagcaatgggtgttcggcagcgggggcggcaggaaccggcgacggtgacgcacgcgtgggcggcgggatctcgatggcgaggcgcggggtcggtggcggcaacggctaggcgaggcgcggggatgacgacactatggagcggcgcacccctagcgcggctcgcctcccctccctcccaggtccagacgaaggggggagggaggaggccggtagccggtggcgtgggacggacggcagcggggcgcagctgtgcggcagcaacggccgcatgcagcggcggaggagggaggtcagcggcagcgttcccacctcccagatccagctggcggcccacccatccaggatccggaagcgttgtgggggagggtggcgatagcggctgcatgcagcggcggaggccggaggtcgtcggcggcactcccctcccctcatggatctggctgcatcatggggagggcaacggctgaggtgacgcggaggcgcgaggtcatcggtggcggcggcggcactcccactcctagatccggacctcccctccc

SEQ ID NO: 71694 - DNA, 31170 bp, Oryza sativa
ccctcccctccccttccctcccctcccctcccctcggcggcagcggcgggctggcacggtgacctcgtggcttcgcagctcctcctcccctccctctgcctcccaaaaccctcgtggtggcacagctcgtggtagggcggcggtggccaaatttttttttacgctgaaaatattttcgcaggcgggtggatttggccgcctgcagcgttttgttgcagacgttatggacacctaaaaaataagttttggccgcctgtaaaaatgtttttttctagtgggtggaaatcaatcgacctaaaggaggctcgtccgaccactcacatggctggcttatcctgctggccatttgaagatgggagcacctcaagcttgttaatttaagtaaatattgctatcgttttagggttttattaatggttagccatttttgttaatttgtactacctcagtttcaggttataagactttctattattgcccacattcatatagatgttaatgaatatatatatatatatatatatatatatatatatatgtgtgtgtgtgtgtgtgtctatatccattaacatttatataaatgtgtgtggcaatgctagaaagtcttatattctgaaatggagaaagtccaagtttgtttattgatggttagcttaatagtaatgttaatttttgttttgttttttgttaatttgtaaactcacatgactttttctatcgttttagggttttattaatcccacacatattgctacgtttactgcgtttagccgaatgttgtccaaaataacaaacgatcgaaataatcgtaatatgcactgctaaaaaattattcttgctagctgctgaaatcgatcagtctttgcgcaaccaaaggtcagagatggcaatttccacaggtgtggcttctattcgcgtgcgaaaattgattttttttaagcgacatctgaatagcactaagtacgaaaatttatttttgcaggtgacacaagtcatctgcttgaaaaaggttttaacgaaaaaaaaaggaaaataaatccgattttcacagcaggttcagattcaaatgcacatcaaacccaagcctgttcagattcaaattggcatcaaatccaagcatgttcaaattcaaatccaccacagcgacccaaaatcaacagacaattcaatatcaacaaacaataacttcatctaatggttgttgtcgctatcgcagtcaccatctcatcgagttccatcggtggaggtgcggcgcagatccggccttcccactagcggatctaggccatgacgtcaagccgtagccctcctctttgccctctttgctgagtcatccaccgcggaggcctccggcgctagatcaagcggccccaaggtcagccgccgcccactctagcggtaccgtggccggcctcctgctgttgtcgccatcccgtggcccgcgtgcagctgccatctccaacccatagccagcttgtcactgatgttgtattcccgccgctgccgtcgctagcccaccgctgccatcgctgtctggtggcccacgtgccgctgccatagccgacctgtggccgagccaccactgccatcacattcccgcctctggtccatcactgctgtcacagtccagtcgctagcccaccctcgcagtctttgtcgtcggtcgcttccaccactttgggctcccccatcctctgtcgccaccgccgctgctaagaatgaaggggttggggatgagaacgagtgtgggggtggggtaggagatctcatggacaataacttgctgagaatgagtggagaagagagcttctcgaccagttccaccgatattttataaacctttcattttttttcgccggcggtgcaataagtgtcctacatgcaaaagtaaactttattttcacatgcagaccatttaaagtaacggtcagagagaattgatttttgctagcggtttttattggaatcacttatgtatatttctacaagcatgtgtttttaaatccgctaataaaaataaaaggatggtatcagcaaaaaaaaaaatattttcgtagtagtgatatgccttgtaaaaagataatagtaatctataaatcaattatataatttttaaaacgaaataagtatgtgtccaacttgacataagccacaatattagtgttctctataagctgcactaccaaaccaacaacagtcttctgaaattctgttttacaagctttacacggtacaagttcattttaaagaactatttagttgactagttgcaaattttaattattctaacaaaattgttgaaatgaaattaaaacaatcaatggataatgtggccttaaagcgacttcagtaacagtgccaaataaagcgatcgaccaattgccaataatattaagcaattcaatacagttagctgaaagtcgtacatccttgtgcatcatttcccatacttgctgtagagatgttagggtattcccaacccaatgactaaaatggtatccatagtattaaataagttgccacctaggatgaaaaatgatgtggcaagtgaataaatgaggaaagagaatgaaaccatgtcttgcatgagacatagtttctacacaacatccaagacatcatgtaacataagtagcattaaatttaagtatggaatagtagtgtttgcattgtaagagtagtgtctagtactagtttcttgatgatgtggagtttatggaaaccatatctagtgttttgggttggaaatagccttatggcccaattagtgaactgattttttttctaaaataatagaagtattatgtctatcgtctgcacgcatccttaattatatttattggcgtacacgaacaaaatggcaatcaacactatgcaggcaaaataaaaaaaaatggtgatagctacttaactagtcgccaaccagtacactgcatgatatcgttattgatatttaaaatattaaaagatatttttattcaataataattattaaaattcctaattagttgagatgtactcggttttaggtctttgcatgattgagttctaaacagccattcgaatcggctacttcctcatttcctgtgagcatgctcttcttcaacggctaaacactactggagaaaccatcttaatctacaatagtcctgattcaactaaaaactgggactaaaaaccattttagaactcccctgggccagggccgccgggctggggagacgatgggagaagcggtggcggcagcggcccccggcatgcggcggacggcggccggcgatgccctcccatctaccagaggtgaggtgggaggcggcagcggtggcaccggatttcttttttttttaagaatttgtaattcattggatctgtgtgatgtgatatgtgatatatatgtgatctgtgatataatttttttagaatttgtgatgtatttttttgacaatttgttatgtgaatcttatgatttgtgatgttgttactttgatttggggatgtacggagcaactcgatttggaatttgtgatgattttgtgattttggtgagtttggcgtgaaatcaatatgcaaagaagaatgaaaataaaagagaagaacaaagactagaccctctttaatccctgttggtaacaccagctgagaataaagatgaatctttagtcccggttattttaaccgggcatctttagttttggattcatagtcccgattgtataaccgagactaaagggggttacgaaccgtgggtaaaaaccctttctccagcagtgaaaatttggctaaaagttgaaaacaatggtatcatcccacaacatgcagaatatagatgtgctttaacttttaacatgacacacaatgttaaatgtagagctacggttatccatcaaatcgatggccagatattttttttagcgtgtgagcatctgcgaaatgatcattaattttatgttaacgtgtgagcttcttgaaaatgttcaattagtattactgtaggtgtagatagaaagatatatatcaaacattagtgcagataaaagtgtaacaaaatttgccatacaacactgaaacaacatggaatttgcaaatacaccgcaaaactgatactttgttcttggacactccaattttgtgtggatatttgctaatggctatagaggggataatataatggcaaattgctgtaggatattacaactctgtggttttagctcatgcagctaaagtcgatctttgagagaagacattctcaaatatggatatgtctattaaaaatattcatatttaaataggagagaaaaataatttgaaatgccagaaatgcctatagcccacttgtattcttcctccacctcccttctctcatgtaccctatagttaacaagttgtttcactcatcacttatcactcgttatttcattcatcactcaacgatccacagcgatccagattatctcaccgagttctaacgctcacacgatcatctccacctcccacatccgtataggccgcttttcctccctgcgcgttctccgttcccccgtcagcgccgccatcgctctccctcctgactcccacccgtcgcccttctttccccaacctcatcgccaaacctaacctcccctctctccccgccgcacgccgtcgacccccgctgcgcatatccccatcgcacagcgccgccgctcgggcgccgcactttctcaatcggaggacagcacgatgaggaaggttgcgggagaggcgccgtcaggcgccgctgatctggtccctcgcaaccagatcaccgtcgcataccctagagtcgacgtcgccggtgcatagccccgtcgatcccgctttcccagttcgctgtcatcgcctccgatcccgcgggttgcgcctctatcccctggtacagcagcgtcgccaccgccgacgggagcagcatgtcagtccgcaactctgcattatcagcgcacaaccagtttattggattggagatgttatttgctttgggtaatttgtttttttgcctagccacaagaaagaatgctcatgtgccatagaggaacagcaagctaacacaccttcttgagattctttaggcaatcaattatttacttgttggtaaattatgcatgtagggttagatttgtggttttcgtaattacattacatcacccgaattaatcaaaagatttgagcattttgtgcgtatgcaagtagttgaagaatttcaccaacgaagatcccgagccctttcagccagtacagcagcaccgccaccgccgacgagaacgggcgtcctgtctggatcgtcagaaggtggccaggtcattggattggttttcattttttctttttggattggattctgaaattggaacaaaagcagtagcattctccattctttgatttggttgttttcacaaatgagaaatgggcagtacatcataaatctgagtactttgatctatataagtcgatttttattgctccgtacacaacacagttcacctcctgagtcatgaaatgcaactatagaagaactgaacttggttcaaatttaggggatatatgctaataaaattacaagggaatggtgtgcattcagtttgatatagttcatatgaatgtcactttcttgaaaatattgacgtttggtattagttgtaaaaccttcatcaaaatgcagaaaacacgggatcaaactaatctaaattcaacatctctccttcaagttttctgaagtcaggtaatagctgacttgagttaatttattaattggtggattactcatgcaacacctgccagtttattgaaaaaaaaaaggaattttcttacttctgtcaataaatataatactatggacaagcacttttgtttgattgtattaaaagaaatactaaaaaatgttaatgagatataaacggaccgatgatgttaatgaaatacttttgtttggtgctatttgattgtgacttaaacggaccgatgatgtaaattcattttttatacacttactctactctgcacgataggtctctgtttaaatgccgctgagggagggtttgttctggttgatgaattttcaagcaaatctgttcatgatctttacaaggtttctatgtgttttctgtgagatctttacaaggttttggtttgggggtacaaattcacattcaatctgaatttcgttttggttttcaagtgaagcaaacaagccaacatagggccctgccaggtatgagtttgctgctccgactgtatgtgcatgtagcagagggcaataatgaagacagaaaaaagtagagcaagaaaatatttaacattgaaattgggaggtgttagtatggaattgtgatcaaccttaatgttgtgcactgctttagctgaaaccatctgagtgacaggagaggaactggaagtcgtgcattgatacaaacgatatttttgtgatttgtagcctgagatcaaataaatttagcaactcagccatatttcagagcctgcttcacttaggcaatgtaaaattataaaggccttcacctagccaatactatttattttttttattctcacaatagaaatgatattgttttcatgctcctaggcggctcacaccagtctctgccattgccagttcgggtgcctaatgaggccggtgcccttgaatgacagccatatttccaaggtgagtattggaaaccttctctcagaaattaattgtctgagtttcctaccaacaaattgatttgttcacagatttaggtggtcacgggccataataaatcattgagaataggtcatataacattcagttatgtcatcacaaacaatctgattttgacaaaattaggcaacacagaatttaatgtatgcaagcatccagatacctaacacggctaacactattgactgctttttgtttcgagggggctcactgcttatattttattgagcttagctatattgtatttctctaaactgcataaccatctcactgcatagcccatatctttatagcattgtgacaataacagctacatctctacaatattactaccggtaagaaatgaaggattagcggtacataaagtgcctcaagttgattggaacaagcaaccatttgtataacatatatatctttcagactcaaggtggagtttgatctctacgtaaaaaaaaagcaatcggtgttttctgtactcgaatatgtaaataagctgtagtgtgtcagatattataatggtgttctttatagagcacacgtgccgacaacattttgcagtgggcttatctatgaatatttttttttattcatctgttgcatggttgccagtgtgctgtatgtttcattcaatttgatttagatttgtaggcacgtctaaatggtgcatgtgcacgtattgtaaatataagttcgattactaatcctaaatcttgtcgatcaggtatgtattgatcgagaattgcatttggagatataatcgataaccaaacaagtgtagtgaaatgggaagttcattatatatatacacacacacactattgattccttagaaaaataagatcatataaaaaaacatgaaacattaaatactccatccgttttataatgtaagactttctagcattgtccacatacatataaatgctaatgaatctaaatacatatatctagattcattagcaactaaataaatgtgaataatgctagaaagtcttacattgtaaaacagaggaagtattaaaagttattaaacacaaatagaattgcaccgtagcgtttagcacgggtatattactagttatctttaaaaaaaaaacttccttctcacatcccctttataatcccttgcatggtacgttcctggcgccgtggcgaggatgatgagaagcaatgcagcgaggctagcagtcacgtgcccctcaatatcgtctttgacatgtttggagtagcgtttttccacagtagtttttgctttcccttttaattgtagcttttgtttgtttctttctcccttcccccagcataggtctgtctggctaattgcgttgtgtaaaaagaaaaattatctttccttctaatatattatattgatgtacaatctttttacgtgttttcgaaaaaaaaatatcattgatgtgtgcaccctaggactccaccatgtccagggacaactatagtagttcgagcagcccgacctccaccttctctgcctcatgaagaatacatcatggccgcccacaccataacctcatcaccggccaacccactgttgcagtccctccaacatgatgcccttccctgggcgatggagcagatcagcaactacctcaccgggaggccccttgctggcgcatggatctggcaaccagagagagagagggggtggtattaggaagcaatggtacgtcgggcttgtttggtttgaatctaatttttgccctaccaaaatcttggtagtgtcaaaatcttgacaaattttggcactaccaaattggacagtattgaatttgaactattgtgacaaaaaattggtagcaaaccaaacatgtatttgcttctattgaaatactccctccgttttgaaatgtttgatgccgttgactttttagcacatgtttgaccgttcgtcttattcaaaaaatttaagtaattattaattctttttctatcatttgatttattgttaaatatatttttatgtaggcatataattttacatatttcacaaaagtttttgaataagacgaacggtcaaatatgtgctaaaaagtcaacggtgtcaaatatttcgaaacggagggagtacccaagaaattagtagggcaagttgatagcaacccaaacatgcccgtcatcttcccaccaaccgagatttggaggtcaccagccccgtgcctctgtgctatcggcctagtagcctcaagcctctctgcacggtgccatttctccgccaaccgaccacatcaatggctgcttcttgcttcttgtagtcctagccatggcgggctagaagtcatctcgctcgaccacgtgtgtaagtcagaaacctgaaatgaaatcctaaaacaaaaggttaattatagtgtgatccaccttctattaccaaagttttactttaagtcatcatttaactaatatttttactttaaactaggtgagattattttttgttacactttagaccattccaagtcacttttgtagtacctcccataccagacataatattttataggtgttagatttgatatttatgtaccatactaaaattatcctggcgctagaaatttccatagaacgatatatcattgtgtagtacttcttctgtttcataatataagtcattctaatattttttatatttatattgatattaatgaatctattaataaaaatataggaaatgctagactgacttatattgtgaaacggagggagtagtatagtatttctagacgtaagagatttcgttgcatcgatattactgttccgtagtatttctaaaaaagaagaggatgagttttgaaacgaaatcccagtggatctcggcccagccaaacgcggcccaaggtagtcagcccagatggcccggcccatctggcaacttgatctaagtaacccccaagcaggaatttttttcgtttttacatttttttttaatatttacagaaataatctatcgaccaaaaaaattgcaaaaatagggggggcggcaagctgacgtggcagacggtgggtcgaccgcgccgtctgccgccgtcggccaaaattgcgattaggcccttgccgcccatacagagggcggcaaggggctaattgcaattttggccgcccataaagagcttgcggccgtactttttgcatctgggtcccttgccgccctaatatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaatcaaggagaattatgtaacatgaagaaatagtagtacaatttgaacatgatacaactatttgcattgcggttacatagatgatattagattcgaactaggagggaggtagtgcaatagttgaacacaacgacgatgttggcatagtatctcaaacctgtgctgttgggtaccttgcactagagctcgatgtttcatggcctttttacgcaactcctctagctttttctgcatgaaagttccaaacaaaatgctattgttcggcatagaggtaagaactgcctggaaccgatccctaaaatacatgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaatttttttctcctggttctgattgcacagcctcttgaacatgttcatgagctccttgttcttgaattgcttgaagaaattagctcccatatgacgcatgcaccacctactctgtacatcttcccaaacaccagggtatcctcgttccatactcccaaactgcaactcttctatcgctcgtagaatgccaacgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttccttgataacaccaagcaggcgtggcaaattgtcatacgaggcttcgtaagttccaaatctcatctctattattttctgtttggccctccaggccttggcatagctaatagtatacttgtatgtctctttgatgtgtcggattattgaccttggttcatatgtgagattatcgatgacatgtgcatacatctcagatgcaacaaatgcacatgtaatattcctgtggtatttctgaacaccaggtagaaaacatgtatgcttggtaacgactgacactgtccaataatccttctatttccccttatacgcgtgcactctccagggacaaccatctttttccttaacacaccgaacttcatattgcgaccggttcgacttggcaacccaaaactctctataaagtgacattgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatttgacgaatcaccttcctctacacgctcgttgtcagaatcctccctctccatttcatccacaatggcaccgacagtctccccctcatcggccactccacttggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccacgttgcaatgtattttccaaataccatctcacacactcgagagttttgaactggcattagttcccaataaaaaccctcagttgtccgacttactataacattgattgttatgtcacttgtctgtggatcaactctcaagcccctcattaaccatccttttataaaaggtatactcctctcagccggtctatcaattcccctttctgatacaataaaatctgacagatctaccccagttggcccgtaacggacgtttcctggtccatggtaaacttggaatatttgtttgttcgacatatttgtcaacgaaataactagatcatattactctttcatgcaataaacatctacaacttaatatcttcttgtgtaagccaatgcaatggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacctgaaatcggtgtctgaatccggcagggcttcgccccttcttctcttctcctcccctctcttctttttttttcactggatttgaggggggaggaatgagggctgggggctgggcagcacgccttttataggcagcgaggcctgccgcccggccagagggcggcaaggggccgcctgcaaaatggccggccccgactggcttttttgcattcgggccccttgccgccccaccagagggcggcaagggttttcctgcaaaaaaccctccctccgtcaccgcccgttcctcccccgtttgccacgtcagcttgccgccctagaggtgggtgacagggtctatttttgtaatttttttggccgatagattatttctgtaaatattttaaaaaaaatctaaaaccgaaaaaaattcccccaagcagagagggtccgccggtgccgccaccgccgccacagatgcccggtgtcgccggcgcccgcccccgatggcgtccctactacttccgccgcggccggccactcccctcctcgcttccacgctcgccggtagctccccttcaggcttcagcgagccgggacggcaggtccagccgtccaggatggcggccatcttgtcggcgtctctgcgcactggtatcctgctccccctgttcgacttgatttgttttttccaattttacgtaaaatgtaagcttagattatgtttactgaaattttataaatgctgtcctttatttttatcaaggtcttaatattttacatttaaattatttaagtctccatcaattgtaaatttattgtatgtcttgtgtaactaagtctttatcagttctaaattagaagttagagcaattcattgttcaatcttttatccaagtaagggataatgcttaaagttaaacagggaatcagaggagtgatgactgatgagagtggttagatttccatcaaatggatgaaaagaagtaactgaaccgaaaactaggcaatgaaattatatatcttgggattgtgatagctttgctcctccacagtatatatggtcctcaaacagaagataactctttggataaatccattggcatgtaaccttagagtcaatacaaaaaggagatagaaattgagaatataatcttatgctttctcagtatttggattgaatgactacagagcgtattttctataacctctgcagtgatccattattgccgaatgcatggcgccatggtggtatggatggcaagatacgtctagagcagtactgagtactgataaaatagaataaacagaaatgccctgtacgcatggaatcagtggatcacactccagtctttagcatcattagcctttaattataaactaataccaaagattaaaaggcagagacttcagatccgtttccttgtgagagagacacagttgttcagattcttttcttcactgttatcacacaagcatgcacgtcccccaatacccatctttcttcctgttggtgctcaaggttcccaccattaaaagcaaaagtgatcagtccataactaaacatcattagtacaagcaagtaatcacctcatcctcctccgatcctccaggctatcacaccattctgcacagaggtggggactagtggtgctgctagctgcattcactagcggcagccatggccggagttgtggggttgttggccatggccgtggtgagggaagcgggcgctaagctaggcactgccattggagagcaagtgatgatgatgtgtggcttcaaggaagacctggaggacatgaaggacatgctggaatccatggcggcggtgctcaaggatgcagagaggcggtcggttacggaggagtcggtgctgctgtggctgaagcggctcaagaatgcggcctacgacatctctgacatgctcgacgggttccaggacaaatcgaagtctgcaactttgctagctttagttgtatcaacttataaaggcacatatacatcttaattcattgcaacacaagcatcaagtttcctaaaggcacaaatacatcttaattcattgcaacacattacttccgttttaagtcagcccaaactttccgcatgtcaaatatgtgttgtgatgagctgttattagtttgcaaaaccgatcatgattcttgtttgagtaagccctgctggtaaccttcgtgtttgaactggtaaccttctcgttgagtgagccctgctgctgctttctcacttcccaagcaggcaaagtcagactcaggagggagggggcattaagtcacatccatcctattttgttttctcaacggttaagagatgatgatgccgtagagaacccgtaggcactattgaaagggattgtcgggttcggcatgtttatgggccgttgctgggtgtgctgaccattcttgttagatcaaaacacaacaaccaagccttttcaaagtggggtgaagtgtaacagaaggaacaaacaaacatgtagaatgaaattttacccaaattagaagacaaaaagataactattttctattgttctatatggttttcaaaaaatcaaataaaatcgagtgaaagcataaaaccaaatggcactaaaataatataaaaaaaagagcaaggttaccacactttcctttgcatgaatatgatcattatcgcatcaaagtgtttacaaagtgcatataaaacactcatctctaatatgaactgcagtctatatgaaagagtaaagagtataaaacctaggttttctctctatataagtgtcttgccgaattactccccctctagtgtttgtttatttacccacaacctctgtcaccccaaaaatgatactaaattttcagatgcattgcgtattattcactgtcatcatgggacgcaatgtacaagtttgataatttagaacaaacgaaataaaccattaaatattaccttagtataaagatgttttaggcctgcgcccagagaaaaacaatagccgcgagaaacgggccaatgactccactttataggcgctaattaggatataagccacgactcctcgtaggacttacttagctctattatgaagatgggacttgcaaaatgttgagtacaaatgtacccaacaaggtataagcaaaaatgtacataatgcaagggatagaaggaatggcataatagggtttattttcacgtaaatccatagttcaaacaattcactggtttaaagcatatgtttaaacacgaccatgttctaagtcataattatgatatcaaccatgttgcgaacccacccaaacctgcctaggctaaaccacttgaatatccatcatgatttcatcctctaggctcttagcctgggagtaacattgctcggccttaaccgtgtaaggccggtgtgtaagttggatacaactttatattgtccaatggatggtatgatgtggtctagcatcccagtactccactttataggaacactagaattggtttggttgagtaaaattaccttgccatgaaaatgcaagtaaaaattggttaagcattttaaaagtatggtgaatttataaaaaaaatactctaggtcacatttgaatttttctttgatggcttttattgtttgagattttctttttggtttttaattatttctaaaattatatttaaaagatggtttttaatttgagggtaaactttttaggcgctacaacctccaacaccaaggacttctacttactaggatatgattccatcacattccaattcttctgcgatatttctaaatttagaacccctctaaactttttaaatttgactctttttccataaacgcacacctcctatgtacaccatatggaaaccttgacttcacatgcactgttccctagcccgaacgtcccgtatgatatccttaacagtttggacctcaactccccttgagtttagtccttgatcttttcactaaccgctcttctctggcctcaagcaacttgaaacatcaacgaaagcatattcagagcacaagttaatcccaacttgactcaaatttgtgcgacaatgattcctttgccccaaaatgtaagcatttctagaggttttcacaaaacttaaggaagtgggtagaattgaatgttggaatattgtgattggttgataagagattctagatagagatatttaataggagatagttgtgattgattgagatgaagggatagctggagaaatagctatatttttggacaaatttaaactctatgaatagctacattttaggactgagggaatacgtaacatacataatcattataaaaacataaatactaaaatcaccttagatcaaaatcttcacaacttaaactcatcaatgaaattctttgctacatctacatgtgatccaccaatgatggtgcaagatgacacggtttggccgagcattcttttcagatgagcattcttcccactaacagtgtagtcaggctgagcattattttcggtccttccatactaaaggcgcatttgggccgatccactgatctcaccagctaagatgagttgtatattgctttaagtctaggtccatcaatgactagttgtccaccctccttggattcaagccaacgacagatatagcttgattgattggtggcagtgtcctacttggaagcgtctcttctagtggtggagattgaggcagatcagctactgtggacctatgatatgatgtcaatcaagccttaatatatactggttggatctgccactaagatatggcctatactggttggatctagtggtgtgatctagtttttattggttagattcaatgtaagaagtttgtcttgaggtgtggccgggcatcggtacctcctctaaagtgaaaatcctaggtgtggccttcattgtttgaatttggcgacggtttcaacctaagcggcttgtccttcttgaagacgtttcatggacaatttggtactggtggctctgtttgagaactcttttgacttgtccttcactactttggatcttgtgaatgatataagtcttatctttctttatgttgttgctacgaaggtatagacttcaaaacctcattgcttcatagccatcgtgattgttaggatctcttgattggtcctaaggatagggcaaagtggttatttttaggtagcctctatgacaatttgtttgccatgttgatggtattgtttactgctcttgaaataagctttatgcttcgtggtgtaatggttgtgtgtatcccttgttcgtgtagaagccagaagtgcctccattataagaaagagagacgctccggtgccctctacttgcagtattctactctaagtagaattaatctcgaccgtttattttaaagggtaaattagtaaagtgctaaaaccgaataggggtaaatctggcacttaatttttttctcatttgtgcgtcctatggtcaagcgtcgctcgatccctctccatcgaacagcagagtcgctctccatcaaaaaggagagcgcagggaaagaaaaagaaaagcagatcgcgaggtccggccaccgccggcgcttgtgcatcgcgttccatagatgtttcttgctgtaggtatttggtttccattcagcttgattgtttcatgtaaaatttaaatatattagttatatatctgaatattacacacgatggacaaatcgaaacactccaatccagcaatgacagatacaaggcaacggaagaataatccggtatgtttttttacgtagactttacaattgcaattacaacaagtaatatacattgaaccacgtacaaaaacgatgatatacacagataggcactttcaaaaccacaagctgttaataagctatagttttgaaaaaaaaaacatggccatcagtaacaagccaaagccacccaaagccatcttgagataatgaattcacaggaattacaggacatagcacaccaggaatctctcaagcgttgattgacgtagtgatcattagcttgtccaccttgtcatgctcagccattctgaacaagctcacttgctccggattcagtttactggcattcaacttgaatcccttcttctaggagaaaaaattatgaccaagaactgcagaacttgagtagacaagcagaaaaactattcgagaactagaggccaacgaaaaagaagattcagtgcagatgttcgagctgcaaacctacaagcagcaagaaaaacaaatcaaatctgacctgcaaagcagaaaaagagtcttctcatgtcagctaatccgttggagagcagcgctatagccagcgagaggagtcttggatgatgattcggaggtcgagagattggtggtcattggctccggaggttgcgggttccgcttgggaggcgatggattgggggctcgccctcgcggctgtgggatcaacggcgggtggagatggatagggctggagccgagcgtgggggaggaggccgacgacgaggaaggggatagcgaggtggacgaggtctcggcggcggccagtggcacggtgctgggtcggaggcggagatccgggaggcgaactcgtcggaaggtgggccgacgcgggggagcggcagagagggcgcagctctggcgatcccagacggagatgcgagctcgtcgagggcggctgaggcagccagtgcgacggaggcgagggagtaggaggcgtcgagggcggtggagtaggcgaggtcgtcaaggtggtgatgggagccgcggggttctctccgcatcggctccagatgcgcgattccggaaggacgaaaatatccctccacagataatttttcctggataaaagtacccctccacgattctactaccactaagtgtggtggtagtagaaatagatctgaaccattggatcaaataagatcaatggttcagatttttttctactctaggtagaaggcaccggagtgagactctataagaaaaccaagaatacttatgaaagtcaatacgattagttgagagtgtaatcataactagtgtcattttgctatcagtacctcactcaaagctttaagaaattgtcgatcctttccaaatttaatatggactagttgttatatataattcaacaagaggttacaaagctagatatgttcttccatgattttctatttcacctgaacatacagataatatcatttttttcctagatgaagacgatgctctcttgttttgcaattgcacccaagatttccatggctaataagatgaaaaagatgagagatcaactgagaaagatcaaagagggtcatgaggcttttagactcacacctgactccacaccatataatgagcatcaccgtcctgatccacgagaaacaacatcgaaggtgattcaatcgtccatcattgggagagacaaagaaagaaaacaagttgtgtctttgctatcagcaagtgacgaggaagacacagtaattttgccaatctatgggtttggaggcattgggaaaacagctttagcccaactggttttcaatgatacccagttcagaggttatgaccacagggtatgggtctatgtgtcccaggtatttgacttgaaaaaaatagggaacaccattatttctcaagtgtcaaatgaaggaaataagaatgaatataccagggagaatataaacggacgcctttgtgatctattagaggataagaatactctgattgttttggatgatctatgggaaacaaatgattttcatttaaatgagttgaatcttatgctaaatacaaaaggcaaaataaaagtcttggtgacaacacgcaatgaagacgttgcaaagaaaatttgcacacataaaccatataggctaaatcccctggactctaccatgtgttggaatataattaagcaacgcagtaatttagaagctagaggtgataaagaccaaatcgagcaagtcggatgggtcattgccaagaaatgtggaggcatagcattagcagcccatgcacttggtttcttgctatctggaatggaccttgtggaatggagagcactgagcaatagtgatatttggactgaagctttttctgataattcagtgttgccatccttgaaactaacttacaagaatatgccaccatatttgagattatgctttgcctactgcgccatcttccctaaaggtcacaatatagctaaagcaagtctggttcaccaatggattgctcttggttttattgagccatctaaaacattttcatccgtacgacttggcgagaagtatatcagacaacttgttgggatgtctttccttcagcgttccatattgcacactgtgagttatcatatacctcaatagggaagcaatgttttgcctgtcttaagtcaattataaagtaccatgcatttgtaaataactaataattataaaaaatgagtccgagcatactcagctgcaaggctaacacattacatgtacgcatgtttaccccaaataatatgttaattgtattagaagtagggcttgtataatttatcttgtcaagtatgtttatatcttttgggatattaagagctttgcctttctaaaataagaaatggaaatgtgaagaagttgttacaagtaccgaataatgcccattaacataacgagaaaggtcatatttgccacatacttattatttactctacagttcactgaattattactaaaactgaaactaacaaaaaaatgatagtactttacattgccaaaaaaaatatatttaaatttataatatttaagagatcaaacacaattcgtattgatgattttgttaggtgtgtgtttataatgaacctgatggtactttacatttttctttgttcatgtaaggaacaagaagttttcaccatgcacgatatggttcatgatgttgcgagatcggtcatggatgaagagttggttttctttaatgacacaaaaattagcagtaccacagaacaaaaattttgccactatgctttgcttgaaaattatagcaagtcatcaaatctatcaactatattgcctgccacgttaagggcagtacatacttcgaattgcagcaaattggtgctccaaggtgatgaattttcattcacaaagttcttgcgtgttctagatttaactgactgctccataaggatcctcccaagctctattggcaaattgaagcagctgaggtttcttatcgctccaaacataggagataatgtgttcccaaagagtattactctgctcccaaaactaaaataccttgacctccatggatcttttcgaatttcagcattgcaaggatcaattagcaaacatgcttgtctgatacatcttgacctatctggttgctctaatatcagagttatacagccagaagctctatgtggcctcaccaaactgcagtttttgaacttatcgtggtgctccattcttcaaatactgccagaaaatattgcaagtcttactgaactgcaatatttaaacttatcaaactgcttccttctcagccaattaccatctcatattgggagcctcactgaactacaatatttgaacttatcaggttgtcagggccttgtaaaattgccaatgtcgtttcggaatctgaagaatttggtacatcttgacctgtcaggctgctccagggtacaagatttcaaacaagtctttggtgggctcaccaaactgcagtacttaaacttatcaaagatatttggtagaaccagagtgggtgataattgggatggttatcctgaaactatcagtactcttaatgatcttgagtatctaaacctttctcggaatagcaggattgattatctaccaagaagccttggaaacctcaaaaagcttcaaacattggacctttcatactgtcggtctctgagatccctcccacacagcatagaattaattgacagtctggagtttctaatagttgtggggtgctcagatcaacttaaggagtatttgagaaaatctcaattcaagaatattccaatatcattaccacacttcattgttcactctatttctggtgattcccgcagcaaccttcatatgcttgaagatataaatcctgtcagacttgaaataagctgtcttgaaaatgtgaagtccatagaagaagcacgaggaattgagttgtcagagaaacaaaatctttcaacattgacatttcattggacttcaagggctgaccgacttttggaggacaaggatgttttgggagaactaatgccaccaagaggtctgtggaatttaagcatacaagggtatgatagcacaaccttcccaacttggtttgtaggcatctcacatcatcttccaagtcttgttaagattgagttgaaggatttgcacagatgcagacacctgccaccactgggacagttgccaaacctgaatgaagtgcatctccaacagatggacagtctcacaaaaattgatggcggtttctgcggtggcgacaaaggcgcattccgcaaactgaaagtcttcaccttgagggatatgaaacagttggaagagtggagcaccacaacacacagtaaaggtggtgaggatagcatagagttcatgttccctatgctagttacactgtcaatagagctttgtccaatgcttagactgaaactatgcccaccgatgtttcacagctggctcatatcagagagcgacaaggttatatcttcatggggtgagatcagacaccaacctgcagccagtgtcagccattccttctcttcttcttccgacaccaacttggagatcaaaggagtaggggttgcagcggacgagtggaggctgcttcaccaccaccccaccctccaacagctggagatctcctggtgtaaaaatcttttgcatcttccagacgccatccgacatcttccatcactatcttatccaaattcctaatccgtattttcactacatatatatactcgtatactccctccgtcccaaaaaaaatttaaatcctagggatgaatctagatatacatgtgtctaggttcattcctaggatcgatttcttttttgggcagagggagtactgcttaattatttcacatcacatcaaacaaaattgaaaatgtctttgctaagcagtgttgtcttatgtttaggctgtcgacacgggtttaacggaggctctgatgaagattttcgctgaagatttcatgcctaccgactcttcagagtaattgttccttttggtcgaaagtatgcaacaggcaagtctacagtaacctggtgttgttccattgatgtacactccatttcataatttcaacatgattcactattatcaactgatgccactctgtataagattatgcgtgttttcctatagtccttaaaaaccaactagaaggcatgaactatcatgataactgtatgtctctttcttccaagacctgttgtgtttgtgtcgtggttggcattacctaccaggggcacgccaaacgcatgatgtggcaccacagtagccagaggccagtagggctagttatcaattcaatttgttgcattagtttggatcctttgaatgttttattacattctattgttaggcgctagtaatttgaaaatcacatgagtaataaatagataaacaagtgttataaatctatctctctttttgtggattctcttcttccttgtgcaaccttcccccctgcacatgttcctgctatcctcactacagggtatgcaattttcaccaacaatgaccaagtaataataacccaaggattcagaattgccatccgtgattaccaagtcacaaaccatgcaaaaaaaaacctggttgttttatagtccccaattgtacaagttgttttgttactttcatctaagggcttgttcggttaatccctaaccgttgccgggcttgttgggaagggatttaccaaacaagcctaaacaggaataggtaagtatacagaaaatttgatttgctttaacttgcactgttggaaatttaagtgtataacacccaactggacagctggaaatttaagtcctcaatatttttccagttatatcccctcagtttcgtgatttgaattctttcctctttgactgctcatgtatctaccgtatgttctatacgtccatggctcctacattgttttcttggcaatactgtgttgctccttacataatataggccatttctgccataaaatagttgttgggcatgcttgtcaataagcaataatttctattacataacagtgtaaattaatcttgccatctcatgccaatgtttattttttgtttgtgaatgaacagtcatctcaagctcagagtttggtatatgacatatcccaaaaagaacagcctgtgaatcaaatgatcatgtagattgtggttttgatcatgattatcttggagactggttgtgatattgatgatgctatgcttcgttgaaattacactattgacatgcattcaactatgttgaaactttagagccaattatcaagacaatttcattttatactgatagtttagagttccataagttaggaatttatgctgtattaagtcaatgtttggtcatttttgtgaaaaaaatgggcactaggaagtgtacagtaagtagtgcgaaattcttgtacctaatgcaatattaattgatttattgctcaaaccttgagccaatgaatcttgttggtggtgtcaagcacaactacgataaatgtcaactgcattactcaaaattgcgtaaagaaaacgaagaaaatcttttttacttacatcaagaaagtgtgatggttataaccactctcacatattactgtggttgatgtaagacaaaaaagaaatcgttagaataggtgtccgaatatatgagtcatgtttggttacacttaggctcaaagttataattgtgatataggatacatatttcatcaatatcgcaaccatgactcataccctatggtgcagggtagagaggttggcggcaacaggtcaatcatacttgcggtggtagagtagagtaacaagatcagcagaacaaaatttgggtaaggccgatggggttcgtcaagctttgtggtgtgtcaacacgtcgtgcaagtgctggatgagggtgtgcgtttacagatggctcacggcttccaaatcggcaaggacgtggatcgattcggagtaggtgtgtgtgcacacaaggttctgaagcagtgcatcgaagggcgtaatggtactaaattggaaggatgcgaggtgatctagttggtttggctagggtagatacgagtacgtgtgatttttttttatattttaaaccttttaaaaataatattattttattaatagaccctataaaactgccacaccatttttgaaaatgaacctttttagctagtgtgaataacactggcatgccatttatgagaaccctaatgaaatcctgccaataacaatcttgggtatcgatgtcaacctgtaccactgtgccaatgttcttggtaatctccttcccatggcttctgttcatcagacgaggcggaagtgcgacaattttggcctaaatagccaatctgtgaaaactgacacgaagcggattaacatccgcatcgtacttcttgagaatcacagcatgcttgcccaccatccacggtttctatccgcatccgtcctgaattccgtgacaaataggttgttccccatcgaattgaacaataaaccccgcgaatcttccgcgtcgggcacccgataggggagaaaaatcaagcgccacgcctccgcgcccccaccacgtgcgcccattgcaacattcgcccggatataacggaaacgccctattaaggacattctacggcagccgtaagccgtagaagaaccatcatgtccttgatgcgaccactcacaactacaaccgccgctgccatggtcggcacgactttcgccatgtcagattggattggttcccaagagccactgaacctctccaaggttgggttcgaggtcaccgcccacacattatccacctcgctgatcctcacatccgccacacaccaccaaataaccaagggcagacaacaatgcaaagatcaccccgaattgacactacaagagatcttatgataggtgacgtttcatttacgtcacaaacattgaatttttcatcatgttccgtaatctgtgacgctcccgtgacgaaaatccattcgtcacctatcatgcgtctctaatgatgttctatgacgaaaccttattttttcgtcattaatctagtgacgatccttctgtcttctgtcgtcataagtctatgacgtccgttttcgtcaccatcaagcccaaaaatcgtcataagatgccatgtggcctgttaaggcccatgtagtgagcaatatgattatgggcttagcccaatggcaagcccaactagattttagcttggctcatctatgatgtaggacattttcagcctgtttatgggctgtttatgggctgagcccaattgaggatggatttatacactatttcagcccaattttattaatccatttacagtagtatcaaaaaagatgagtgggccaagcccattttgaaagacaaaggcccaagcaatatacccaataacaaacatatagcacaaagattgtagcccagttaaaatccaataaaattcagttcacatatgatacattgcaaatacatatgggccgacccattcacatattcaaatacaatcacaagtttgataaaaaaatagattacaaggtaacttgccaaaacaaaatacatcagtacattgaccatgcatatccagccataagtcactgaccaaaacaaagtcacatgtccacatgggccgacccaaccatgtccaaatacaatcataggttcacttaccaaacacaatgtcacgtatcgaaatcacaccaacatactgccatctcttcatgaatcagcaagacaacaaaccttacctctgaaattacatgcaaacaatttgtaaatgcatgtttagtttcagctgctgaaagagaaaatttacaatatctaatctaaactacttatttatgtacataaccatgaacaaagaattcaagtacactgcaaactacttgaacagatcaaaggtaacttatgcataaagtagaccatggagttatactcatttctcatataacagtaaaaaagaagcgaagcaatttactggtatcttaccatggcatgtcaatgagatcctgtcctttgctgtgtttcacagttaaaaggaacatggaacagtagaatagtatggaacattctcatggttaagtttctttcacacttgtcctatagaaaagcaaacattagtagcacagtatttgtaaccacaaccatacaaaactttgaacccccgcatgtggccatacaaagctttgaacccctgcattgcaaattgaggcacaggcataggcataggcattgcaaattgaacatatagtactagtaagtacctaaatagaaagagaacataggcatagcaaatcaaaacaatagagttatacatgccaagacatgtgagacatatgcatagtaatgtaagcctactgcaagcagaacccctcccccttccctctacgacaaaacaaactgaattgcaaactcaattggatgtgtacgtagtgctttatcgacagattttcagccattgtaacagtaaagtgtggatgataaaaaaaatcatatatggtgaacacatattatgaagctactattgggtatgttttcggttcagattacagggtagttacatggatctgatttcagtagaacccaaacatgaaaccatggctaattttttatgctctattattatattggatatgtgctaggaagatttctgggatgtgtgaaagatttaactaatgttctgtagtcatcattaaggtcatgatgctacacaaagcacttccagccctatatatctgatcacactaacaaaatgcagctacaagtacccaacacataagttatttatatcagaacttaaaagtacccttctatgtaaaagctaacatcccaaagagaataagaatcacctttgtcataaaaggtgagcacatgtaattatacaagaccaaaaagttgtaatttaaacagaagtgctgagactattgtttatatagatagctagatcattgtgcgtgctaaccttggaaaaaaaggaatagttttcaccacccagttactaccttcttcagatctcaccacccagttactaaaaccctgcaacaaacagaacccagttagttgaaaaaaaaatagctagttgatgaaatttgctatataacaaaatgttattttcctacacagtcgaatcgcttctgaaaagatgggtgcaaattttagtttgtcataaggctgaaaatttgcttacaaaacaactcatggtcaatgctaaataaatgaaagtcatctgtactgactgatgttttggtaacataagaaagtttttttttactgaaatttgagaattgaactaacctatattgactgaaacatacaaacaaaactatttcgataaactaacctatattgactgaaatttgataaggacctctacttgctgaatttgctaaaatataaaacctaactactatgcagagttttgtttctccctgaactagtgctctatatgccctacagtatctactcctactttgtccaagacaattctactgcatttacaaaactaatatatactttctgaaatttgttaacagaactaatatgtacttgctgaaatttacaaactacaaaaataactgctgacaaaaccaatacccattttgcatacaaaacaaaagactgaacatgggtatataatttagtttgtaagtacacttgattgctctagaccataattaaaaaataaactgataggaaacctaacctaacataatttgtcatattcctctgattatctccacctgcacatcacacatttctgaaattttcagttcagatcggttcagcattttgtaacaaagaaactaagcatgctcagatatcagggaaaacgatatatatatactttcttctgaaagatggatggtttctgaattctgatgagattaacaaacaaggcttcaatttgattacaagtcaagaattatgttactgtgaggttaggtgaggtgaggaatgcaaaaaatgcaaattgcttctggtggagagttagacagtgatagatgtgaaggactttctccttttccgcaacaacaaacaacatatattgcagatcttcagagcagtacactgctgctgtggctgtgtctaaatgcctcctataaagttatactagtacccatatatgcatgcacaaaagatgcgcacgcacacacgcagacaaatccaagtgatgactgatgctgatgcctgattccttgtggtggtttgcagtgatggcatttcactagctatagctaccttctcctcctctcacatgacagatcgatgccccaaccaaccaaacctatatattagtaaagctatagctaccttatcgtcggcggcaccggatccgcgcggggcggccgagccgccccgccgccgcggtgttgaggaggggggagggtcgccttatcatcgtcgttgtcagcagcggtgaggaggggatggcgggccgccgagccgaggtcgccgagccgccgcccgtcgccgccgtagccgctccctatggcggcggatccggccctcccgagggcggcgccgccggatccgccgcccgccgacgccatcgccgctcctgcccgaggtcgccatccgccgccggcaccacccgcgtcgtcgtcatcgtcgcccactcgtcgtcgccgtcgtcggggtcggcgtcgtcgtcgtcggggtcgccgccgccgccgccaccaccaccggggaggagcggccgcgcgcggagggcagcccgagcgacgggggcgccgagagaggaagagaaagagagggagaggagagaaagagtgagagagagagagaggaagagaacgtgtgaggactgagaaggggaaaatatcaggggggagagagagaagggatagagagatgaaatttttgaagtggtgtggagggaaaattttcattgaaatttcgaatcgatttttatagtactaaatcaactcatataaaaaagtaaaaaataaagttgtacaactcattaagatctatcaatttcgttttggtcatttctccatccgaatttgattgaagtatataaaatttgaattttaaaatataagaaattcaaataactttttggatagtaaatgatttcaaataagaaagttgtcaacaacaaagttgtataacttatcaagatctacaacttctgttttggtcatttttctatatgactttgtttgaacagtatgaatttgaatttcaaattatgacaacttcaaacaatatttacaagtacttaaatgatttcaactgaaaaagacatcaataacaaagtggtataactcatcaagatatataaattttattttggtca

SEQ ID NO: 71695 - DNA, 22719 bp, Oryza sativa
ggatgaagaaatgaccaaaataaaagttatagatattgacgagttatacacttttgttgttgatgatttttttagttgaaatcatttattatttgaaaatactgtttgaagttgtcataatttgaaattcaaatttaaattattgaaaacaaagtcatatagaaaaatgacaaaaataaaaattatagatattgatgagttatacaactttgttgttgatgaatttttcagttgaaatcatttagtatttaaaaatattatttgaagttgtcataatttgaaattcaaattcaaattattgaaacaaagtcatatagtaaaataaacaaaacaaaagttttagatcttgataagttatacaactttgttgttaagaattttttcatttgaaattatttactacccggaaatttatttgaattgagaggagggactcaaaatggacttctcggtgagggaggagcaaaagggctgggccagcggcccaaagagggaggaggggaaggggaagccggcccaaggagggtgagggaggctatgggtgaggagggagaaagtaacacttgggccgaaaaaggcccaaggagagagagggaatttaatttgttttccatttattttaataggttaaatgaaatttgtggtattaaaattagttattgagctccgaaaattcactgaaaatttcatagaataatttagaacatgtagaatattaaaaaaatatttctagccatgatttttaaaggaaaattttagtttcctcattaattcacttgattaaattgctttaacttttaatatattttttttagaaatgcattatataaatctgtgacgtttgctatttggcgcttatgacaaattaatattcgtcacaatgtcccattgaaatactttatgacgatttctagttggtattaacaacgaacacctttttttcgtcactaagccaccccatctcatactaatcgtcataaaatggaatgtgctaatgacgaatagctcagacgtcatgagaaatttgtcacagaaggtcatatttcttgtagtgtgatgtaatgcaagagtgagtaaaccagcagtcaggtaccaacaggcaggtcccaagaggtaggaagaggagagaaacgtgatcaaaatcacgatctcggaagttcttgaccgagcaaccatcaaaacaccgccggggcatcatggaaccctaggagaatcatcacaccacctctgttttgctgcaattaagcctactcaactttccatggatcaaggatcctatattaaagagcgtaagtgggtcagttcacgaaccctcatatactactaaatagataattatttatactacgaatagattcatggacaaacccacttgttccctacccacaaacatcgcacaactaacctgccatgtcagggtaaaaaaaaagaacgattgaagttagtggaaggcccactataagcagggaaactacctggctggccgctggcccaagccaccccgtacccacgctggcccacctcacccaacaaaccgaggcctccctaccctccctcactcgggtgcaacctagccagcctaggatgctagagcattatcttccacctccagccgcccatctctctccctctcggaagaaccctagcgctctcgcccttcttgatccacctcctagagcgtttcctcttttgattgaacgcgaaaatcagtttccatttcccttaattctcccccactcaatcaagtctttgatcacccataaccaatgactttactccctccgacgaatcaaagccattgatgacgacattcgagctccacggtgtctccctcccttcccctatgtgctataaaaggagcccgcaacctcctcttcaccttcctgatgctgttcgacaatcagacgtggacgtggagcatgatctaacgacgtaacaagaaaaacaccgaacgggatactgttgatggacggaggatggtagcagcttttaaaaatttttaagtaggtaaaaagtatcatgttattataaaatttatgtgctatcacattcaatattataaacaccattctagtactggggattggcgtcagcgggaactaggcactacttgaatgcctggtattgcgtggtccaataagtccacgtacctccaaaagaaaatgttgtgattaaaccaacttggtcctggaaacatggctagctacatagtacagactagtcgtgctttatttttctagcatatctagcagagcaattattatttttaaaaataactagcatagcaatatagtgacagttgtgggttctacctcatatataaaatttaatcttgtcaccttatttatataattatatcagttgcatcatgtagtttaattaacccgtctttttaatactttcatattttgggctacgtgtattcgtccgacacgtataacatatttttctgcagggctgttcagtaggcagcggctgcggcagcggctgcgctgttgtcttgtgtttgtggcattcttctactgattggagcgcagctgcaaacttatgtagcaaccaagcagctacagctcctattttactatccccatgtgaaaatatttaacacatcagacaataaattcttataggtctacccactttgtcgagaaaaaatcctttatgcagcctggaacatttggaaacagaggaactccctaatttttcagaatttaccaacctcaatttcttcctggaaagctctctttaagagtgatctgtcccttttaatttttagattaaatgtttataagagacggttccttttgaattggttaaatctcttgtaatttttgttcgttaataaagttttttactgtgggggcttcccctaccttgttttcccttaaaaaaaatatttaacgacgataccgttacaattggcatttgtgtcccatttttttttactggacggagaatcttccaaacgctgttgaattggtcgtgcacaatctaccagccccatcatttgacttacttgagtggcatatttacaaacaaaaaataatttattaataaaatttttatatgtatgttcttagtaatttaaaagaaatgctgaaaaataaacttcgttgaaaaattttaaaatcaactttaaatttaaagttgaagattcaaattttaatttataagcatgaatataaacataagcgataagcgaaaagataaggcctacattttacatacaccatcctatgcgacatcgggtactctctaaacatgtttggacattgtgagaaagagatttcccacgcttgaaaaattttcggaggcaacaaatgctttaaaaaaacacttaacacgcacacattaaccacaaaacacgcagatggacattgaatctactcctaatttaaacatgccgacctgggcacaacacaacatgacaacaacagtaaacatgttcatcgcgttcctttttttctttttactgcacgtattatatattatagtatagattccgtaaggaacctgtgttcacacacagcatccaaatataaaaaggtgatagaatacaaaagaggaaagggtgatttgagaaagcatatgtaagcttctagaagaatcctggttggtgggtgcactcgtggtctcgtgcctgcgctgcttttgctgtgtcagagcaagataataatagagccgacttcctactattagccaattttaaagccaacacatataatagattagttataagtttggctacaattttcttcttctctctatgtctcacttatacattaattgtatttgtctaggaggttgtgttaagctagctcttgtatgagagccaacacccttaactttttgtcacatctctcctctacataagcctataatagatttatagctcactattatacttactctcatgcgactgatgactacattcgctgcatcagtgaggaagaataatcaaacgtgaagcgtatactctctacatatgattatatgatgggtacggcaccgttgctcacgtgtgctgcttgcccgtttccttcgttgcgcacggacgtggtcagtgacagtactactagcatgtttttttttccccattcgacgttaatcagtttaaaattgaattaacgaacgtcaataagtaagaacaaaggggtactatataagattaaatatatacaaaacttgatatgaagcggtcggaaacggtagcatctttttagaaatgatactcgatcggctggtaattgatcatatttatcatttaaattactcactatcgacattaatacgatgcagaaagaattgtgaaaaataaaatttaaaaatagcaaaaaaaaagtatggtcggaaacgataccccttatacggaaacggcgatcggtcgatcgggaatttccgtgaccgttttcacccctacctgaaagagtgataccatgtacaccacctattaagttagaacggcgtagatctagagaagttttgttggtgctatagcactcgttgataggtaggttcggatctatataccagtgaccggtcatcaccaatggtcaggagggcaccatcgctactgcctctcctttaagtcaggaaatccacatcttttgaactactagattatctttttttacccactagaaacctaatttgtctaatgaaaatctctatgaagttggagcatgtggtgtcgagaggtaagagcatgaagcttcgtggttcatgctaaggttggatatgttatattacctccgtatttaagtactgagtaaattttacaaaataactatcacaaaactacataatctagacgtataacaaactataattttagcactaaattcttcataaagctatagatttaaagtcaagtatcacaaactatatatttaatattgaagttatcataaaactacaaatttgagagtataaatccctaggactatgattagcactatcattatattggagctataaacgttgtagttttgtgataaatttgatacgtaatatttattttttgacactccatctcaaatatatagttctgtaagaaatttcatgttaaatctgtagttttttttataatttggttaattgttttgtgaaatttactcataaatataaatatatgacatggctcgttttatttggctttggtatgtgctctctccgtcccgaaaaaaactaatctaggattggatatgatatattctagcacaacgaatctggatagatgtatgttcagattcatagtactagcatgtgtcacatccagtaatagactagttttttatgggacggagggattaagtttgaacactttattctattagaataccaaaattttaatattataaaagtaattgtaaagagaaatctgcccacataagatttttatgttttcaaactattttttaaaaacttatcgatgattaaactttcaacagtttgaccaaataaaggaaagtgcaactcgattagctcaaaccctgatataaatacatcgaaaatcaaatggaaaaaaagttgtttcttaatcttgacaacatgaaaattagatatagttaaatcggtttattttgtgtgtgtgtttttgaaaaaggggtttatttgatcgtgattgattagggccttacatagttccatgtgctccaatagagctgaactaaaacggagcagtaggacacgcgtcacacgatgcaaaaaaaaccgaattgacggcacccattcctttcttcttcacttcttttccgtctcctctgctacaagcgttcgtcaccgaacctagcttctccgcaggaaggaaggggcagcagcgtcgccgagccagtggccatcggagcgactggatccggcgttcctttttttactgctgttcctctaatcctctcacatcgcttgaggtcgagctcccatgattcttcttcccctgcaactgcgagatggatagcagaatttccttttccccaaatgccttgaaaatttgttgttttcccatgggggatctttggtgctgcgaggtaggccaaaaaatgtttttattaaagggttgttttcaaaaggggattttgaattgacgaaatttactacagtacactcaaaaattgtataattggttaagtgaaaaaaaaacactgccaataaacactgcaaaagttgtgttggacaaggcattattttatattttctgaacaaaaataaaggaatttttttttgaaatgacgggaatacccccggcggtgcagcgtcacgccgagcgccactccgcttcaccgccaaacttcaggcggcattgtagaagcagcaacaacagtcagggatatcggggcggtcgtgtgacgtcggcgaggaaggcctcagaggagatgcggtggccctcgagggatcccttgtccatgtactcgagcatgatctagagctcgtcggcctgttcatacatgccgtggcaccacacgatggccgggtgtggcggacacgctccatctccgacaacgaagacggggccggcgccacggagccgactgaattcggcggggtgaggacgccgctaagcgagaagggcctaaatgaggacgtcgactatggcaggagcgggagcagcacggcgagggacgtgaggtcctgctgcggtagcagaagcgtgagatctggtcgacgccgcgaccgccccggcgtccccaactgatgctgttgcagtcccatcctcaagttcggtggagaagtggagaggcgcacggggtgacgaggcgccgctaggcattcccatcatttcgaaatctctcacctctttcagcacggaaattataaaataatgcctatggtgtgctacaatcaattacataacttttgtagtatctatcgacagtgtcacgtttttcggtatctctcagccaattatatgattttttagtgtcatgtagcaaattttacaaatggatttgtacatgtgtttatgcttcacttttatcattttttaagatccggttgtatttgccgtgtggtgttgaaaatcgtgaaaaaaatcatggatggatggatggatgtggaatttaactatttgcaactattagtttcaacaataattcaaataccccttagatttgcacttattttttttcctcttttaagagatgccttcttaattattttccactttttcccatgtggcatagcaacatggcaatgcatagtagaaaccgttgtgttacccactagtcatcctctcatctcctcctcccctcttccttcggtctggcatacgatgacagcaaaacttgcggtgcagagcagtgacagtgacgaaggaggcagagcagcggcggacagattccttgcggtggtagaggaggcgaagcggcggaagaggagggcggtgatggaggaggcgaagcggcggcaaaggaggccgagcagcgtcggaggggcttctcgtggcagtggagacggcgacagacgggctcctcgcgatgctggagggggtggagcagcggcggtgactgagaaggagggtgacattggaggagacagagcaacagtgaaggaggcccagcagcggtggaggggctcctcgtggtggtggaggaggcggagcagcgagcggacctcaggacggtgacgagttgcttggaggttctccgatgcacgccggactagagggagagaggaaggggagagaaaaggctgactagtgggtttcacgtcagtttctaccctacgttaccatgttggcatgccacgtaagcaaaatggcaaatagttaagaggggaaaaataataagtgcaaatctaatagggcgtttgaataattaccgaatctaatagtattcataggggggatggataccctatactacgtgagtatttttcacgtattcctggtaatcgtagctccaaacatatcgaaaggaagcagctacacctaaggatacccagatacggttcacaggtaacttatccgtatcggatgtatcagatacagatatgtatcggatacacccgtacgtatccctaattaccgcaatattaaaaaaagaaaataaactggatacttctccgatacgttccgatgtgtttccgtcccaatacgctaaccaacgctccagcacagaagcacaacgcagatcccaatcctcctgcggcaacgcagcgacgcccgcatcgctgtccggggcacaccgcgcagggcctcgaccagctggccgccgggttccgccgccgctcgcgcacgacctgaggggcaagccctccaccggcagccgtgcgtcgcgtcgcgtcgccacccgtgggcgtaggacctccgctggggtgggtccaccaacaggcaacgcatacaccagccatttggttctttcttttcccttttaagtctcgatttagattggatttcgttatgtgttttcccatgtcatttagatccgatgaattttggaattaaaatcttaatcgcttactccctccggttttattttaattaacgttttggacaatgacacgatctacaatatatatatttttggcattatttttctattataatatatataataaataaatgtatttttatttttattatagtgttttaaaagataaatctatatatgttgttttagttcttttaaactaaatatttttaaagttattgatggttaaagttataaaagtttaatctcaatcatatccaaaacgttaattaatatggaaacggagggagtatttaacatgcgactatgttagtgtggggatgtaagacttccagccacatcgcagactatgaatgcaaacaacgcttatccattatgtttcgctttgtatcttttattttttaaatatatatatatatatatatatatatatatatatatatatagacgtattcctgtatccgcctatccgtatcttggtatcaagttaacatactgctctcctctgccacagaaaatcccaccccaacaaacccagcgcatcctcatcgtcgtcatcaggagagagagacccagcgtgcaagcgtcatcaacctccctccaccttcattccacctcaccacgcctcctcccattcccgtttcctcggccgcaaatccagtcccggcgcccgcatttcccgttcccaaactcacctgctcctcccctccctgtttgcaatccagcctctaatcgggatcggcggcggcggcgtcgctgtcgagggcgacgtagggaggagtcgcggtttcggctccgcggtttggagagtttgattcggtctctcccctttttctcatcctttaatccggtgtgtatattcctataagccgtcttggttcgctgcatgttcgatttttttttcctttctcacatcctttttattcggattcgattaggaaatttgcttgctctgtttcttggtccaccctcgccgccgctggacaggtggacgctgcggcggtgcggctccggcgccggttcgcctcccgtagagaatcgcgcggcggcaggatccagcaaggccgccgccgccgccgctgggaatcttctcttccgcgtccgggatttccggctcaggtgaggacggtggctgcgtctttcgttggaattcgctgcttttgcttattgggaagaagaatcctgttttcctgggtgttcttggtcacctcgtccgctcccaaatttatggaccatatggaattcctcgatctttgttcttcttttgctatattgggacttggagcatgcggattcaaattggttttgcttcgaccagagatttcgagccgcggaaaagctccaatcttgagacgcgcccggttgtcttgtccgccatcggaaaatcgtggctgatagtagtattccgataaccttggagcttctaacctcagctcgctgtcctaaaatttgttgatatcccgctttcgatttggcgacttagggcaaaatattccatgtttctgtcaattttgttgctcgatcaaaggatatgtgatgaatctccaagtaaagtttaggctcactttttttttattaattgaatttgattggtgggtattggaggctagctcatgtgtagtggtgctgtctcatttcattattggccactcgttcctaccatcacttttctagtagccttacatgcttacagattccaaagcacatgctccctcccccatttttctttactttatttgtttgctttgaggtttccctgtttatgctactgcacgaatcatgtgtgtttcatcacatggtcagtactgtcatattcttggagatgtcctcattatggtttctttaatgtgttcttgttttgctatgtttgtagcttcaagaaaatacttgctgagctttccctagaaagtaaaacaaataaaggaatatgagatcagtagttcggtcgcttcgccagctccggcgattcggccagctccatgcagagagacactcatcaacgaatagattgatcaagcagcagaatgctctagtgctgtgcagttcagcttccagttcaatgagcacattatgttgtaatagagaaattggcagatatgtgagcccaagtgtggaaatactgaggtccagcttttccactgtggcagctgattcaatcaaaggtacattcttgcactcatttgtattctggtagcggcatttcattcaacatattttctttcccaatttgtgtcagatgttgcaagaggtggtccgatggtggaatatgaaaggagaatagcatcaggggagcttgtggatggtgataactttcaggttgttgcaccgctcctgaatgtttcctttcttcttgtctattttcctttaatgtttggtgtaagatttttcttgccatttttcctcattatacagattgatactattcaacatttacaaaggctctatgaggagctggttgagaatgaagaagcttgccaactggacagataccagtcatctgagaaatctggaaggtaaatgcagttagaaaacacggagttctcattgtttacctggtagtgaatgttcctaagtcctaaaccttattattatgtttggcaggcgtagatggctatggtcccgcctcattacccagccttctacctattctccggtgcaggggctgtatatgtatggaggtgttggtactgggaagacaatgcttatggacttgttctatgagcaattgtaagtacctcaacctagaatctgtaggctttgttggtgcatccttgagaagttgagaacttgagataaaacagttatgtttcatagtgcagataatagataaaacttgtccatagattgcttgcttattagtaattcatcagtgtgcaagtatgtgtaatgctcttcgatgaaatgaaaactctggtgcaaaatagctcatacaggatttgcatggcaattatgcagtcctcaatgacctatttccatatttaatcatatagagaactgcataaagaaacaagtaaacaagtatgcctttctactttttacttgttcactataatccatatatgatctgcattcatggagaagcatacaatggatacatactgaaaattgacatggtgaacaatttcaaaatacagatggtatgttactttacagaatttaagaagcttcatcagtggttcatgtactgttacataatgctaaaatagtaaaaaaatctctatctatggaattttcttgagttattcatttggacattgtctagtatgaagggtctaggctattggcactgtctagtataattattaatggacattcatgtgacttccccaatatggagtcgataaattttcaaataaaaatttcacttgcttatatccctaaaatttgagttctggttttaatgaattcaaaataattcatgtcgaccaaaccaataataactagctcaaagccttgtcagtatcttaacacatgagttatgctaatgaattggcttgaaatcactcttcttaggcactaagataatgagagaattatgagctacacctggttgaactgaaactcttggattattaattgaaaaccagtgaagattaaaatttattacataacacataggaatttcttgattatattccagcattcttttgaagaaatgcactaaatcccttggtcaagagctttgtccattatgggatttccagcataaaaaaacactaaatggagtaaacataaacatgtctcttaaatattttggctctttctttgcagttgtttagaaataagtaggaaacatcaagtagtatcttggccagtccaatctctgcagccctatttgctagattggagcctacagtgatcatgatgatttaatattaaattaaaataaccatatttctccctcttgaaggaaagtacctggaaaaaaccatcatgcgtcttcctttcgtctttttatgaaatatcagtgtttgcatcaaaacaatttcactgtgtggtaaaagaaacacaaaattactttttcatactaaattggttttttttttttttttttggggggggggggcaggccagctaattggagaaagaagcgcattcactttcacgatttcatgctaaacgtacatagtcgtcttcaggtacttatgtggatataatgtgcataactagctttctcagttttagttcaggcatatattattggactttcatctatgtacagatgcataaaggtgtttcagatccccttgaggtggtggcagctgagatttccgatgaggccatcatattatgtcttgatgagtttatggtatgtgtatgcttatcgaaatattggattgataagtatgtgtcttgttaacaaattcaagacattgtacaggtaactgatgttgctgatgctatgatattgaaccggctattcagacatttgttcagcaaaggcgttgtatgtgattttttttcactctcttattccagttaagcaacttgcaacagtaccttagcatttcatattaattatcttgcatgatgatttttttctcagattcttgtttcaacgtctaatcgtgctccggatcagctttacgagggtggtttgcagcgagaccttttcttacctttcattgacacgttgaaagtatgagttagtttcacaatttttactgtcaaatcaattttattgtgcatgtttactggactcaacttttgtgaaccatttcaggaaaggtgcattgcacatcccattggctctgcagtagactatcgtcaattgggttctgtatgttgcctatcttttcaatatattactgtttaattttcttgtaaaccctttcctttgttgacatctttcatctgatacatgaacaggctgaacagggtttctattttatcggaaaacaatactcacttcttaaacagaagttgcaaacattaattggagatgaggaacctagacctcagacagttgaagttgttatgggacggcaattgcaggtcttttataagttaaaatttttaagtagctagttttgttccagtaaaaaaataacttggtgttattattgaaccttaatttgttgcaggttccactgggagcaaatgggattgcatatttcccatttgaagatctttgtgataggcctttaggtgcagctgattattttgggctgttcagtaagtatactggtgcaatgcattttctcaatcaggattttcaaatgcctattattgatataacataattgttgccaaattgttactatgcagaaaagtttcacaccttggcacttgatggcattcctaagtttgggtctcagaaccgaacagcagcttatcggtttgtcacattggttgatgtaagatcattgtttccttactctattattttcatgttcaagtttgcattggcctgactgcttagacaaccttttatagttatgactccgaactactagacaataagcaccttgaacctgatagccttataagcacagatgacatttgctttgcttctctttagtactaatgcactaaattttcttatgaatcttggtctcttcgctagattttattatataatagtgtctctgttcaagattgcaaagcatatattttgagtagttttgtcaataaatattaggtttttctcatatatcaacgcaaaaaacaaacacatttttttccttcatacccccagtaaatattcaccgttactttatattccatacatgcatacatttaatatagcccttaagagatactaattctgtggttaacctagtcctttttaatacatgctttatgtgcaagatgacatatgccttgtatgttggatggacaggtcacgggagtagaattttttttattgcagatagaaattattcttgagcataaacaagaacagaattcatgttaaccagaacctctgtttaatatggcagaagtaatctcgtctctaaccaccaaggaaatgatgacatttcaggttatgtacgagaacaaagcaaggttattatgtacagcagacgctgcaccaatagaactatttgagaatatagtgacagttgctgaagcacgaaaaatttctcctagatcttcacggtcgcagaaaactgatgatcctgacttgtgtgtggacaatgagctaggatttgccaaggatcgaacaattagtaggtaatgtcaaatttgtgatattatgcataatgatttcagaaggcaataagttttatcgtttctggtttttttgtttatgcaggttgacagagatcaacagtagagagtacttggaggactttgaagcgaaattgcgacagcccttacaaggtgtagataatgatattgatgttgtactagtgtaagtagcagcaaattgtctggtatgaattaagtctaccctcctggctttacaaaatgaagaaagaaaatgttggttttccaacattggtgcatgtaaatttgcaataagccccgtaagaaattttgcaaacaggcgggtcatccataaagtgtaacacctgtagagaagaaaaatgttgttcgttcttctgaaacctgtgttgtgtctttttgcctcctctcactttctattcccatgtatatgccaaaacaccaatatcataaaaatagaatatgttagattcagtgagtgatgaatattgtcagaagtgaaggaacaatttggccactgctaacaatgcctggttcctcttcaatcataagctcatcaagttatacagtgtgcaatgggaatgaataactgaaattcattttccctgcattttacaagaccgctattatgtctcgttctagatcatacggtaggaagctaatgcacataattgtttataccctgccgtaactagttgctacagaagataacccccaatccacaaataaacagaacccacacaaagatttcaacaaatttgggctgtcaattcttgagtagctgcgcttaacaaaaagttggtatttctttattaaaaaaaatctggttgtcacatcttttgggtgtataaagaatttcattcttcaacgattgggaacaaaatatcatgcaagaaacagagggatagggatgttggattctgtcttctaaagaagggaacgatcttcatactatacagagggatagggatgttggattctgtcttctaaagaagggaacgatcttcatactatactcgtgagttgatattcctgtcgttctaaaatataacaacttttaaatatgaatttggatgagtgtatatccatatttgtagctgatggttgtgatattttagaatgaaaggaatgtttaagtgcaaagtatgaactgtagcatatccgactctcccttttggagaactgttgcatattcagtttgcagcatatggttgttgtgatctgcagaggtggagatgtgtggcgatgggcaacacaaactagttccgattctcccttttcgccgtcatgctgtgacggaatgtttaagtcattgatgaagttgcaaactatatcttctagcttctcttttttgtgttttagttttcttcgtttgtgtgaggtgtggagtctaagttttggctatatatatccttcgtggatatagaggtcatattattaaaaaaaactattatttaaaaaatattatagctaacagttgctatattttgaaacggagaagtactataaaaaaaaataatttgtagctgacgtatcaaagtatataagatacaaatggtgctctgtgtttggcatcttatactgctaccagatttttaaggagcatcagttcacaagtactatgtttcctttttcttttttcttttttggagtttgtgtgtattttattttggtgcagatgtcggatgctttgatgtggaaaaatttgtggcggaatgctaaatgttaggtgcaatatagatttatggattgagctttgaaatataaaattctactttgactaatctgcagtctagaacaattgtccgatcagtaagacagatgatgttgttaaaaagaagttattaattattaggggcaatttcgcatttgatcctgttttgaggactaaggccgtgtttagttgttttggtaaaaaaaattgtcgtatacggacacacatttcaagtattaaatgtagactaataacaaaacaaatgtctgtaaattgcgagacgaatctattaagcctaattaatccgtcatcagtaaatgtttactctagcaccacattgtcaaatcatggcgtaattaggctcaaaagattcgtatcgcaatttacatgcaaactgtgcaattggtttttttgtccatatttaatgctccatgcatgtgtctaaacatttgatgtgacggaaaagttggaagtttgaagggaactaaacacagcccaactaccaatttgaccctcttctttcaactttgctcatttgagccttcttttcaaaattgaaaatataatctgaccctactccgttaagggcatgtaacggtgttaattggagcaacaaatgccccttcttcccttgcttatttgattctattttataaaaaatataaataaaatataagaaaattttggatttgtgaaccacccatcctcttcaccacggcgctgtcatcgtcgctgccgacccggcggcggcacttgaacggaggaagacggaggtcggtgcgcggggagggagggagcggcgccctttgtggcaaaggagctcgccggcgtgcggagggtgggcggcggcatcacacgcgcggagcaaggaggccggtgcgcagaggacgagcatcaccctgtgtggtgaaggagctcgccggtgtgcggagggtgggcggtggcatcacgcacgcggaggaaggaggccggcgcacagaggacgagcggtgacggtgcgtgcgtagagggagggaacggtgccctgtgccgcgccggagctcgccagcacgcgggagagaggcgcggaggacggtggcgagaggcagccagtgctggagaacttgttggcgcggggtcacacgtcgttgccaacccgcaagtccctaagaccaccgccacgccgccgtcgctgacccgccgcctctgaatccacagcccgcatgcctcggcaacgccgtatttgtggctcgcacctccagccgccgacggatccaccgcctgcacaccgccacagcccaagctatgccgcagttgctcctcctcctcatcgtcgagcctccgcagccgccgtcgccgtcgccgccgctcctttctccgcgcgcgccgccatcgccgcgcacgcgttgccgcgggtccagtcccttcgtgcctctccacagccgccactacctccctccacaagtggccgcgtgggctcatcccctttgtgcgccgccgcctcaagcggaatatgagagagatgggagggaatggatagggttaggtgtggatagggtttgagggtagtttggtcattatgaataataattatactttttttagaaaaaaaaagaaaccttaacattgcagtggaaacagggttagacgggggtatttgttcttgaaaagcatggccaaataagcaaattagaaaaagtaaggtcaatttagtagttaggcttcaaaatgagatcaaataagtaattgtccctaattattaatgtacgattaattagagaaagtttaatactccacccatttcaaaatataaggtacaaccatatggacacagaccacaaggtcgccagaattcttcagtatgtatcatccacaaatctttaataatctttaacaaccatctcaacttaaagaccaagaaataattagatcttcatggtggagaatttaaataataatattttagtgcagaagaggtgttagttaatggcatgcatgcatgtatgccttatattatgaaacaactttaaaaagtagttgtgccttatattatataatggagggagtaatatagctaactactacctccaaaaattaacgcatcatctatagctaacttaatagactaatattacaatagttaactatagatacacactataccattaatgcatttcccacatttctctctcacatgatttattgtagcccgcttttcctctctcccccctcctctctgctccacataagcacaatatgatatggcaacatgtataacccgcttatattatcttattgtactcgctcttagcaagagaaaccaactacttccgtccaattttaagcgcagttgtgggtttctgtgcccaatgtttgatcgtccgtcttagttgaaaaatttataaaaaaaattaaaaataaatcatgtacaaagtattatcatgttttatcgtgtaataacaataaaaatactaataatgaaaaaaaattcaaataagatagatgatcaaacattggacatagaaacctacaattacacttaaaatgtgatagagggagtattgagtttgtgtttacttgattacccctatttattaatagtatagcattgctctaaaagtaacaatggtgtgatgttactatctcggagaagcatctcttcgatgatgtagagacgaaagaaagatactccatccataaaaaaaaacactcaaactaggtgggaatgtggcccctcctattacaacaaatctgtcgacgggggatacccgtggaccggatatagaggttattggggtccgttggtacgaggatcgacgtagtatgacatcaagcaaacaaaagataaagactatactggttcaggcctcttggtaggtaataaccctaatccagttggtatgggattaaatgatggaaaccacagattacaaagggaatagcagaactcgatgataccgacgagaccgtagtcgagttggtccgactagatctcccggcgacttggctcctgcacgctccggctccgtaggctgtggtgggtgtgttggcggtgatattctatgccttaggtcttgcccagggggtcccttatataccgcgggtcagtttatctccaagtaggactcggagataacggacccctcacgatatggtgaagacccagtcttgtccgagtagaactccttccattcgtagacaccatccctatcacgtgatagatttccttaatgtatacggaaactatccgtatacgcgcgggtataccgtatcaatatacaacgcacatccaaggatagagggtataccttatccgtaaccctgacagtagcccccgacttctgcttaaatgagctcatgttatcgatcgtggcttctgatgtcggaattgttgtcgctctcatctagtcgatctcggtgtgaaaaccatagagacaaagagccatcgacaacaccgcgtgaagttcaatggtcatgagtgaatttaaattgaagtctgaaaaactaccgcacaactaccgcacgcaacggacccagaattttccggcggcaatctctctcctttccttcgaatacgcaccatcagaagcgtgtttatttaaagggattttggggatccatttgaagtccgtttgccagaaaactctcctgcgttctagcgctccttgtcctctccactccccgcaaaagaaaaaccctagctcacttccttcatcctgttctccggcgatcctccgacggtgatggaccttgagaagtcttcctcgaacaccacgtccatgaagaagctgcaggacgacggtgccctccccggtcacgggaccatgcagagggaggctggacgtacagaacctgaacccatcttgggccgcatggttgtagtcgaagattatgtttcttgcggttttcttcctccgccttccaagtttcttcttcttgtcttgaatttctacggcctttctttgcttcacctgaaccccaacttcatcgcctttctgagcatcttctctcatctttgcgaggcctacattggggtagtgcctttccttgacctcttccgtttttattacgggctgcgttggatggaatccaacagggtatctggatgcgtcggattccgatttcgggatggcctgaagtcgcgttacatccccttctagtgccccacttctcgtagcaagtggcggacgagatggttctatctccaaatagagaactcagaccccgtccttgttattcctgaggaccagccagaaaagatcctagagtggactgctaaacccgccctgactccctcactccctccaatccattatcgacatcattgatgatctccgaaaatgggggttgtcgggatatgaagtcgctgccgacttcgtagttcggcagattcaaccgctacaggcctacacccatccggccttcaattactctaggccagatgacgtgacccgggtctctccttggggtatttatcctcgcatttctatttttgttccaactgtatctgtttcttctgacttatcgagttctcgttctcgatttacaggtctggatagtgacactgtggggtgccgtgtcggccagataatgatgagcgcaccttcggaggcgaacggcattcctgtctcactctgcgacacggactcggctgaacgcgccactgcaattaacgtgagtgtactcgatgattcctttacatctttcttctcgagatcacgtcgtgacttcatgttgtgcaggctctccctctaacagacgccatcagaccacttgtggatcaccaggcggcgacgtcgttgaaggagggcgtcgccaaggaggcatcagacgttgttgctgccaccacaagtggtagcaatgttccgaagagggagaggaagttctcctccgtgctcgggtcccaccggaaggcgacgagcccagcgataagcttctctttcgtccttgagtgcgtagtcggaacgacttaacctcacatcatatcattttactcaggactcgggtgcgtctccaccgcctcagcgaaagcaaaggttggtgacgatcggcgagaagtaagtaaatgcttttgaggtttttatattctcaaagttttgatcacctagcctcatggagacaagatggcgcgtgcgaaagcggcgcatagtggggctgatgctgcttctagtgcgtcccctgcggcgacctcgacggaagtcgtggccgttactaggaccaggaggcggcgccacgtagtcctatcgcccgcctcatgcccgtccggcctccgtcccccgacgccctcacttggggggagctccaggctgagatggagagcatccttcaagcgggcgcccacggcgtgggccgcgagatcgaggaggccagggcggcggcgtcgtcggcaaaccagcgtgccgatcagctggcgcgtgatctggcggaggcccgcgaggacctccaaaagattaaggggctggtagctggaaacgagacgcagcggcgcggactcgagcactggatgtcagagctcgagggccatctgacagctatccgaggttcgctgcggacatcgttcaccggcctgcaccaactcgccggggagtgcggcgtcacgacttcgatcctggcgcatcctaacgagtggtcgttgatgtcgtcgctcgtggagctggctaaggcaatggaggtgatcccctccagccacgcggccaggattggtgaggagacgtctaacggcatctacatcggggcgtgccatgttcttgcgtgtatgaggctggcgcatcccgacttagaccttaaagagactttggatcggggggccactgatgacgcgcgtaaggacacgatggaggaagtcggtgacttgggggagtccgtcctccccctttttgaagagtaggattttcattttcctctatactccttaatcaacatgctgtaatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaa

SEQ ID NO: 71696 - DNA, 22769 bp, Oryza sativa
aaaaacattgctcaactcgcccataacggcgggcacggctattcgaatagttttactctggcaaaaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaatcaatgcgaataggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaatgaggaaaaagactaataaaaaccaaataaacaatacataaaaagtaaacaaacatgtagatcataattttagatgaattatgagacttgaacggcctcattctgatttcatatgaatttattatgaattttacaagatttaattccaattaaacctattaaacggagactattccaaattaattaaatcatttacaaatgatttataacggagataaaggattaaagcaacctccggaaaagattggatcttatttggtagatgacatatattaaaaagaaataatatgccactgaaaagaggagaggatttatattgattttggacagctgagattaaccttgaccgagtcgactaagatcggatggcttggattgatttggcaagcgggcctcacgagataccgactcaacgagtcaactccacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgataggccggtgggaaactagggttgcacctacggctacacaactcgactaaaagcagcggctaggtttaagcggcacacagctgcgacacggcggcactaagacaacttgactcagctaggcggcggctcagcggacaacagcgggtacggtgcacggcaatgaccggctcgacgctaggaccaaacaatattagattgaattaagaccctagggataaagtacaccggtgaacgacaaaggagcggcggttgccggcgaaccacgatacgacctcgccggagatagagcggccggctgcggatttggagggcatgcacacgtagaggacgacgaggcgaacccaacggtactcaccacaacgacaatcgacgtccgacgacggccggcaacgacggggaacgggcggcggctcggttgaccggcggcggcgaagaaggacgggcggccgggcttcctcactcctcggcgcacctcttggcggcggcggtaagcgccggcgacggcaggggcggcgctgcggcgcggctgcaacccggccggcggcggcgacgaactaaacgcgcgcggcgacgaggctacggggcactagagagctcgggagagggggcaaacgaaagaggaggactagggggtcctttatatagccataggaggccgggatcgagcccacatcgacgggaaaaactcgggaaagtttatcttcgccggaaaaaggaaaggatttgatccgcgaaattggaaaggatttccatataaaattttggggatttcttggggaaaaggaagaggagattgagaggattccattcccgcaaccaatttggaaataggagcaacggggaggtcggatttggtggaggaagcggcggctgcacaggtacaggacggcagctcgggctctgtccaggcttgaagatgaacagtgccagggaggcaaattagacttttggctgggcttctacttcttggcccgattgaaagagggacacaaagcagactttggaggagggataaggccagccgaaaggaagggagaatgggccgaggacagaagctgaacttttcctatttcggcccgaaaaggagaaggggattttaaatacttttccaattaaattaatcactgaaatgatctttgaattgttaaaaatacttccaatgctcaaataatttcaagaaaaatcctgaaaatacttggacacccaaagtatttaacaatattaaaaccagaccatttaatgattaatttaatatgtgggtaattactgaaatgctctttgtatgattaaaattaggaattgagctccgaaaaatccgagaaaatttcagagagttgacttaaccatggagaatttaacaaaaattaaatccatccatgctttatattagggaaattttatttcccacatttaacttcacttgtaaattaatgaacatttaatataaattctataaataatttattaaataatttataaatcctgaaacaaaaatcaggatgtgacaaactaccccccttacaaagaatctcgtcccgagattcggaacggctagaaagaaaaagggaataggtaaactgcagtctatcttattccataactccgataattattctaaggctttaaagaaaactactgctgctttgaaactggtggctgagttgtaacacttgaagacacaactctagaagacgcaactggcactgcattggctcctgtgacaacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgctcgatgttaacttcattgctttcattagtctctgatttgatctcaccaccgatgtttaactgttgcgactgtccttgaccagcgaaagaagattcaccaatttggagtggcttgatacgctgcctctggctactaccttgtgcctcctggaatacagtcattttccttttacggttgtccatcctgttcttcttgtcttcaagtcgaattgctttgtcaaccagctgctgaaaatcagcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgctttttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtgcactggagcagttccaacttcttctcaatagtgtgcaaccaatcacctgcttccactgggttggtagtgctagaaaaggtaggcggcctcacacgaagaaaatcagctaacttgttttgcggcggtggagcattattgttcccttggttgagctggttctgcatctgttgtatcatcatgttcattaactgagtctgttgagccagaacttgagcaagagttgggttcccttcattgttattgtttccacttccattagcacgagtgttcaccatctattgcatattagagaagatagaaggagagaggttacactaaagacaagaccttaaccaggttaacactgatctggtgtgtgtagaccattatattgttcaagttgattaagcaagcaacctagtataattacacactcatcattgaaccactccaatgacgggaatgcaaccatacctacacacaagcaagcaacaaacgttctaccctactaactattcttcaaggatagtttggcggcataggttctaaggtaggatccaaacttcattccatgttgacatctgggcacttcagttcttcctcgatccacttgactgacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatctaactccaaaccaggagctaagcaaattattaccagttataacatctatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcggtactggtaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgaactatcattaagccatcattaaataatagtgagtcataagttatcccaatagtatgctaatgtttctaagcatggctaagcaatcatatctaatatctagctgaaccaatatataaagctcaactagtcaaattataataacccaaggtatcaaggaatagagtaggattttcattttcctctatactccttaatcaacatgctgtaaaactttctgtaggtccgaactgcttttatttaacgagtcgtttcccttgtttccttagcatgtgatcccgagtacctttgtcattgtagatatgttgatgtcgaggatgtccagcagcgcgggcagcccgatacgccggtagtcgttccggcgctcacgcttgagccgcatgtgccggaggtggaaatcggtcaaagcccatccacggagacaaatatggcgatgacgtccttaggtttgtgtcttgattttcttcgctcctcgtgtttggattgacttaattagccgtgttctcgaaagagaagagtagcttgacttagtcctttccgtgttgggcagatttcaagaacgcgttggctaactgagatcgttgaatccagtattggaagacaaaactcgaggtggccgaactcgaaaggaccatcgtgggggcgaaggaccaggccgtggaaactctccgaggtcgcgaggtgtggtttaactcgtaccttaagagttgttgcacggccatggtagaagtttgcagggagctccgagttccccgcggagatcccgaggagtccgctgctggttatatctcgtggatgaagggggcctgcgcacagctcgaagggattggcaagcgcatcgacgaggccctgaagcaggagtgtcgtcgagcgagccgctacgccgggggacatgtgctggcttgcatccgagatcaccgcccgcctctgcacctcgagttccttcgcgaagggttctcttgttctcggaggacatccgcggagatcgacggtcttgcgcagtcgatggcgttgcttgccgagaaggttttctgctccatggattggcgttggccgtcctggtagcttttgtatcctgtagaaaaacatctcaagggagcatgtaatatactttgaagtattcatgacttgtaagaaatccttgtaaaataaaaatgaaatctatctaactaagttttcttacttttggtatattgtgtatgagtgttttctcattctacgacttcgatcagtcacttgagccatacactctccctagcccccagccttgtcgtcggagaattgttctcgggggataagactcttggacccttgacctgccttggttgaaaaagtgcagagcctagcccctagccgtgaagttagaaaactcaatttccgattacacggcttagttaatacgcacggtgagaactcttacatgaccagatcttacgtggtgatttgtctctgcataatctgacaaggccttatccgctctgggcgtccccagccgaagttcccttaggttcctcagaggccttgccaggacggcgtaaagggacatgaggatagatttcaactctaggtgtcgtagtggtaagggatcgttgggaaggaacactttgacgatattctttacctgaaatcaactttattgaaatcgtaagatatcttacaaatatggatactattgatttatacataaaatttacataattgatcaatgtttcaggagtttgctaactcgcgaccatcgccgtctgcactcttgaatgcgcccggccgcaagacttgcgtaatcgtgtatggtccttcccacttgggtgagagcttgttgcacccagcttggctttgaacccgtcggaggacgtaatcgctgatcgaaagtgtgcgtgctctgatgtgcttctcatgatatcgacgaagggcctactagtagccggctcctctgacggcaactctttctcgatgttcctcgagtagattcacatcgtcgcttcgctgctcctcctgctcctcgtcggagtacttctgtactcgtgtgctctgatgtcgtagctccgtggggagcatagcctctgagccatacacgaggtagaagggtgtctccttattggatgttgtcggtgtggtacgcacggcccatagaacagagggatgttcttcgacccacttcttgtcgtgtgacatgagtctgtcgtagacgcgggtcttgatcccttgtagcactatgccgtttgcccttttgacttgcccattgctctaggggtgagaaatcgaggcaaagcaaatcttgactcccaatccaatgcagtaatcctggaagtcggcactgatgaactgggagccgttatttgttatgatgcggtgaggcaatccgtatctgtagaatatccctttcataaacttgatggcattatcggccttgatttcccccgtgggcgtcgcttcaatccacttggtgaacttgtcgatggccacgaacaggaacttgtagccgccctgtcctcgtgggaatggtccgagtatatcgagcccccaacacgagaacggccaagtaagagggatagtctggagcacttgcgatggcagtcttgtgtgtttgctatgaaattgataggcttcacaccgctgcaccatgtcgcaggcgtttttgagcgcggtcggccaaaaaaaacccttgtcaaaaagcttttcctaccaacgtccgtccgccggcgtgtgacccgcagatcccttcatgtatgtccaggaggagatgtttgccgtcgtcagacgagatgcatttgagaagtactccgtttggcgcctttttgtacagatcattgccgatcatacaaatagatcttggcttgtcgggttatcttctcagcttctgcatcgtcctcgggcaactcgtcgctactctggaactcggtgagtggggtccgccagtcgtctgtggtctcgatatcggcaacgacgtgttccgcttctgtagcccccgagctgatgtcggggacaaccgtgctaccgtcgtcgcttgcctctttcaccgatggctttgtcaggatgtccagaaaagtgccaggttcgagtggctctcgtcgggacgcgcgccgtgctaggtagggatgaaactggttcggatagtttccgtccgtccggaccaattttcggatacggcaaaattcggtcggaactatccagaatttctcagattcggaaacgaatacgcataatttttctcggatacgaaaacgaataccgtaagggtgatattcaacggaaacggaaaacgatcggaaactatccggtaatttttcccggatatccagagaccttcatcagccattcatcagaatcagcccaaagagcccaacccagcctaactatgtgtgttatgcaaaccctagctcgctagcaacacagccaacaggcaacaggcagccgagccagccgactactcctattcccccgagtccccgacccccacgcatctcggccggcggccgccgccaccgcccacaggcgcctcgccccttcgccgctgctgccaccgcctcaccccttcgccaccgctgcctcacccattcgccgccgccaccgcctcacccctttgccaccgccgccgcctcaccccttcgccacagtcgctgcctcttcgtcggcgtcattgcatcggccctcttcgttggcgtcgtcgcgtcggccctcttcgtcggtgtcgtcgcgtcggccctcttcgccggtgtcgtcgcgtcggccctcttcgccggtgtcgtcgcgtcggccctcttcgccggtgtcgtcgcgtcggccctcttccgcctcttcgctggcgtcgtcacatcgccgtatcaccgccactaccggtctgccgcatcatcgtctcgccataggcccgtaagcaggttcgtcggatccacattcattttttgtgctcctcattcactgagccagtgagccctatatcagagtttgagacatcgagttgtgctgttgtggtgctccttattcatttgtttttttctttttgcatgtgtggtagatctgtgaatctgtgatgaattcctctcatgcaagtagcagcagcttcagcttgtgcagtgcgtgtgtgacagtcatcttgtgcaagtaatgtgtgtgacagtgtgactttgtcagtacgtgcaagtttgtggatgtttctcgttatggtattattaattattgatctttgcaaatgtaacatgctctattagaaaaaataacaagttatatttcttcgttgatttgtgaaggtcagtttgaggggcttttatgttcggattaatattcgttaccgtattcgtttcgattcgtattcgctccgtatctgtattcgataatattcgattctgttttcgtatccgggtttccgattccgatttcgattccgagaaaaaaaaatatgaaaacgaatatgataaaggtagtttccgaccgtatccggtccgttttcatccctagtaggtcgtctagttcgatgttgttcttacggtatacgtgtcggaccttgatcccatcaaacctcttctctagcttcctgacttctgcgaggtacttagataactcggggctagagcacttgtagtctttgtgcacctggttcgcgactagttctgaatcccctttcacgattagtcgcttgactccaagtgtggctgttgcttttatcccagcaagtagtccttcgtactcggctgtgttgttggtcgccctgaagttgaggtgaattgcatgcttgaactgatctctcgatggtgatgtcaagatgaaccctgccccttctccttggctgttgagtgcgccgttgaacgccattgtccatgtctcgctgtccgtttgactgtctgacctgttctcaggcatagtccagtcgattacaacatcagtgaggacctgggacttaatagctgttcgtggcacaaagtggacatcaaactggcttagctcgactacccatttcgcaatgcggccgacaacgtctttgtttctcacgacttctccaagggggaaggaggaaacaactatgactatgtgggcttgaaagtagtggcgtagctttcttgatgtcataattactgcataaagcagcttttgatctgtgggtatcttgtcttcgcatcgtggagagcttcgctgacgtagtaaaccttctctctcttgacaacaatgacattactcacagaatatggcgtggcagcgatatagaggaataattcttcattaggttggggagcaacaagtacagagggatttgacaggtagcgcttgagcgcgatgaacgcatcttcggcttcctgtgtccacacaaatttgtcttgtttcttcagcaggacaaagaaaggttgtcctcgctctcccatcctagcgacgaacctgctcagtgccgccatgcatccagttagcttctggatttccttgagtcttgtggacgacttcatgttctcgatcgccttgatcttctcgggatttgcttcgatccctctttcggagacgaggaatccgaggagcttgcccgatggtactccgaatgtgcacttctctgggttgagcatgaggcgatatcgtcggaggttgtcgaacgtttcccggaggtcatcgatcaatgagtcgcttgtctttgtcttgacaacaatgtcgtcgacgtaggcctcgacattgtgtccgagctggtcattaagtgccccttgaaccgtgcgctggaaagtgtttcctgcggttattagtccaaacggcatcttgacatagcagaatacacagaacggcgtgatgaatgctgtcttctcctcgtcctcttttgccatgctgatctggtggtagccggagtaagcgtcaagaaagcttaacaactcacagctggccgttaagtccaccaattggtctattcgaggaagagggaagtgatccttgggacacgccttgttgagatcggtgaagtcgacacacatcctccacttcttgttggctttgcgcaccatgactgggttggctaaccactctgggtggagaacttatctgatgaagccagctttgagaagcttgtcgagttcttctcatatggcttgtttccgatccggtgcaaatcaccgcagtttttgttttactggtttggcatcgggtcgcaccatgagtttgtgctcgatcacctccctagggactcccggcatgtcggacggctgctaagcaaacacgtctgcattgtcgcagaggaaggtgatgagcgcgagttcctatttctcatccagtgacgccccgatcttgacggtcttgtcggggttggcactggagagcgggacgatcttgattgcaccgtctggcttcggcgtcttgttggttttgctcactttcttgggcggctcagctatggcaggtgggttgggagtgtgctcgaccatgtcgaggctccgcttgtcgcactgcaccgccagtttcgcgtttccctgaatagtgattgttcccttcggtctaggcatcttgagcacttgatacgcgtagtgagatacggccatgaacttcacaagtgcagtcctcccgatgatggcattatatgctgtgtcaaacttagcgaaatcaaaggtgtgaaagtgcattaattcccctagtggtttttggtgattaatgacaaatgtggttaagggtctaatgagtttattgagctactttcaggtgcattagtccaaggcgtggaagaagatgtcgtcacctagccgttatacatatacaactcgtttccagctcgttgttagcctctcccaagtgtttcttgccttctccactcaatctagagcctaattcttgtgagaaagagagattgagagggagagaagaagatttggagaggtgtgaagactaggaacttgggtgagcacttggaatatctcgtgggctgtcatctcggtgcttattactcttggagatgatctcctagacggttaggtgtcgcccgtgacaattcgttgcatattgtggatgtcccgggtaagtttgtgaaggatctcctctcctccgaaagggaacgaggtaagttaatgaagttcttatgctgagattctagaggttttccaagtagagcaacctacacttgtggtggatttctagaagtaggttgagttggatcttggtggtcactcaattctagaaatttgtctaggagtgtttggggttgaaggctgtggatttcctctggggtttttgcacatgtgaggcaaggggttaatcgagacccagctttttggagctcctcaacggagagtaggatcgcaagatccgaacttcgagaaaaaatcgctcttatctctttctgtgatatttctgtggatgattctgtgatctatcctctgcttaaaatacctgtgcaccttcttgtgaagattggcttagtctcctgttttgaaatttgaatttcatctctgttctgttaccaggaagttcctgtcctagaacaccggaagttccgggcctggctggccggaagttccggagttccttactaggaagttccgggtctatttgaattttaccgccgcgatttgtttttaagttttcagggacagcctattcaccgcccccctctaggcttcatcagcgcgttcaaggtgatctgttcggaagttgtttacttggccgaaagtcatgggtagcgtgatcttgcccaatggcttggacgacgactcaggagtgattccatgaaagggttgatcagtgggtgtcaactcgcttcgtgggatccccatcgcgtccaaggtgctagcgaagagtaagttgatggagctgccgccatcgatgagaacccgtgcgaccttgatatcctgaatagtgggctcaaccacgatcggatatcgccctggagtaacggcagtcttggggtggtctgcttctgagaactcgatcttctgctctgaccacttcatcttggacgcagccccctgccatgtcgaacaaacttcgcgctccactttcttgtactctcgctttgaggagtacgccgtggaacctccgaagatgtgcgaaacatggagaccggagtctgggtacgctgagtctgagtcctgagtagtcgcttcggcggccttctcgactacacgtactcgcttgcatttctccaacgccagttgcttcgtgagtgcctttttaagatgaaataagtctccagagagtgcttgtccgtcttgtatatagggcaccatattttcttcgtgtcgtcgccttgtgggtttgggtgcttgggcgggtcaacgtgttctgctatgagaacctccgtttgcgctttctgtttcccactcctgcgaatctttttcttgcttgactcaggcgtgtccttggctggtttcttctcctctcctgtcttcgacttgtcgttcttgcgtctcagagcgtcgtccgcgtgagcgcatcaattgacaatctcgaataacttgcaagcagttgtgatatgccttgttgccaattcctgggttgtgtagcgatctcggacgctagacttgaaaacgcggattacagaagcatcggtgatctcggggatcgtatttctgcactcattaaatggttgaatatagtccctcaatgattcgcccggattttgcgttagcgcgtgtaggtcgtccttgatcgcgtggcgcttgtatgttccttggaagttagcgacgaactgttgccacagatctgcccacgaagaaattgagtagggcgggaggtgaaccagccatgaacgtgcagatcccttcaacgcaaccggcaaataattcgtcaatgcgttgtcgtctgctccggcagcatagagtactgtagaatagacctgaagaaattcttcagggtcggtgcttccatcgtatttctctattgctcccggtcgaaacttctcaggccatcgaacatctcacaaagtacgagtgaaagccttgcacccaccgccaggggcagtaggttgtcggcgatcatatgctcatcgtggatgtctgtccgatgatgaagatgacgaagatgacaatgatgatgatgagtcacttggttccggggcgcgatttcgagtatgatgctcgggttcttgcaagcctcatcgtcgcccatagttgttgtcccggcgtcgatctccgtcgtcgtcattgtcacggcgtcgacctcaactggtatcgcgcggcacccgctgctcgcgtttagtatgttcgcggcggttgtggcgatcatcacggtctcggttctcgctcggacgtcctccttgttcttcgttctcgcgatgtcgtgaagagacacgatgttgggaacggttttcgttatcttgagtgagtcgcgcttctcggcggccatttagatggtcacggagatcactggtgccgcgaggtggaggggtagcttgacgaggtggcgtccactgatcaggctgttccccattagcgccgccggtcggcggttgttctggtggtgccctggcggcggcctctgcgaacgcgttattgaagttagccactgattcccgtagtcattctgcccattgatcaagatcagtgttcaggacgggatcgaaagggctttcgttcaatatcgcattgagggttctgatatgttgggccggtgtcggtgtaaccgattgatccgccgttcccgtgtggccgcctccagatgtgttggttccatcgatagcatacacgtcgcgtggtgtacttgtcgatgatgaggcctggacttcgagcagatgtaggacagatggctcatagggatcgatatcgattaccctgacgaatcgatctgatgtagtcgccgcaccttgttccttgtcctcatctctaggagagattcgtgaccgctggaccttagggggtgacgtcttaatggcgctgagaaggaccttgcagctggagaggtcgtgagtctttgccttgtggatgggacaatagacatcatgagttggagaagtacgttgaattccacgctctttgcaggcacggacttcagcttgtacgttgaggaaaaccgaacaagcttgcaaggtgtgcttgctagtcctgtggatgggacaccaagcttttgtcgccccggaagttgtccttgtcggctcgtacttcttgtgggaaggataagatttgaccacattaggatctttctcaggcttggatgttgtcgattctccgttctccacttctgcgggaggatcttttgacatggagtcaaccggggtcgtaaccacgccgttctcgctcccgataattgctgggccagtcgagattggcattgtggtgtagagcgggaagacgatttcgccgacttgagtccacaccagcatcgtcgaagttgaagctccttggttgatgccagtgttgacgctatcgtcgagaaggcttgaaatcataatagtagaaccttgagcaccaagttcccctacctgatgcgccactgtcgacaagggatacccgtagaccggatataaagggtattggggtccgttggtacgaggatcgacgtagtacgacatcaagcaaataaaagataaggattatactggttcaggctccttggtaggtaatagccctaatccatttgatatgagattatatgatggaaaccacaaattacaaagggaatagcagaactcgatgataccgacgagaccgtagtcaagttggtccgactagatctcccgacgacttggctcctgcacgctccggctccgtaggctatggtgggtgtattggcggtgatattcgatgtcttaggtcctacccagggggtcccttatataccgcgggtcagttgatctccaagtaggactcagagatatcgtacccctcacgatacagtaaagacccagtcttgtctgagtagaactccttccatccgtagataccatccctatcacgtgatagattttcttaatgtatacggaatctatccgtatacgcgcgggtataccgtatcagtgtacaacgcacatccaatgatagagggtataccttatccgtaaccctgatagtagctcccgacttctgcttaaatgagttcatgttaccgatcgcggcttctgatgtcggaattgttgtcactctcatctagtcgatctcgctttcaaaaatggattaatctgatttttttaagtaactttcgtatagaaattttttacaaaaaaatacaccgtttagcagtttgaaaagcgtgcgcgcggaagacgaggaggaggagttgggaacctgcccaaacgaacagagcattagagagttattctaatatgcaactctgcatggtagacaagttcatatataggagttgctgtgcataattaaatttgcataacgaaacaaacacagctggcaatggtggcatcatcactgacagtaagcaaatgcatgctgcagtttagcaccaagttagtgataaatcgagcttaattagcactagtgtgcgcatcttggtgcaccgaaaggttaggtcactgcagtcgcttgcttccccaaggagtgactgagtgagccagtgacccagtgacccacacgatatatgttggagtcggaccaaaacattcctccagatgtcggtgcttttatagagactcttctcccttttttttatcgcaccacaatttaattaacaacaataaatataattaatatgagtcttttatgacttatgaggtataaaaaaaaaactctgttgagtttttattagcttgataattctcatatctccctctccctatctctctccgaggggtaaaatttacaccgaacttagataatatctctctaaaatggaattaccagcatagtattaaaattaaaaaaacaattattatctaaacatttctaatcatctaaaatgtggtcaacttatcagataattactccctcaacctagcttgaaacagattattggccaaattataagtggattattaactacactattttagaaatagactaaatattttgataaataaatgtaactgatagcttctaagacatctaaataaaacagtggaaggaagttttataaggaaacatggaaaaaataatctgtgacaataatttggtgaagcaggtgaaaataataatgcaatataatgttgacataaacccaatgtttgactactcatcttattaaaaaatcagtgtaaatatgcaaaatatatgagtgataattttagtaataaaagaagtcacaaaaaaataatgtaaataatatttttaacattacaaatagtcaaatggcatgctaaaaatcaacagtaattacaatttttaaaaagaggtagtagcattatgagaaaatcccgtctccaaacaggcaaacatgggttggccacctctttgtcgaccagctagaatttcctttccgtaaaagccataaatcattataaactccgtggcttgcatctttgtgatatgatgcatctcttcttctttatccttttaaaaaaaagggcttagaaaagtttattaagcattattgtctggtatataggggcattcaaattatgtcttggtcagctgtattgtgttgaccacttcaccagaatgtgataaaataaacaatggacttgccaaaaaaaagtttgactggtccaaaataagtacggaatatttgatatataagggcattcaactgcgtacagaccaaacttccccaataaacaactcaaaaagatgcttatagtattagcaattgtctgctctctatgcattttgcagttatacttggtatttgcaattttgtattttgtcccccacttccccagaaattgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaataatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaaggcacaaaccgcgtctccctctccctctctccgcccatccatcctcctagagagggagcgcgcgcaaggaggaggaacaagggctcctcggatcgggaccagctgaggtgagcgctcgatcatctcccgttttctctcctcggatctgaccatctttcttgcctttgttttctttcttttttcttttcttcttcttcttttcccctacctgttcttggtcgatcggggatttcgctgccgtgaggctgacccttcttgtggtgcggtggtggcagtgggtaggatggctgcttgatccccttgattttagtattttattttatttttcagattagatgcgtagtgtagctcgtacctcgcattgcccgcccaatgcgtgttcttcgttttctttaatttggataatatatggcactgaatttatcaagtttaaaaaaatgtcatcgtattttgcttaactttgtcaccatcaagtacacctagaacgaaaatttccaaaattagacggaacattccgaaatatcgtattatagaagttgccctcgcgtatcttccccctttcccttggcgtaaaagaaaatctccggtgtcgtctcctccgctccttgttcccaagacgagtcgcggctgaacaggggaggggaggggatcctggtgagcatccacatcctctttctgattcatctctgtcccaccgggagtacttttgtctagaatttgcttgcgttccttctcttctagatctggaagaagctcttctcttgttaattttacagagagccttaaccttaataccagtaacagtttgtttgttcccccaaaaagtttggggattcaacgagttgtgagtttctggaattggagggacagaggattggcatgttgattcttggtccgagcatgtttaccaattggcaggaaccggcatgcggttcagcactgaactgtagcaggagatgagtttcttgcctggatctggagccatcatcagtgaagaaaaggaagatttcttcaagaattcaatcacaagtgaggtttatgcggttccactgttgacagggatagggataatgccgcatgatgggtcgttttcagtacagagtgcacactgatgaacgctgtgggttccattgttccacctatggaaattccacggtcgaggcagagagaaaatggctcatgtgtggtgactggtggttctgttccactatgttttttgttctgactttttcccctcatctgaagctcgtgttaaggtcatatatggtttggtagtcctaattgtcatgtattaatggccagatggattggtagagtagtatgtttgaatttcctatgttctaatagctgaatttgttaacttggacttagatgtagctacaaattatggcctagaacagctatatcattatttcccgacctgacagaggaatctagagcttggctgcagatttagttgaatagtgtgatagtatctctgtgttttttgttcattgcagtgatgtatttagtgtttcagtatgagctatcattgattacaaatttacaatataacatatttgaagcgtttggacaatgtgatgacgaggatatatttgacaaatttacaatatgctgatgtacttgtgtttcagtatgtgctggtaacagaaaaggcataatcctatcacttgttcactgccatgggagctgatatacaatgattttttcctattgatggaaaataatatgatgctccagatttatgttagaataagatgcttctctatttattaaaaaaatggaaatataactaggcaaagccatgtaatgaagaagatatggatgtttgtcaatattcatgcacattgtgtttgcataatgaaccaaaccatttttagaataatctcatttaacatatgttattgattggcaggtgcatgcttgaaaaatgtgaatgtgtgtaacattagtgtttttgtatgttttaggttggataggtattttaatgaaccattgtaatagtatgacaggtccatgccctttaatgtcatgtaatattcgtacagtagaggataattgtttgtttccagtattcagaagtgttgattcaactatttgtccattattaaaggtctactgtaatttagaagtggacttatttttgctttcttggtaaaaacttgaatgataatttccttgagtaagatcaagacgtatggagcttgctactgatgatatctagactaagacggtataatttagtaaaactgttactgttattattggcgatgtttcagtttagctttaggtaatcaacacatgtgcatatcatatttctttaagatgtatctcgccaagcataatttttcagtggcaacttgcaattgagttcttgttgagttgacctattaatttattatcgcgccatataggcatatgtgtgttgaattgaatgcttgaagccttgaagcatgttattttcataatgcaatctttctagctagtatgtactatgtagtactagtttgagaatatatgtgtttcctcatcttttttattttatttttctattggacaggatttgaacaagtcagcttgtcgccaccatggttcttgattcattatcatctcctcacaggaggtcacagaacacattttttctatcatccccaaag

SEQ ID NO: 71697 - DNA, 9330 bp, Oryza sativa
cctgcagcctttttctaataactctataattaaaaatatgttaacaacagcttaattaacatcgactcttagtgtttattaaattgaagtttgatgcatgaggaaggataaagaagagaaaggtaacagaaaaattgctagagcatctgtcgtctcaactcttatatgagggtaatctctttgtagactaaaagtatatatcagcttatcttaataaatactagcaatggaaatagaatccgacacataaatatcttaataggtgaaagcagcaagcctctcaaacagcgatatgcctcgtcatctgaaatatcagggacctttaggagatgggagttgaaacagagatggaccgttggatcatttggagtggagtccaaccaggaggcttccagaccaggtcccaatgcagattactaataaagaaataagggagcgtagcagagtaatgcctaaagcaggggattaaaaaaatctcatcagatgtttttttcagctttatcactttaataatcaatctatttacatctatacatgtacaatacaataggctacaagtaacaagttcttcgtataaacgtccaaaaaataccattcaaattatgatagactttgcaagctatatatgttataaatattgttagtattctctctaggatcacctaggtttagatctagtcgggttggttctatttgattgaatgattgaacaataatagagattaagggaaaacggtttagggatgtgaccggttgacgttggatgaggagaaagtgccggccatcgtcgttgtcgtcgctcggcttgacgaggacggcggcgacggtggtcgtagtagtagaagtcataggcaacgatgaggcgtggcgcggcggtggtgtcttcccatcactggctgcaccccctctcgatcggattatggtttgtgggtgtagttggcgccggcaacgaacctcatgtcgtgcgccgctctagcctccatccctctttatatggcgcatggtgacggggcccaccagccattgggctaggtgcccctgatcagggcgtgggtccccttgagcccaacggctcaaagggagggagatcaatctaacattctcccccttgatctcactatttcttttagcctttttctattccatcacagatttgcacatagagcatgtttcatcgtcacggtcaatcaccaatggattcgacatccactatacacatctctattcaaatatagatactttaacttttgggccctgtagtccaggattcataaggcttcccttaaacccatgccgactacatgtttcttgaacacgttgagtgataggcctttcgtgagcggatccgcgagcatcctttctgttctaatgtgctcgagactaattgtttgatcccagactttgtccttcacaacatagtactttatgtcaatctgtttggcagcaccacttgactgattgttgtgagcgtacaaaactgcgggttcgttatcgcagtataactttagtggtttctcaatactatcaaccacctttaaaccgggtatgaacttctttagccagttcacctgcctagtggcctcatagcatgctataaacttggcatacatagtagaccctgcagtgataatctgttttgagctttttcatgaaatagctcctcctgccagggtgaacacgtatcccgatgttgactttgtattatcttttgcaaagtcagaatcagaataccccactatctggagcgattctgatcttctgtaagacagcttgaggcctttagttccttgcaaatagcgcaagactttctttaccaatttccagtgctctgagcctagattactctgaaatctaccaagtaacctggtaccaaatgctaaatcagggcgtgtgcacacttgcgcgtactgtaggcttcccacggctgacgcatatggttttgttttcatttcattgagctcatactgatttgtgggacattgtcatgccccatacttttccgctttgactataagagcaggtgaagcactgcatctgtacatgttgaatttcttcaacaccttttctatatatgtcttttgataaagtcccaatgcatactttgttctatctcagtgaatctgtatgcccaaaacatatgaagcctcaccgaggtctttcatgtcaaagtttgaggacaaggatttctttgtttcctgcagtggactgacatcactactagatggtagaatgtcatccacatacagaattaggaaaatgaatattccattcttaaattttgaataaatacagttgtcctcgacattctcttgaaacccaaatttctttatagtcccatcaaacttcaagtaccactgtctcgaagcttgctttaatccataaatggatctctttagacggcatcccatatttttgttccctttcatgacaaaaccttttgtttgtgccatgtatactttttcctctaaatctccatttagaaatgccgtttttacatccatctgatgtaattccaaatcataatgtgccaccagtgccattattatcctgaaggaatctttacaatagactagagaaaatgtctcattgtaatcaatcctttctcgttgcgtgaagccttttgccacaagtcgcgccttcaaattttctatattccctctggagtcatatttggttttgtagactcatttacaacctactgttttggctcctttaggaatttctttcaaatcccaaacatcgtttagtttcattatttcatttcatcttacattgcttccaaccattcagatgagcgagcgcttctcatggcctcttcatatgaggtgggatcagcctccatatgcgactcttctatactataaacttgatagtcatcacgaatagccgatcttctaactctttcagaccttctaggggcctgctgttccggcacattatctgtttgaggctgttgcagctcctcctctggtgtggcaataatttcggttgaatcctgtagaacaggttcctcactttcattcattgttgccacaggagaggtaacaacaggtgttggtaccgcaacgtcatgcattgcaggcacaacatcagcaagtagagagaagaaaggctcttgaatcgacggagcaggtacagacaccccctctcctcaagatcaatttctcgaacaaccgagctccccctaatcatttcgtcttccaagaagacagcgtgtctcgtttctacaaactttgtataaatgtttggacagtagaaatcataaccctttgatcttttaggatagccaaaaaaatggcaacttattgtcttgggatctaatttcccaaggtttgggttaaatactttagcctctgcaggactcccccacactcggaggtgagctagtgagggtactcttcctatccatagctcatacggtgttttgggcaccgatttgcttggaacgctgttgagtatgtattgttgtaaatctgagaactccaatggaggaagaattacactcttaactagtctctcaattctccccctcgaaatatggcctaaacgacagtgccataatttcgatgagacatcaggagttcgctttcttttcttgttttcttatatcaacgaggacacaacattcacattcttagaaagagataacaaataaagctcgccgacgatgatctcgtatacaagccaacacatgccccccggcatatcggctcgaccgacgacactcctgcttcaaggcttcgtcgatacgttgaccgatgccttcgagctgggtgctagcgccattcagccacgagatatatccggccgccgattcctcgggatccccgcggggtactcggagctctttacagactctcgacatggatgtgcagcaactcttcagatacgagttgaaccacacctcacgaccccggagtgtctctacggcctggtcctttctcacttccagcatagtcctcttgagttccgcgacctcaaacttcgtcctccagtactggatgcgatgatcctggtcagcaagtgcactctcgagatctgctcagcatggaaacgactaagtcaagttgctcttctctcccgagaacacaacaaatcaagtcgatccagacggaagggcaaaggaaatgataacaaagacaaccaacctaagggagtcgtcgccatgctcgtttcgatgggcgaattttgagctacatcgccctccggcacatgtggctcgaacgcaagtaatggaacgactaccggcaactcagactgcccgtgctactggacatcctcgacatcaacatctctacaaacgacaacaaagttctcaagatcaaaatgctgaaaacgctaaggtgatgactgcgcacacaaaggcggttggaaccaataaaagttttacaaagcatggccaaagagtacaagagagctaagaccctactcttcaaaaagagggaggacggactctcccaggtcaccgacctcctccatctcgtccttgcgcacatcgctggccgccccctgatccaagatcttctgcagatcgagttcaggatgccagcctcacacacgcaaggacatggcacgccccggtatagatcccgttggacgtctcctctccgaccctggccgcgtgtttggaggggatcgcctccatcgccgctgccagctcctcaagtgaggacgtcaacgagaactcgtcggggttcgccgggatggtggccttgacgccgtattccccggcgagctggtgcaggccggtgtaggtgacacgcagggagccgcggatctccgacaagcggttctcgagctctgacatacggtgctcgagcccctgccgttgtcgctcattgccagccaccagctcctgcatcttctggaggtcctcgcaaacctccgctaagtcgcgcgccagccggtcggcgcgctcattcgccgacgacgctgccgccgcccttgcctccgcgagcactagcctcgagaaggcgccccatctcgacctggagctcctcccaggtgagaacggcagctggcgaaccccgaccagcggcaagatcgctgattgggccgctaggtgtcgcctcgcgactcctgggcacgaccacgacatccgtcgaggccatggcaggagacgcgctggaggtccctccagacccgtcttgcgccaccttcgcccgtgccgccctgcgaaaagatggaactgagacaggctgcaacagtttgatgaagtgacaagatctcaaaatcatccacttacttctcgctaagcatcactagccgctgccgtcgcggaggtggaggagacgcgtccgaggcctagagtacaaccgatgcgatgtgaggtgcaaatctttcgactacgtaataaaagaacagggaaacttaccgagggggtgggtgtcttccgacgatgtccgaccatagaggagaatttcctcccctttttcggaacattgccgccactcgttgtggcagcggcagcagcagcgtcagacgcctccttggcaactttctccttcagcaacgccgccacctgatggtccacgagcggcccgatgatatcagtcagagggagagcctacgtgtcatgaagtcacaatgcaatcccggaagaaaaaaggaaaaggaccgctgagtacacttacattgatggcagcatcacgctcggccgcccccttctcgcaaagggggacggggacgttgctcgccgttgtcgggccactgatcaccagttgactgacgcggcgctccacggttgcactgtccaagcctgtagatccagaccagaatccaataagtcgggaagaacacgcgcataagggggtcaatttaactaaaaaggaaaataccccgaggagaaacccgggtcgcgtcctccggcctagaataatcaaaggctggatgggctcgagcgtgaagcggctgaatccacctaccaatgaagtcggcagtgacttcataccccgacaacccctgttctcgaaggtcattaatgacatcgatgaaagactgaagggaggagatcaaagcgggtttggtggtccaggatggaatcttgtttggttgttcttcaggaacaatgaagaccggatccgaatcctctatctgaagatagaaccacctcccccgccatttgctgcaagatgaggggcactggaaggggatgtatcgtgacttcaggccatcccgatgtcagaaaccaacacacccggacacttttttaggttctatctagcgcaactcatagtagaagcggaaaaggtcaagaaacggctctaccccaatgtaggcctcacacagatgagaaaagatactcagaaaggcgatggaattggggttcaaatggagcaaggaaagaccatagaaattcaacaccaatagaataaatttagacggcggaggaagaaaaccacagagaacaaagtcctcgatcgcaaccatgcgacccaggacaggctggggttcagtacctcctacttctctttctgtggtcccgcgaccgggaagggcgccatcctcctgcagtttcttcagtgacgcactggtggaggttgacttaccgccggggatcgccggagaaaggatcgagatgagctagctagggtttttgcgggagcaaagaagacgagggatgcttggaagctggagagttccttcaacaggcggacttcaaatgggatccccaaaactcccttaaatagacgtacttccgacggtgcgaattccaaggaaaggagagagatggccgccgaaaatttcggggtccattatgcgcgacagtttttcggacttcaatttaaattcactcatgaccgttgagcttcacccgacgttgtcgatcactccttgtctctcggtttccacatcgagaacgatgacaacatcagaagtcgcgatcggtctcacaagatcatttaagtagaagtcgggggctactgtccgagttacaggtaaggtataccctccacccttcgatatacgtcacattttgatatagtatgtttgcgcatatacggacgttctcagcaaaagttaagaaagtccagcatggagtctacagatggaaagagtcctactcggatagaactgggtcatcattgtatcgtgtcgggtccgatgtctccgagtccaacctggagaccagttgacctgcggtataaaagggaccccccgggaggacctaaggcattgaatctcagagccaacacatccactacagcctacgaagccagagcttacaggagcagaattgccgggtgatctagttgaatcaactcgattacgatctcgtcggtatcatcgagttccactatttcctttgtaatctgtggtttccatcatataatcccatatcaactggattagggctattacctattaaggggcctgaaccagtataatttttgttttctgcttgctcgatgtcgtattacgtagatgctcgtaccagcgtaccccaataccctctatatctggtctacgggtatcccccgtcgacagggggtttctaaaatatgtggcttttttgttgcactggaatatttcagttcactgcaacattagatcgatgcatagtgaaacattgtgagtaatctaggtgaaacctttttggtggaacaaaaaataaaccaaattcatttaatagagggtttccaaaatatgtgggtgatttgttgcaacaatacgtttcataatataaaaatccactgcgacatttgattcgtacatagtgaaacatcatgagtacactagctgaaacgttgtaaaactactggttgaaacatcagaagagaccacatgcaacattaaaaaaatcaataaaaaactaatgtgtggtcttgttgtaaagatttaattgtaacgaatttagtggtacaattagatcgtaaattagataaatagtttacgagaaaaaatcttttgaagaaataagagaggggggcatgtaataaaagattcgttgcatgtctgcatgcagtggcaggggacaaaacctgcgtccgatttttctccaccccgctggtcgccggggtgtgagcattttcggtataatcatgtaaaaccggtaaaaaatatttttttcaatatttttgtgacttctatgtgtgaaagactgagggtggtagaatgagaaggccctatagcatcttatactttggtttttgcccaattaattattgtggtaacataacagacttgccaataatttgtacccatgctgccagtcttagaaatctcggtagatgtgcccgttatatataaatctacaacggcaattttgctccatgtgatcaaaacttatttttccatacggttgggctactcatttgccccaacatatatatgcaaggagatgaggggaggccatcaatggcagtggttcaccagagattgaattcgatgattaaaggctgaatcaagaagggtaaatatgggggaattgatgatgaggaggagagagaatgattttttattcaattcggagtgtaatcatccggggagggaggtcggcgtgccggcgacggtagggtttggtcgggagggagaagaacggcggacttgaggtaggggacgcgcctggcacgtgggccccatctgccagcgcgtgaggggaaggggatgggaaggtggccggtcaactagaccaggacaggccgagggggagaggggagagatgggccgacagctggagatggcccaagagggagggagagaaagaggaggaggtgggtggacaaatacagacttcgctcatcggctggggagaggaggactttgggccgaaaatgttatggcccaaagagaaggagagaattattttatgtttttcatgttaatataaactctgatattggttgttgttgtattaaaattatttttgttgctctgaaaattcaaataaaaatttagggaccaatttagagcatggagaattcaagaaaaatactccaagccagatttcaattcttcttgatgtattttaccttttaataatttatattattccttttaattgggataagtccattttacactgtcgaactctttgctttgtctaaagtgcacacccaaactctaaaaccgggtaaatgatgtttaatttaccccttccattcaaacaagggtggtttttcttaaattatgctgacgtggtgatccaatcaggcaaaaaaattaaaaacaaataattggtaccacatgtcagatgccacctatctcctacccaatatctcttccttttcactctcttctctccttccactacgagaacggtgctggcgataagatcgagttctacctcctcgtctcccccctcagtgccggcgagctccccgtcccccg

SEQ ID NO: 71698 - DNA, 8723 bp, Oryza sativa
tgtggatcgttggtatcagggtatatgcgagattaagataaaagagatggagacaaggatttctatataggttcgagccccttatctgacaggtaatagccctactcctgttggccgaaaccggtgttgcttttattcatcataatcacaccaatacattaaattgggataacttatctagctgtcatcaacttggcggcatggataaccaactcgtagtggacgacatggtagtcttccctcgaatccgcactcggcgaaatcagagatagcgctagatccctcttgttggcctccgcagacaccatattgtgtttgtctagacttatctctgatatcgatatccagcgacttatcttggcgtgtgttggcttctattgatctatgttgatctgtatgtcttttggcttgtcccctctcctcctaggggggcttgtatttatacccatacatgcccccttgtccaagtagaactagagagaccaatatggatacaatccgagtagtccttgtcgtttccatgtagaactctatttgtccttccttatccataactccttctatatacgaggtttgtttccgtataaaacatgttatgtggtgggccttgccgagcttagtcaattagtgttaggtatatagtatccataaccctgacagtagctcctgacttcaatgcaaatgaacgagttcatgtcctgaaccgaagactttggaataactattgtcgtgctcacctgaccattctcggtgagatcagagatatcgctatattccccttatcgacctccacaggcactatattgggtttgtctaggtcccaatgcctactcagaaggtatggagtttgcgactaagtcccccatcttgctataatcgagaatttggattgaagtcaagaaattccatctcggcgggtacaccatcgcttcattccatattctttgttgagctccatcaaccgttctcgagtaatcgagtgggcatagagactgcgacaaagccttgaaatctgactagactgttataatgtctgactttcagaaatttacgtagatgctaagacgaccaccacattgggcaatggccaggtgtatagttgtagtcaacaaatcacagaagtagtgagagaatcactacaccgcaggtcgaagaccagttatagtcataactcgaccacttgaagtggaggtacgagagattgctacgacctacgagttcgagaaccaggagtaggagtctctcaaccgtttgaaattgaggtgcgaggaccgcaacgtagtaggtcgaagaccagtcgtagtcgtacatggaccattagaagccgtggtgtggagatcgctacgttgctggtcgaagaccagtcgtagtcgtacctcgacaattagaagtcgtggtgcgaggatcgctacgtttctggtcaaagaccagtcgtagtcgtacctcgaccattagaagtcctggtgtgaggatctctacgtttctggtcgaagaccagtcgtagtcgtatctcaaccattagaagtcgtggtaggaggatcgctacgttgttggtcgaggaccagtcgtagtcgtacctcgaccattagaagtcgtggtgcgaggatgtcatgtcctgataaattcatcttgaaaaaaaaaatcattctctaaaaggaataatagaattaattaaaattcgaaaaaaattggttaacattaaaatgcgtacaagaaaaattcgaatgtggcccggagaatttttgtttaattccccttggtctaaaatgagccctcaaattttacttgaattttcagagcaccaaaaaaaattattaagcaacaacaaccattataagagtttattaaaaagaaaacctgaaaataatcctcctttgggccaagcctggtccaaagtctccctctctccctcagcccgctgtcgaagtctctcttccatccctctccttttcctcccttctctctcgggccgcccctccctcctctccccctcccggcctgcctcggcccagccgccctctcccgtggccgcctccctcacgcgcccctcacgcgcgttgcacgcgcgctgaccgcaccccacgtgggtcccacccgcgccggtcgtctccttcctcccgcccggctcctctctctctcctgtgaaaccctatccgtttcctccctcaaatccacgcgattcaagcattggattccaaaattgattggggggaattaatcccccttccatcctctttgatttcccccaatttcccccttgaatggcaccctccattgcccggaacgcccgcgccattcctggccaccttccatggccgccgggcgccatttccgccaccgttccacgcctctcccgtggcccgttcattcccctctgctataaaatggaaccctctccttccgttctctcgttttagcctcctcccgtgtctccccgtggccgcagcacctctccccgtcgccctcatctctctcctgtgccgccggccacctccagccgcctctgccgcctcgcccacgtgccggccggccgtgccatcaccatcctcggcgcctcagctgcatcctcttcccccggcgttgcctccgtttcgcgcggatatcaccggaggcgcatcctcgccggcaaacagtggcgttgccgccactgtaccgcctccagtcgtcccggtcgccgcgccaaagcgccggccgacgtcgccgtctccttcgtcgacgtcgtagcatcaccctccgccccggccgctcctcggtttcgtccgaccggaaataacccaacgggtgttccttacgtgagtgtattattccttgtcccaggagacaaggtacacaaaaagttgatacatttcggagtttatcaagcggaagcgtaaatagttactttattacatgggcggcgaaggcccagcacacacaaagacaaacgggaaacagcgtaaatagttactttattacatgggcgacgaccacaggcgcttgacggcaggcacgagctaaacaccaaagccttcatcatccaggcgctcctcttctgggtttgggaaaaattgagcaagactgattacaaccacagtacccaacaagacacacccataagtgcagaataaatgcaagggagtacaagggggttataatacaaagggttagggtttgcagtaaacagcattaaaagacacttagttgctcaaagctattttgtaaacacgatcctagagctatacaatactattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttcaagaactaaaacactaacataggtacattgctcggcttgcccataaccgagggcgcggctattcgaataggttatactctgatcagaggtgtacatctttacccacaagacacatcttcctcacgtgtaaccacgtgccacataccaccacggcatacagacggaagacatgacatagtttccaacccatcctagccatagacaaaagtaccgacccaaccccacctacggccggaacccccgtgtcacaccctaaaaatcctaaatgtataaattgttgtttaattggaatttttagaaatgattttaaaagtctagaacagaagatctaattttaattaataaattccaatataaaatggggccagataaaatttcattaaatactttgctttattctataattcctagatttttctgggatttatttgagctaaggaagtatttttaataaatggaattgcatttaatgaataatttaaattgaaaaatgtttttaaaagtctcttttggctttgggccgaaagtcggcccaaaaccttctctctctctcttcccggcccaagtcggcccagtccagtccgcagccgcgcgcgcgcgctcgctgtcgctgacaggtgggtcccacctgtcagtcttcgtcttcctcgcgccgccgccgccgcccgaaaccctagcgtgcgccgccgctgtctctttccaaattcggccgcgtctttccttctccggtgaaatcaatagaggggaaatgtttcccgagatctcctctaccttttctcttttggaatcatcggctaaaatcgcttggaaagtgtttgattcgaggtcgattcggatcggtctctctctctccgagcccgagtgacggagcgtggggctcctcaccgggagaccgtgcaggtccccctttgccggttcggccgggggccatgggtgagattctaagctcccagtctgtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggatccgaaaaatcccccttctaagtgggcaaggtcctccttttatacctcaaggggataccacatgcaccatctctctcttttttgtggggacttatcctatcttttcataaacagacggagacttgtatggttaccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatatggttaggtgagccccgctatgctcacctaccccatatacgcggcgcaaaacctacaaggggtcggggcgcctcggccctctgggccgagacgggagcggtccgacccctcggggagacaaagagaagggcggccgtatcaccctcgggcccgacccccctgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccagagggcggtgtgaggcagctgcgatgggctcgagctggcctcgggggcggagacgagctcaggagctggggtccactccaccacaaagtcggcgagggcctggctcttgatcgcgtggcttggttcaaagcgcaaatcgaattcagagagttcgattgcccatttcaccaccagtccagtaccctctcggttatacaagatttggccgaggggataagacgtaaccaccgtgacccgatgcgcctggaaataatggcgcaacttcctcgaagttatcaggatagcgtaaagcatcttctgggcctgaaggtatcgggtctcagcgtcccggagggcctcgctaacgaagtagacgggccgctgcacctttcggcggggctgatcttcttcgtcaggggccacatctccagggcgctctccatccgagaggccacgcggggcgcactcggcttctgtgccgacgacctcggggtcagagggcgacaggcgcggccttcccgcagtggcctcggggccatcctgggggtcgggggcgcctggcaccgtcggacaagcaggcggagggccagctccggccgtcgggggccttgggccaccgttcggctcgggggcctctcctccctgctctctctctcttcgggcagaatcccggcggtcgcaagtcgcgcgcatcagcaagggaaaaccgaccgacaataatgagcggcccctcggcttcgcgtttgccttcaactccgacaaggagtgcggtgacgacggtgcggacgacagtgacggcgaggccggctacccaggcacgtcggagtgagcccccaggcctccgccaatcttaatagcttttccttcttcttccgaggccttcgggcccccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagccccctagggtaggattgagcacgagtgacctatttcaagtcaagattcttcaaaaggaaacaaaagcacagacacagcctttaggaaatcgaaaatgcttttattgaaatacgaaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagtttgctcagtccagcacgtgtttggacacggcgtaggacgaggtcgtcgacgcagagtgatcgggcccggacgtagcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgagccgacctcttcttcctcctcctgtcccgccgccctgaccgagcggcggacccgggggcggccgaagtggggctctttggaggcgatattttcgagcatgcggttgtgccgcacaccccccctgaacgcgtagatcaccgcgtgtgcagggatgcatggtatggtgttgcggacttgacagaaccgctgaatgtatgagcgaagtgactcatcatccctttgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgttccttcagggccatgggaaagaaattcgccatgaccctgtcgtcacccccggcggcctcgatcccggtcgtgtagacctggagaaactcggcggggttgacgctcccgtcatatttttcggcgatggtgggctggaaccttgggggccaacggatgttccgaaggctcgccacaaaggctctacagctgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctaggtcggaggcgctgacgaaggagtggcggccaaatggcgagcaacagccgccgctcgccgcgccctccgccttgacgatatggagccggtggtagcagcgccagaggtcttggtggcggaggaccgcccaccagcacctaggcgctgccgtaccgtcatgaccaagttggccacgtcgtccagccaacgttgggctggagactccgggtcagggacaatgggcgggtgacgtaggagcgcgcccgcagcttggagcgcgccctgaggcgtgctgccgtcgccgtagacgaggaggcgacgctccccatctcgccgcccttccccatcacccgtggatgttgaagtcgcggatccttcgaccctctcgagcgcctcctcccgcctaggactttggcgtggagggggcgatggagtacgagctcgacggcgtgggttcggctccccgttgtcaccgctaacactcggagagaggttgtgcgcctttgcttgttcggccattgggctgaacaggaaaagcttggcgcacacgaaagaatgcgagagcttagaaaaacacccgcagagccccctacctggcgcgccagatgacggagcgtggggctcctcaccgggagaccgtgcaggtccccctttgccggttcggccgggggccctgggtgagattttaagctcctagtctgtgtgtggaaggttcgcgagaatggaaacacacaagacacgggcgatgtatacaggttcgggccgct

SEQ ID NO: 71699 - DNA, 835 bp, Oryza sativa
gaccaaaataaaagttgtacatcttgatgagaggatcaactttgttgttgaccatatttccatttgaaatcattttgtatttacaaatgctgtttagatttatcatatattcaaattcaatttcaaattgttgggaaaaaagttatatagaaaaatgaccaaaataaaacttgtacatcttgaaaggctctacaactttgttgttgaccatatttccatttgaaatcatttatctgaaaatgtatcatgactaataaaatgaattattacacaacagctatatattttgcacttacaaatacaaatacttcaaatgaaaaaatagaaaaaatagtcatcggtgatgggccttggttatagcccgatagagattaatctatctcaaaggccaccactctcttattccagctaaccaccttgcaacagtaccttagcatttcatattaattatcttgcatgatgatttattttctcacattcttgttccaacgtctaatcccgcttcgtatcaactttacgagggtgctttgcagcctagaccttttcttacctttcattgacacctttaaagtatgagctactttcacaatttttactgtccaatcaattttattgtgcatgtttacctgactcaaccttttgtaaccatttcacgaaaggtgcattgcacatcccaatgtctctgcagtaaactatcgtccattgggttctgtatgttgcctatctttttaatatattactgataactttcttgaaaccctttcctttgttgacatctttcatctgatacatgaacaagctgaacagggtttcttttttatctgggaaacaatac

SEQ ID NO: 71700 - DNA, 704 bp, Oryza sativa
atcaagcttctttattgcagatttctgcccatcactaagctctccaaagaaaactctggcgtctgggccctctcctattagggcatcattactgaagttgctagttatcttctccaatatgttcaggggaatgatcgatacaatagttggtggagttttgacaaacttcttggtaaggggaggggctacatgttggtttggtttgttgtcaccactagctgtattggagaaaccaaaagaataaaatccaatagattaagttaattgctgcttacaaaattcgtattttgttagttgtactccatccagtaaaagatacttgacatttgaaaattgaccttttttaatgtctttaaagtgcatctcttaacaataattttatgctacctccctttctgaagagtgcctttttagctataaacatggacaacacagtctaggttcatagctaaaaagaaatttttttaggaatggaggtagtaaaatacaagtttatgagattatggaagtacctttctggacaaccagacaaatctacacatgtcattttaatgtttttaaaataaaacttttaaacatcaaagttttaaaattttgactggatcgtatctaaaacgtccaagtatttgtggctagagggagtgctacttaagtacttagcacaataatatttatatttttgcaaacaaggtgcacatttaaat

SEQ ID NO: 71701 - DNA, 12462 bp, Oryza sativa
cagtagaggtttcgttgcagccttagaagcgaagcccactctaattgatcaaattagagaagcccaaattaatgatcctgatattcaagaaatcaaaaagaatatgagaagaggaagagctatcggtttcttggaggatgagcaaggaacagtatggttgggcgagagaatctgtgttcctgacaacaaagatttaaaagatgcaattctgaaagaagctcatgatactttatattccattcaccctggtagtaccaaaatgtaccaggatctcaaggaaagattttggtgggcaagtatgaagcgtgaaatcgcagagtacgtagcagtatgtgatgtttgtcagcgagtcaaggcagaacatcagaaacctgccggtttgttgcagcctttgaagattcctgaatggaaatgggaggaaatcggtatggatttcatcactggtctacccagaacgtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctaatcgaggcagtcagtttacctcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcggaattctcgtacaacaacagttatcaagctagtcttcagatggctccgtacgaagcactgtatggtcgaaagtgccgcactccacttttgtgggatcaaacgggagaacgtcaggttttcgggacggatatcctgagggaagcagaagaaaaggtgaaaatcattcaagaaagattgcgtgtggcccagtctcgtcataagagttatgccgacaatcgccgcagagatttgagtttcgacgaaagagattatgtgtatcttcgtgtcacgcctcttcgaggagttcatcgttttcacaccaaaggaaaattggcaccgcgttttgtgggaccttataagattgtcagtagaagaggagaggttgcttattagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaatagatgagagaagaaccagaaatcgagttatccgtttttgtaaagtccaatggagtaatcactcggaagaagaatcaacttgggaacgagaagatgaattgaagtcagctcatccgcatctgttcaccagttcttccgaatctcgaggacgagattctgtttaaggggggtaggtttgtcacaccctaaaaatcctaaatgtataaattgttgtttaattggaatttttagaaatgattttaaaagtctaggagagaagatctaattttaattaataaattccaatataaaatggggccagataaaatttcattaaatactttgctttattctataattcctagatttttatgggatttatttgagctaaggaagtatttttaataaatggaattgcatttaatgaataatttaaattgaaaaatgtttttaaaagtctcttttggctttgggccgaaagttggcccaaaaccttctctctctctcttcccggcccaagtcggcccagtctagtccgcagccgcgcgcgcgcgctcgctgtcgctgacaggtgggtcccacctgtcagtcttcgtcttcctcgcgccgccgccgccgcccgaaaccctagcgtgcgccgccgccgtctctttccaaattcggccgcgtctttccttctccggtgaaatcaatagaggggaaatgtttcccgagatctcctctaccttttctcttttggaatcatcggctaaaatcgcttggaaagtgtttgattcgaggtcgattcggatcggtctctctctctccgagcccgaggtttccttcgcgtcgccggtcgccgtgggccttcgccgccgcctccttgcccctataaaaggatcctcggtgtctcctctacccgtcgccacccttgctttcgcctctcgccgtcggtagcgccctagcgccgtgtgacctagcgccgccgttgtcgccgccgctccagccgtgtgtcaccgtcgctccagtcgtcgtcgtcgttcgggaagatcgccatcgtggtcgccgtcgcgtcgccgtcctcgtccgcccctccgccatcgctgtcaaccgccggagcaccgtcgccgccgtcgacccgatcttctccgccgcttcgacctcgttgccgacgtcgtccgttgctcctccgtcgtcgctttggtcaccggtgagttcgccgcgatgtccgcatcgttttggtgtcctccgttcgcgtcctcgcgccgtcgttcgccggcgagcatgcgcgcccgagccgccgagccgccgccggtggtgacgtcgtcactgacgtcatcgtcgtcgtccctcgtggtccggccgtggaccggtcgatctcggccgtccgttttggataggatcgatctcggccgttcgttcccgtgaaccgctgccgtgcgcccggtccaccgctgacgcaataaacccctttttctttttcaaaaataattcattattgcgtcataattcaattaaaatccatataagtgttttaattcgatttaatctttaaaaattcataactaattcatcgtagctcggatttagttggttcaagtctctaaatttttctaaaattgagatctacatgttaaaaatatccacatgtactgttcatgcttgtttatgtgctgttttggtttttttttgctcttttctatttagattccgacgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattcctagataccttgggttattataatttgactagttgggctttatatattggttcagctagatattaggtgtgattgcttagccatgcttagaaacattagcacactattgggataacttatgattcattattatttaatgatggcttaatgatagttcacgatggtcaatcgtgattggctaattaattacttgccaactaaaacctgataatggtgggttgtgaacacatggttttgagagtcgtgctcatggcaattaaggaccggttcacgagtttcggttgtgaaacattaaccgtgccaaccacaagccagcgtgggcaacggctttaccttttgtatagcgtggttcattgcagagcaccagactgagaagtggcggagataagcccacaggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggtgggtctaacaatgtctttcgtgattagtttcacacctctcatcataataacagatgctataattggtaataatttgattagctcctggtttggaatagtatattcctggtttgaagatagaactgtgcagccgggatggttgttcagaatggttgggcccatgcaacagggtatgttgtgtagcgttggattaatactgtttaattaatacttaactgttttattaaattctgaaatgtttattaaatgttgtttatgcaaatgaaaccctactatgccatcctttgttatcttgtgcgcttgcatatttgctgcgtggcttgctgagtatgtcatatactcacgttgcaatcattcatcagaggaagagttctacagtgaagctgatggtgtggaggattaggtgtaggcctggtcaagctgcctgtggagtggagtcgtctgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctagagatgtccatcgacccccgactttgtccatctccatccgtgtacttttgtttataaccagactgagccacaaactaagccttacccactagacatgtggaagtatggtagtactttgcaacagaggcccgaagaccggtccttatatgaccgaggtgctactatcaaaaccatgcaccccgagcccagcctaaaaccattttgagggttttgaatagagggggaggtgtgaatccaattccacaataatccaaccattccatagtgtctaggtgatatgaatattcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgacaacgcgggaatttaaataaagcgataatgcaataatttaaatcaaaataattttataaactaggattcaatatgttcaaggatgatgtgacttgccttgctcgctttcccaaacatcggcttcaacctccatgaagagaggatcttccgaagctgcagcgtctacacgaccaacggaaaataaaagggcttttactctaataaactccatataacaagcaggaacaaagcacaaaaatgggttcttgacttcttaaggaaaaattagagacttgaacagtccaattccgagttcaaatggccaagttatggccatttgaagtttatatactcttaaaataaatatttgcgaatttcttcatttaaattttaatttaaaaagggtttatcgcgtcagccgaggggagggggcgcgcggaccgggtccatgggagtggggcccacgtggcagcctcacggtccacggtggaccgggtgcacccgggctcacaccggccggtgccgtgggccccacacgtcagccgcacccgagggcgcgggcggctgacggccaggccccacacggcagccactcggcgcgcccgagggcggccatgccggcgcggtcggcgagaggcggcacgcccgcgccactatggtcgccggcggcggccatagacgcggcggagcagcggccgagagagcggaggaaaaggggaaaggaggcgacggtccacggctcaccccggggcgacggcggcgacggaggaggcggccgaagcggagggaggcggcggcgtggctcgggtcagtggggacggcggcactccggcggtcggcgaccgaaacggagaggtggacgaggtcggcgaggatgtggtgaagccgaagtaggcggcgccgaggtgggaggcggtccggggcgatgacggcggcggaccggagctcggcggcgacggtggagagagagagtgacggcgtgagctcgattccagcgatgagaaggcgcgacaaagggtagaaacatgcgaaggaagtgcggggagggtttaaatagggttggaagggggagagagcggccggaggggcaggaaactggcgcgggaggtccggccgccatcaatggcgccggcgagatttgcaggggcaaatccgcccatttgaacgcgagagagagtgggaaaaatggggggaaagggagaggggatcacggggagtatttccccccactttgttgcacgcggggacggcgggatgcggcggattaggcggcagcggcggcgcttggcgcgggcggggcggcgggagcggtgggaggacggggatgacggatgggccccacacgtcagcgagggtggcgggtgggcccgcccgtcagcggcgcgcgcgcggggagggaggccgaatgagccgcgggggagaggagagagagagaggtggggggagagggagatgggccggaccgtcccatggaagggaagggggacttttagggtttttcttttttttaaaactttttcaactttgtttatttcttcttaattattatttgtgctctgaaaattccactaaaatttatttacacattttaggcttttaggaaatatacaaaaatcctccaagccttatttgacttttactttgcacattttaatttttggaggctttcacacatggattttaattattctaggcataatttaaaggatatattttagggtcgttttgggacgtgacactatccttcctcctcgtcgatgtctcctccggcagcccctaacgccgtgcccgtgcgccagccgacgtcgccgtctcctccggcatcaccgcggcaaggttgccctcgccctcgcctccccttcggctgaaccccgccgatgttcgtcgtcgtcgtcgtcgtcctctcatcgttcccggttgtagtggcgttcgttccgccgtcaagccgtatccgttcgtcgcctgcgtttcgtcaaggttgctacggccccgtcgtcatcttcgtccatgcctccgcgtcgtcaagcgttgcgccggtcgtgtctcgccttcgtccaaagatcaccggcgcaatgtcattcgttcgtctccgtcgttcccgtctgactccgccacgcccgttcgtcgtcgtcgttcccacgcctcatcgcgtggtggtaagggcctgaaagtgcatctaggcccttaatgattttgatgattgattacaatgcgattagagaggactaacacttttattcaagcaaatgtgaaggttgttatgtcctcgacatgttgtaatgagatgcataccccatgaatgcgacatcacgatgcaatgcggcaatgatcaaatagtatattgtaccttttaccttacattgtgtcgtaggaatgtcgtactattaagagggataccacatgcatattattggtaaaatactagtgctcaaaatgcttcatctttgtgtgagttgaaaaacctaagtcaaaattttaatcacgagttgtttcacttgtcacaacacttacaccgggtttctttgcaagtttttcaaaatctcttgaaggttttggaccatgttttatgttgggtttgatagcccacgaaactagctttccatagagtccaagatcttcgaaatcggagttcagagtaaaaagttattgcagttttacttgagcaacatcataatatccgatttgaaatcagactatccgatgtatcggactatccgatttttcatataacttcactctctgtcttgatttgaaaaaatcctatcgagtgagtttttctatgtatcggagtatccaatgtcggatcagatagtccgatgatacagagactccgaaatttcatagaactcgagtctctgtatgaggacgaagtttttgcttctaaaatatcagatactccgatttaacatcagatagttcgatgtctcggaaagtccgaaatttcatggaacttcgttctctatttctcgttgccttggaggtttaaaatatcggactatccgatcttgtatcggactatccgacgtgggctgaaagattcccctcacacggccacatttttggggggtctataaataccccccacctaacccttttctagggttacccaactcatttcattctcattcactttgggttgagcttggtactaaggtgctttggatctttgagctctctctccctctctcaaatccctccttgttctttgtgtggtggatcttggtggttgtggatttggtgtttgagggcctagtgtgtgtttcactcgatcttgagcgctaaggtttgaccaagagttgtgtggtgtttgttactcttggaggttgagaactcctagatggctaggtgtcactcccgagccaccgatctacgtgtggttggctgggagaagtttgtgaaggccggatctcgcctccgcaaggaaagagataccccttagtggaaggaagagtgcttagtgcaacctcttgaggaaagggttagcaaagactcggctcttagtgagctcctcaacggagagtagaatcccctcaaggatttgaactccggggacaacttcgtgaacttcatcattggtgatctcccttcatcctccttttagctttgcttaattgtgccgctatagatctagtcgttgtttgtgctttactcttgtttgtgtgatatatctacttgttgtgcttcattggtggatcagacagtctaatccaacatcagactatctgatattttcggatagtctgactgtggatcagactttccgaccttatttcagttttagcttccgcataaagttttaaattagcctattcacccccctttaggcctaattgaccctttcaattggtatcagagcctaatctcctaattaggcttaaccgcttggagagatcatgtcgggtcaaacggggaatggcaaggatggtgataagggagctacgtttccttatgactatccctccacatctgcatcttatgtgagcacctatagcggcaaagctccgtacttcaatggtacggactatgccgcttggaaacataagatgaagatgcatttgaaatctattaaccctttgatttggagaatagtcgaaaaaggctatgttttgcagaatcccgtggaacccaccaaggaggacgacaagaacgagcacaagaacgctcaagccgctaatgcaattcttagcgccttgagtggaagtgatttcaaccgtgtggacggcattgagagtgccaaagtgatttgggacacgcttcggagtttgcatgaagttacggatagtgttagcgagttcaaggtggagattctcaaggggcagtttgagcggtttgtgatgttggatggtgagagcccaagcgacatgtatgatcgattaagcaagatcgttaatgagatcaaggtacttggctctaaggacatgaccaatgaggttgtggtcaagaagatggttcgggcaatcactccaaggaactctaccttggtgaccatcattcgtgagcgtccggactacaagactctcacacctcatgacttgctcgggcgtatccttgcccatgacatgcttgagcaagagtccaaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggcttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcaagtcatttaatgttgatcttgttagtgatgaggaggaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtggacaagagtgtgatgatcaagaatccccaaggtcttagcaactttgttaaggccaaatgtatccttcctaatgattatgcttctcattgttcttttgatacatcttatgttcttaggaaaaatgctaatggtcgtgctgttgctaagtatgttggcccaaggggcaaaaatatttctatcaagagagtgctttgggtgcctaaggcacttgttattaacatgagaggacccaagcaagtatgggtacctaaaactagaaattgatctcttgtagtaatatctctccgatggaagaagttgggtgattgatagtggatgcacaaatcacatgaccggagaaaaatcaatgttttcttcccttgatccaaatggctcttcgcaagagaacataatcttcgggggacgatggaaagggaaaagtaatgggattgagtaagattgcaatctccaatgatctttccatctccaacgtcctcttggtaaaatctctaaactacaatctgttgtccgtttctcaattatgttccatgagctacaattgtctttttaccgatgttgatgtgaccgtatttagaagggatgactcatccgtagtctttaagggtgttctcgagggcaagctttatcttgtggattttttctcaactaaagccaaacatgagacatgcttagtggctaagtccaacatgaggtggctttggcatcggaggctaacccatgtcggtatgaggaatcttcacaagcttctaaagcacgatcacatccttggactaacaaatgttcaatttgagaaagatagggtgtgtagtgcatgtcaagccgggaaacaaattggagcacatcaccccgtcaagaacgtaatgattactacaagaccgttggagcttcttcacatggacctcttcgggccaattgcttatctaagcattggaggtgacaaatatggtcttgttattgttgatgacttttcacgtttcacgtgggtgttcttcttgcatgacaagagtgagacacaagccatcttcaagaagtttgaaagaagagcccaaaacgagttcgacctcaagatcaagaacattcgaagcgacaacggcaaggagttcaagaacacgtgcatcgagagtttccttgatgaagaaggcatcaagcattagttctcggctccatactcaccttaacaaaatggagtagccgagaggaagaatcggactctcatcgagatggtgaggacaatgttggacgaatacaagacatcggaccgcttttgggccgaagccgtcaacaccacatgtcacgccatcaaccacctctatcttcaccgccttcttaagaagactccctatgagcttcttaccggtaacaaaccaaatgtctcttactttcgtgttttcggtagtaagtgctacattcttaataagaaggctagatcctcaaagtttgctcctaaagtggatgaggggttcttgcttgggtataggtcaaatgagtgcgcataccgtgttttcaacaaaacctccggtattgttgagatcgcgcgtgatgtgacatttgatgaaattaacggctctcaagtagagcaagttgactcacatgtgttaggtg

SEQ ID NO: 71702 - DNA, 1560 bp, Oryza sativa
gatggtcttcgtcacagtaggggcattgagtaacgcaattactaccgtagtgtcctatctctccgcaacgactacatgccttaatcttcgaaacttctttggatgggtctggaactctatcctcttccgggttgatctgtgaaggcagtgtttcttgttcttcattggtgtcttgagtacagcctatcgcataatgtccaaattgtccacaagaaaaacaacagccatctctctttcgttgccatagttgtagctcttcaacttcttcaggtaaattaccgatttctattcccattttactgagatcaagttcagcatatgttattagtgatgacgcttttcttttctgttctcctttccaccaatgctgtgtagttctttgtctaggaaatggttgatacggaagttttggattccctgaacagggcattggcgttggtaatattcctggtcttatattgcatattgggtgccaaggcaaattccttcttggtccaactctcaaccttctttgggggcatttattggcataatgtcctttctcaccacaaccgaaagatgtgacatttgtcttccgtcttgccgtagtcagatggcagcttccatttgcagggtattgatttaggtgatttagattgatggtgtagtcttcaggctttagtgaggcttgaactcgtcctttgttcctggaagcttggggaggatcttcaaagggtagcatgggctggtttattcccacattttgggggtcttgtagattggaggaattcttgtttttttttcgatgtcgattggtccatgtcttcatgtcctgtggtaggtttctcttgttacaagttagtaggttgaaagttagtaaactattatactagtcatcaatagtagcatgacaatgctgaattgttgtttttcttcttcatttgttcaatccttcgttccttaatatttattatgaatcttgccgacgagagttaaggtcacaccctttgcagttttactatccaatgatacttcaaattccctgtacaagggcaaatataccttgatatatagtattccttgtccatattttcccataagttattgatttcctcgaggtttctccatcataggctaccccccttaaaataagaaattttgaaagcaatttaaaaggagatatgcttttgcgttcacaaagaagattttttttttcaaaatgattttgcagaaatatcctttggaagtgatgtttgcaaaacatttaaaatattcaagagatgcagtttctcaccaaatataatttgaaaatagatttttcaagcaagattttgtataatcatacatatgtttaacaaaaagcaacatggcaactaaaaacttttgtaatcaaaattttttttttaaacaacatttgattttatttcgcaaaagagcactcttgccaatagggccaaaataccatatagattgtatgcatggttcaaagttgaaacaacaatacttttgaacacctcaaaggaaaactcatgaaagaaaattatttttttactattattattattattattataaatatta

SEQ ID NO: 71703 - DNA, 763 bp, Oryza sativa
  unsure (1)..(763): unsure at all n locations
gggtcggcccgctcccgtttcggccccgagggctgggacgcnccgaccccctgtgttttggcgccacgtgtgtggataggtgagcccagcggggctcacctaccggcatttatagcgggttggacgagcgcgccacgccgcatttaatgcggcgcagcgcacgcttatccggtccgtgaccagtcccggtatgtgaccggtcacagaccggtcagatcgcgggttaggtggcaacaggcgtcctgtcgcacgcctcgcctcgtcccgtcggaatgatgagagtttcctggctctcgtctctagccgaagctggcgtgctgactcctggagttggtatgtcagtcccggtcagatccattttaggcttcagcgcaagcatggcaagaaagtcgctggccattgaatgaaggttgaaacgggcgtcccccgggagagctgacgagcggagcagaaggcgtgtgcagtgcttgtcagaggtcacttccggctgtagactagccctcattgtaaaaagcatgtttcctttcttaggcagctagaggcccatgtggtgacccctgaccacataaaaaggaggcccaggcctaggagagggggctggactctggccacttggttctagagcctgagctctctctggttctctcgagctgtattccttcacacacagatccaccagaacacaggagtagggtattacgcttctcagcggcccgaacctgtctacgtcgcccgtgtcttgtgcgattcttctcgctgacat

SEQ ID NO: 71704 - DNA, 1702 bp, Oryza sativa
tgtgaccgtttgcccaccgatatgcctccccctcctcacctccccaattctaccgcgtgcatgttattctgctctttcaaacatcgctgcatgccccctctctattgctcctccctcctcgacgcagtgtaggagacggtgcagggaccagatctgatatccaaacctcggggctgctcagggttaccaccagatctagtccttgtagcgcttcctccactacgcgggggaggagaactgtttgcctaccgatgtctctcccacttgtatccccaaccctaccgtggggatgtccttttgctgtcccaaacatcgctgcatgcctcctctctcttgctcctccctcctcctcgacgcagtggaggggcgatgcaaggaccagatctaaaacccaaatctcggggctgctcagggttccactagatctggtccttgcagcgcttcctccgctacgtgggcgacgagaagttaggggcggagaatgtagtgatagtgcttgattggtaggaatggcggtgatgacaatggtagcttattgagtaggagtgatggcggagacttggatccgctggttggggatctaaggagagggagtggtggcagatctggtggctccatggtcgatgactgtgtcgtgagatcacgaaggcccgggaagtcagcacggagattgtgacgacggccttgccctatgcttacggtagttcgatccctaggtggtggatctatattcagttgttccgaccctccccactcccttccgctgcgagcttgaggcacgagaccttgctacctcacaagttagattatctcatattctctttttttcttattgttgtgttttctctttgcacagtttttcgtctgctgcttttcttagcttgattgctataaacaaattgtggcaatgtggatttttgaaagcgtatgatttgttgaatgttgaattataacattagtatttatgtacttttgtttccaaagctagtatcactactacagaaaagggaattagtgccggttgggaaacccccttcggtgccggttttctcaaccggcacaagggaggcggcactgatttgaaataaaaaggtgccggttcattagaaccttttaggttcgacgaataaaaaaaagccggctcgatgcgttagctcgatcgagccaacgcatcgagccgagcagtccctcgtcccacatccagaagaatagaaagaacaagaaaattttttttggcaacattcatcccacaacatgcaaagatggaatcatccacatatcaaattttggcaacattcatcccacgacacaaattttggcactcaaatcaaatttatgcaataaaaaaaatcacacctcttcagtcgtcaccgtcgcacggtcagccgttgcgccacctcccatcgcgccgtcttccttcggcgagcccgccggttgccgccaccaacctccccgggagcccgcacccctaccgccggcttcccttccgctagatctagtggaggggagggctcctccccgccggcgagcccttcgccacctcccctttttgagccaccccacccgccgccaacgccagatccggccacccccgcctgtcgctgacgcctcccctcctgccggatctggcggaggggagggcgcagttgccgctaccgcctccgctggctgcgggagagaagggaggggagagagagagaga

SEQ ID NO: 71705 - DNA, 19623 bp, Oryza sativa
tgagttctttttcttataactggtatatatcataatagggataagacattttacgaagaattttccaccttttaagttatttacatagaacgataattaatattataaaaaaacggtgacatgtttccaaaatgttagctttgtaataccatgcatcagtagtaattttaatggtacataagtacaccaagacattatctaacaaaatacaccaagaagcataaaaatataaattattataattataaattataacactacaacagaaaccttaataggaaacggctcatagtcataggtgccaaactgccaattcatttaaaaccggcatctattgaccattttccactttcatgggataaaaaaaaattaaaaaccggcatctttaagaacatacaggtgccgattctagaaaaaaatcgatacctatactgatattatatgtgcatgttctttaaaagaccgcctataattaaaaaaaccggccaaccgagccgactggcgttatcctctgccgcctcctccttctccccgctactgcccttcttcctcctcctcctcatcgtactgccacccctccttcctcttcctcctcctcctccttagccaccaccaccactcctccttcctcctcttcttctccatccaaccaacgccactgtcaacacagggactgatccaccgccacgaccacggggttggcccggtcgtcgatgtgatggtgtcattctttgtctgtttgtgatgatggtgatctcagtgatgattgtgattgtgtttgatgtgaatgatggtgatctcagtgatgacggagagttggtcgaggcatcaagccagttttttttcattcctaggacctcaaaggtgttgctttgctgggtgccgttcgaaaatatggcacctatggtcatctcccaaccagcacaaatttccttttctatactccctccgtttcatattataagacattctagtattgcccacattcatatagatattaatgaatatgtacatatatgtctagatttataatatgaaacagagaaagtagtagtgtatgtgattactagtgatttcaacaatttgaattataaattatgacagtacatgttatttgttctacttataaccttaccagccatcttaattaattgtagcaaaggctcacttgctcatggacaatatatacttgacctattttatcagatccaacacatgttatccatgcatctcgtagataagtgcattataaattatatcttttgaacaaacaaagtatgaaccacagcaacacattattcatcaatccctatacatcatccacatcacacttgagctttccctatgcagtagggtaggaaggctccatggcgaggccacacatgccccttttgtcagaaatgtccttctccatcctcaagaaaccattctcaccccaagtcgtgccccaggagttcttcagcaaccaatacttggtaccatcactagccttgccatagccaatggccacaataccatggtccaagtcagtgccacatgagccggtcatcacaccacctttgtagaactggaatgtcatgtcgcctccatcgacagccacagacacaggttggttagccaccgccttcataagggcagcctcattgttggctggcacatcctcatagcccttgatcgatgcgacgctgttggatacactcttgcacttgtcgtctgctgctgcgtatgggtagttagactcggtggtgaggccgccattcttgatgatgaatttgaaggcgtcatccatgagcccaccttcgcagccctggtcctcaccatggacatcacagtcaacaagctcttgttcagagagtgagataagtttgcccgtgctcagcttgacaataccttccatggctgccacggccgaaaacgcccaacaacaacctgcaataatcattcatgttcaatgcattggacacaatagatgtcatcacaaaacgctatcataaaagatactgaagaatgtcatctgagtagcctgaattttcttaccacattggccttgatccttgatgggagtgaccgcgcccttggttctccagtccacggtcgccggcagcgcatcaatgttaacattctcatacctgaatccagtaggaaccctagtcgtgctaggaatgaatcccttgttggtcttcatccacctgaactcgtcattggtgaggtcggcgaactggttcacaccaagccagaaattgtggttaccagcattgaacgactcgatgaaggcgacattggccttgaacacctcgaaccggcgggccttctcggcatcgtccctgtacacgcgcccgtactgcgccatccacctctcgtgcctcgccgccatggccgcgtcatcgctcagctcacgagctgctagaacagcgctgcagaggcagaggcagccgaggatggcgaagagcagagccttggccatggccatggtcgatcaggctttgtgacctgtgatccagctgctgttggttgctgctctgctgctgcttctgtgaactctgcttttggtttggtgaattggaactaggatgcattggtatatatagtcagtggtacgaacttatgtaagcacatacggtgcgtgtacgatgttgtgtttctgtgtaaacggcagtctgcgtagccgtgaagtatatacgcgtataaataaattattgtgcataggacgtacgtttcctgcagaacacagacgcctacattttaaattatgctgtgggggtttgttgaatgggaatatgaatacaaaattggaatttgagtgctccaaatttgccttggtgaatgtgtggctaaatgagacgtggttcacacggaatgaatgtgtttatcataggtaatggaggattagagtgatgtgtttatcctatggagagttttgcacattggggcaatcgaatttaggataacataactgaaaatagttgtattgcatataatagatagaacatggagtacaatatattttgagtactcgtatttacggctaattatttttttcaattctaggcgacgtacttattaacaacgaggtgctagagataactttatcactctcaagatatacaagttcagtcttttcgaggtgctaataaaggttgggtgtatatgtgcgtttatatgggtgtatgtgtattgtgagtatctacgtttgtaatgttgtttctcaaattaaaaaaaatgtatttttggagtttttttacagagagaaaatacagtattttggttgctcttaatcgaaattaaccagattaacgttactcccaaccaaattactagagtacttttaactctacatgagtccaccaaatcgatgtaatcaaagagaatttctccttgccgtaataaaattaatgtagattttgttctctcgctgttggatatttgggccagcagcaggtggagggcatagagagcacatctgtcagtctctggtctatctatactaatataaaaagtataagttgtgtctagcaatcctacaggtgaaatcacctcctcccatctcatccgtccatctaccatctcatctcatctaattcgtttcgctatcctcctcgctccaccgattccaacgattatagcgaccttatcctctccaccgtccacgcgcgattactccgcatgcgccatctttgccgcgcacctcgcctccgccgcattcaatccgtcgcgcatcatcgccacaacgacaaatcctcatatccgacgctctctcccaagcgtcgtcgctgctacctccactccgcctcggtcctcctcgcctcctcgctcctccctgcgtggcgccgctccgccgtcgtccccttgcttcgctccccctctcctcctcctcgcctcctcactcctcctcgcgtggcgcacgccgccgtcgtccccttccgccgccgcccagacgccgccgtcgtacccttccaccgctgcccggacgccgccgcccatacgttgccatcgtccccttccacagccggagccgcggtcttccccatcggccacacaaatcgcgccatggcaactcacaaaattccccacgcgtggaccaccaaggctccatcgcgctaatcccgcggtggctcccctaatcatgataacgccgtcgccgcgcctttgaacgctgctgcaccatccgtcatcatccgcacttccgccgccgtcgtcaccgcaatcagtatcctggtggtccagggtttccaccagtgccgctaccccgtctcgccctggttgtgcatactcccaccagcgtcgcagctccgtcgtcgccctgcaatcggtgcctcagtggtccagggctccgctggcgatgccaccccgtcgagccacggtggtcaagccttccgccgacactgagcctccatctttgtcgctgctctgtgagtcctctagtgttgccgccattggaaggggatagactcagcagctaggcctcccagccgtgtgcctccctctcttatgttggtgatacctgattcaactcaaatcgactcttttcaatccccatttttcctctttgtgaattttccccattagttctctagctgaattttcttattcaagcttaatggtatgcatctccttttagttatgttattcggttcttctttacctttgtggataattgcaggctatatattacgtgattggtgctgcagtttcatacatactaacattatagttgtcatgttgaatatcttgcagattgtcttacagagagcaaattcaaccatgcctagtctcttatcttttttatttagtcgaaaaataacagttcctttcttactgaaatggaaaatgcacgaaaccctacactgcaattttctgcaatgacagggtaaatagccatatcaagcccgtttgttgctgttgggctgcctgcctcttatttttcttttttatttctgtgatcatcaacaattactggattgtcgtcccttatggtctttcatttgattcactgcacggttgataagttcactcatttgctgccaattgttgttgactaatttctttttcatattttcttttatctaaatatatttattctgtacttctattgggccatatatagtctgatttagtgtttgtcatttcaggtgacattgcttcttagccaattggagcacaaaagaaaatccaataaacaggaaaacatgatttagtattggacatcatttctgaaagcttttgcacttaagaaatgcaaatggacaagaataaggtatgcggtaaacatgatacttctgtgtggcttactacttcactggtcctactactttagagctatatatttttgtgtgactgtagatgggttccattaatggatggctgtgagaactaacatttcaattttgtatatatggtagagcttcctcgggtggttggtagcagaacaagatagtataagttttcaagtggatagaactaaagcaaagctaagaattaaacatgtgtaatggaagtatcaggaattcagaatggtagttggcgcatatggaatggatttgatgactgaaaattgtgtaccctgtgaagaattcattgctggttttaagttttaacttcataccgttatcatttcaaggaaagaaggtcttgcaatcgatcttctgaagagctgagaaaggtacagcttaaaaccattatttgttctatagtgaagttgatgtgtgtatactaaataacatcgtcagaatgagcaaacgctataaacgaaaatcaaccttcaaatataatatgtataagctttaaatgttaatggccacttatgcaaaatgcactaggtaatgttgttcttcattttcaggagcgatttgtaaattaggttaatgaaacaaaatattccacgttttgcccaatttctataaatttgagtacctgaattcactcacaccaaatggattgccacatcttttaaaggtcaaatttaattgtcttgtcatattgctgcgcaatctcgacccgcacaacgggttgtgcaatggaactaggcttatgattagagcatttcagaattattccattagtgctgagattgtcagtggtgcacatgctgggaagagggtcttcataccacggattccattatacccctcggaggatctttcattgccttttaagttcaagcggaagcagttttccatccgtcttagttttgcaatgactatcaacaaagctcaaggacagacaatcccaaatgtggcaatctatctccctgaacctgttttctctcatggtcaactctacgttgcactctctaggggtgtctcgaggggaacaaccagaattttggccaagccaaggatagacattgaccccactggaaaaagcacaaagaacattgtatatcgagatgttttattctgaacaggtatgagattctttatattcatgtcgacatgactttctactttcctgaaattgaaggttcactcatctaatgatttaattgtgcacctgtcacttgctattaatgttttaaaacttgctcctgtcacttaatggtatttcaattaattttgccaaatattacattttgattgagtaattaatattatatctgcagattgtctaaggttgattagagagtaccatgttcagattcttctgaaggcccagttctttatattattcattggactgttgagcttggttgtttctggaggaccaggttgcatggatggtgagtatcatattgtttacaccaagtgttcattgatatggaggaaaacctgatgtactgatgcacaagagtatttcaaataatcttgccaaatattattttctgattgagtacttaatattatttgtgcaggtagaatgtggttgcattgagagtactatgttcagattcttctgctggccctgttctttattttttttttttcactggactattgaacctggttgtttctggaggactacggagcatggctggagtatcatattgtttgcaccaagtgttcgatgatatctagaatatcatattgtttacaccaagtgttcgatgatatctggaggataacctgatgtggattatgagcttggctttgtcttgacaaataatagatgagttgatgcttgtaagagaggtctcgatgatctgctaattgccactgtttagttacatggggtgaaataattttgtgcaaacataactgatgtatatgacaatacgtctctgatttggatcttgtaaacttatttgatttgggaaggactgcaacacttgaaatttttattggaaggacaattcagaaacataattgggaacatttgctatattattttatgatcttatcctgggttgtacctgaacttaatattctgacatgccggttaatttctgagttcatttgctgaacttgctgactaattttaaccggtgatgtgcctgaagtttatattgtgacatattggtttatttctgagttcaatttctgtacttgcggaccaatttatatcactcacattggcatgttgttgttgttttctccaggactccaagtggtctcattagctaatgatggtaaataatgctataatttgagggcaacattatgtattctatagtgatgttgtgttctacgtggacatgaatacaaaagagcatgctactcagaaatcaggctagagttcaaatgatgattttcatgatctataaaacatttactttttattcttaaaaagtgcactacatagataagttatatttattattctatcttttatgtatataatactaaaacgtgccttgcacgtgcacgataactagtactaatataaaaaggaggagttgcctccttgcaatcctacgggtgaaatcaaggaaaaccagggcccacgcacaaacacgtcgaatccccatcccatcaccacggattcctctgccgtccccgccgccgctaaccccgtcgccccactccctctatcaccgcatccgcatgtcgcttcctcctcaatcactctgacgatagcttcctcttcctcttgatctcgccctcgatgacgcgccacctacacacgatttcgccttcaacaaattcactcggcctcttcctctgctcgatctcgctggctgtctccttcaccgccacgaagccttgccgcccgcctccatcgttctcctgtgtcgccatcaccagcaagacctcgcaccgccgccgttgtgaccctcgatccacgccgagcttccgcctccaaggccacagcgatctcttcttcagttctcaacttactactgggtgaaagatttgcctcctctgtgtactagcctcattctcctcaggtaacatcctctctatgtactagctgcttgatggaattcccacatgagaaaatttcgtgtattctgtttcaggttgcgtagagtaagggagaaatttcagaactatgtacaaacatactccaatgattttgctgccatatacctgctcaactatttactagccatcatccttgtcagatgcactagatgagaaataagagtatcgaactcatcttctggtcagtgtgccatcatactgcaaaggaaggcacgttcttttccattttttttttcaaattttaatgttgctcagctctctgtgcctcacacacactttttgattttatttttttacttctatctatcgtttgttaataatatgtgtattaaatatatttttactcaaataaaataattttagaccttcatttcattaacagatctaatatttgtgtatgatgtttgcaaggacgataaacagtattgaaggaactgcaaattactcagatgatctttacaacaatggatgaaaatgatcacttagtgttgggttccaacagtatgatccacttatactctgtaatcatgatgcatgatttctcacatgtatgccaagtttatgcactccaaatcctgtcagtgaacatctagatacactattcagtttcattgaaaataaaaaagaagtggaccagcgtggaccagccatcagacaaattacagagtccattactctcccccaatcttcctctgcaacattttctggtggtgatattctgagttcatgtttaaccaacaaatcaaggcacttgcttggattagagttccacaccaatggttgtagtggttttagcgatgaccatgaatatttaactattgcctaaccggtatgcagtcagggtgccacgtcttagatctatatggttagctcttattctactgctcactttgcttcttgccaaagtagtttgacggtgttttggtttcaaccctctgtccctggaacaaaataaattttgggcaccatgctctacaagctggattttgacatttttctacccaattttttgcgagtttgattggtgctaattaaatggttttcttttggtgaaacacaaacttatctctgttagtaatggcaagtcagcaaggatgaccacctgtacaggattttttagaccggtcatgactgggaataataagtaaggatatgatgatatactaccactcagtctaggaactcatggaggtgcgtaatagttatgattgttacatataggctagcagaatggtattttttgttatttttccattagaaattttccacatacatgattatgctcaatcaagttattacatattgtaggataattaatgacaaaaatatgctgaatcaagttgttatctcaggttgatttctcagcaaaattatactgcctgaagaaagatacttcagagaaagattgagaaatgaagcttgcacacggtgacaatacctaactctgagatattgtttcacattcactctaaattaacatgataattctaaaataaattatagatgcagctgttaatttcattttaaagtgcaggagctgaaatctttcttccccaggtcaagaaagaacatgaaccttaatggtcaggcataatcccaatattctatattatgtttcacccatcagaggtcatgtggcggtctatgtgcctctaactattgcatcgattaatagttcaacatattcttttattgatccagtgtcaatctcatgcagtgatttttcttatgaatatacatatgctactctacatgattcagctcacaacacaaaaacaacgtgattacaaatttatttggtgaatattcagttgcatacattaagtgtcatgatatgtgtaaacatatgtgaataatggtttccattgcttctttataccatgctccacaaaagtgaaaatagtggtgttaaagatattgctgttaaattatagaattctcttatgcaaatgcctattttctaatctgatcttatgccaagaatctttgatgttggtgttgtggtcaagtaaggggaaaaagtgtagcttgaacctcccgatctcagctgtttctgacctctaaattcgggtaaaggccaactgattgaagcaacaagtgaactacaaaattttctaggtttgccatcatttcagaaattatacattattcttagaaccttggttttatgtgagctggaactgttgaatcgtacaaaatatattttgtttcatggtgcctctagctaaatatggagcttaatttcctacacggagggatcactcacctccaccatatcagtacgataacattttgtagtaagatggttcatgtaatcatgtatttagatatgcttgattttatagttgtggaaagaactaatttgtagcttcaaatgcaatagcttcatgtacaacaaagcattgccattttataatctctttcgttgttcacatttcaggagttacatataagtattttcatttgagtataaaaatataataatgtgttgagaagatgattgtgtggtgactagctctgataattgataattttgtttatgctttatacaatgtgcgtctttttttagcactgatcaacatgagattgttctactgaccagttaactttttgcacgcttagtatttatgttgcattgtatatgccttcgatgtaaatgcaacaatttgaaaaaaaaaaaactatattgaaatatgtacgtagaaaattgttaccgcattattaatgtcaaagtagatagttggagataaagaatcaatttttatgacctggtttaagttatatatagctttcctcaaggatataattttaaatcgtacctatatttttctagattcttgaatatccaacacatgaagactcatagctatggaagttaactacatgtttgcataagtgtcattatattggaagttttttaggtgctggatggaactaatcaggaaaaaatttaattatatttatggttaatttgatcattatatttttggtgttcgaagttagtttatgtcgatttgtactgttggcagacaaattaagtcttatcctccaactggtagtgtccaccatttgtggtggtgcttgagaggcaagttgatatctatcatcagatattacggagaagcaattcattgttcgaaatagatgacattgaacatggtcaaaagtgcaagttggtgggatcgaatccattgggttagaatggcatgaaacctggacctcatgagaactatggacacttctgtgacttcgacaacaagtttggttgcccatgtactattgttcatgtattaccctgttcatagcaaatgattgaaaacaaggatcatcatttgagggtttttgtttatttattgttagatcctatggagttacaaaattatttatgcaaagttgattaattggattgttcaagattcaagtcttatgggatttattgtgtaaatttgtatgcaagaggaactggtgtccttgtaacaagcatatatatatatatgaatctgcgaactttcaaacatttcacaagctcactacattgaacatatatgaatgtgatctgggtcaaaatttacatatattgctgagttttctgcagaacactcctaacctcgagaaagttatattgcagaactgcgaggtactacttatagtttctttcagtttgtcttgttaatctgctttcttgatttatcatcctagagtgatcctgtgtgatgccccaatagatttcagatcattcgagaaagaggaaaagaacacccaaggcaaacaggaaccagattcattccaagagcagaagtctgataacttccaagtctgagatctcgaagataatgaagatgacatatgaagatgacggtatcagcgaccttattgaacttttgttgcgcagttggagaaaacttgaggaccatactatcataatcaccaagatttgagtcctttgcatacggtgttatcatacgcctgactcttatgtcattttgtactatgatgtgagtatttttaccaacagcaactaaacccatatatatgactaacgccaggctggtgtgattaagggcattacatccattgtatgctagtattaactgtttccagtgagattcgtaaaatcactcttttctagtttcaagttgagaaatttaagtaaaacagccatttgattatttgatgatgttcctccctattgatcaattgacagttgacattcttaccatactacaggtgcaaaaggattagcttcatttctgttctgtcattccaatctatagagttcttttcaaaatgataagtgccaatttctcatgtttttatactagaaatgcaaataaacatcttcatgatgctcttggaataatctgttgtgaggataatgttttgtgacactgcttttgttgaaagtcatttattataaattggggaagacaaagtaattgattttcttgtccaaatatcattcaacaaattcttcttgtactaaaacactatctgattattacacccagtgcttcaacaaatataatacagaaacagtagggaaaaaacgtttctactgagcacatttcgccatgcccatgtatacaaattaagaatgtcacccaattgattattaaaaggcagatttacgtattacgttaccagctatatcaatacatcattccaatcaagaaaaaacattttttatatgtcaaataaaattatcaagatctacattatagaaggtaaattgagaaacagttggaaagtgcaaacctgttctacattttgcagttccatctattctcatgacccgtggaagtgcatactttgtgtgttccgtgttgatctttatccaacttgattagtcatcatctggccaattaaaagcctgcaattcgtacaaagattgggcagattacttttgagttttgacattctcatagttgaagacatgttacttacgcattttaaaattccaaatcattcagctacgaagttataatattcttttacttagaacataggagaactaaactttctccctccattattgtaatcataaccagagatctaaataaaataccttggtagccagatgaaaactattccatgtcaatatgaagcgtactttgaggcaaactcaacaatattattatacgagctccctcctttcttcatggcttccttagctttcttcatccacctattagcatttttcatgtaatctgccttcctctcactctctagaacctctctgatgcatctctccacctcttcttttctcaccattccttccttgtcccgccgtacgcgtacaccatttccccatgcactctcaatgtacttcgctgtagttggttggtctgtccactgaggcatcgctaacagtggaacaccagtaacaattgcttctgttgttgagttccatccacagtgagttaagaaacaacctgttgattaatgaagaatgatcagtttctacctgcagcttaattatttgaaactgattactgcagagagttccgatagaagaattgacatgatacacacatcttatcacccaagagttggattgacaagataggttacccattggataatttggttgaaggcagtaacttgagctaggttcgtgggatccaaaatatagatcttatgaaaatgactcagtatgccatgtgtacaaaattaggggtagtatgtccttgtaggattctatagatgccattaaatttaagtgaagaaacactccaatcaaactgatcagtatctatgcatcagttacaactattgtattcgtgcttttgtctttactctgacaactacttttaactgtctacgcggcttatgtaattttgagagagatatggttcatatattccaatatctgggactttcagtcttctattcacaccacatatctataatcatggccttatgacattaattctgtctcatgaaatatttgaactagtaatttagtgaatgaactgaaattaacaatattattaccaatttgactcaaaatctgaattgaatatattacatttccgcatttgaatcaaacagatatggggccttgagtaacgtttaaccagattaaagaaagttgcttactagttgcgtatctttgtcaataaaacatgactttttgttccatacctgtggctttgtgagataagacctcgagctgggggcaccaagaaacgattaggcccctctccttgcacttgtcacggagttcttctgatagcttgtgttcattacaggacctcacgacccaaaggaatggtttaccagaattgcaaaatccattacccagctcatctaactgagttgggtcaagatcagcaacagttccataggaagcatagacaacagagcaagggggctgattatctagccacgccaagcatggtgaagtgctgtcagaaatgttgaacccatagttcttgtttggttgcaagcgatcgtcatccaagtagaaggatggcacggtcgggccaaccgtcttaaaacgccatgctgatgccaagtaatctgcctcctgattaagtaacaacattgcatctatcaaatcttctacgtttttcattgaattgaacactgccatgatttttcagctgaatttgaaacgaacctattcgttgactctatttctctaattgtctcttgggcaaaacaacaaacaggcgaggggcatgagcaggttgactcaccttcggctccaattcttggaaagagttgacgagcacatcgtcggcgtcctccagcccatcgaactggcccaacaccgcctccaggaacggcggatacgactccggcgccttcacgaacgacggcacgtcctccggcccaagctccacgctcagtgtcgaaacatgatttcggcaataataaaagggggtagcgcacgagacctaaaagtggatggaggcggagacaaaggatttagacaggttcaggccctctcaatgagaggtaataccctactcctgtttggggatttgaatccgccgggtgtattatagatctgacgatctagttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatacagcatatgcggtgtgaatcctccaaataacatgatccgggtgatataccaactgctttgtaaaatatgatgagtgatatagcaaaatagctataaagaagcttgaatgctgtgaataaagaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagccataatattggtcaataaaaatgcacacttacgtggcgaaaagcaatgatattgtatctaatcaattgcttaaaaacccaaacagcaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatactcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggcccagtctttgagcatagaaaatagactcatgactatgaatccatgtggaatgtatccggaacaaatccaaattggagatataatcctcacgcttgagttgatgagcccctgagcatatagcttgtccttctatcatagtcaaaattgtctattggcaataactaacgcagtcggcatggagatgaaatgaccaacatgaagacgaaattgctcatcagaagtaacggaagatgtcagtggtagtaaagatgccaccaattaaatgtaatgaagttgcataaccatggaggtgaagaaaccagtcggcaacagtcaggtcagctagcagtgaagatgtaggcgcccaacaacaacgaaagaacagtcggtggtgacagacgatgcagctggtgaagaagatgaagatgcccattagtggcgacataataagccatccatgaaggcgaggataccggtcggtggtgacaaaagcaagccgacggtgaagatgtagacacgcatcaaaggtgatgacgaaatccaccaattatgaagatgaagaaaatagtcggcaatggcaaacgcatccgacggtaatgatgattagcggcaacagagatagccggctatgatgacgaagttgcccatcaacggcagcagagtaggctatgttgaagagacttgacaggatgtttgatgaagataaccatgtcgttgatccagtcaatagtagtgtagcagtccatgataacgatgagatcctctatcggcagttgcatagtaggccaaccgtgaagacgaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttatcgtcgagtagtcattgcttaattgaagatatgtgttgaagatgtccaagtagagatcatgaatgttggagagccacttgttgtagtaaaataacacggcatcgcatgccgagatgtcgagattcacaacaacgtcatggttggtgaagtagtaaaacttgcgaagtagcagcaatagagtttgccggtgccgaagataataaagatgaagtcgctccaccatgatgacaaagtggtattgccataatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcgacggccggccggtgaaaacgtagacgcccaacatcggcagcataataggccagccgtgcaggcggaaacaccagtcgacggcggtcgaggtgaccggtcggtgacgacgtagacgcccaacaacgccggcataataggccagccgtgcaggcggaagcaccagtcggcgacggacgagacggccggtcggtgaagacgtacacgcccaacagcggcggcataaaggccagccgtgcaggcggaaacaccagtcgccgtcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcgaaaacaccagtcggcggcggcgaaggcaagccggtcggtgaagacgtagacgcccaacaatggcggcataaaggccagccgtgcaggcggaaacaccagtcggcagcggcgaaggcaagccagtcggtgaagacgtagacgcccaacaacggcggcataaaggccagccgtgcaggcggaagcaccagtcggcggcggacgaggcggctggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaatggcggtataaaggccagccgtgcaggcggaagcacc

SEQ ID NO: 71706 - DNA, 7927 bp, Oryza sativa
tgaccaagcgttttgagatgtccatgatgggtgaattgaagttcttcctcggccttcaaatcaagcaactcaaggaaggaactttcatttgccaaacaaagtatttaaaggacatgctcaagaagtttggaatggagaatgcgaagccaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctctgaaggagtgtcaccttgtggccatgaagagaattcttagatatgtgcacacacctaatcttggtctttggtatcctaagggagcgagttttgatctcattggttatgccgatgcggattatgccgggtgcaaagtggataggaaaagcacattgggtacttgctaattcttgggtagatcccttgtttcttggtcttccaagaagcaaaaatccgtcgccctatccaccgccgaagcagaatacatttcggcggggaattgttgtgctcaacttctttggataaagcaaaccttaagagactatggcctcaatgtgtccaaaatcccactcctatgtgacaatgagagcgccattaagatagccaataatcccgtccaacattcccgaaccaaacatatagatattcgccaccatttcttgagagaccattccacaagaggcaacatagacatccaacatgtgagaaccgacaaacaattggcggatatcttcaccaagccactagatgaagctaggttttgtgagttgagaagtgaactaaatatcttggattctcggaatgtggcttgatcttttgcatgcatttgtttttatttcctagtataagttgctttccaccttgtgataaattaaacattcaattcatggatgtacactagtcacacttttgtggatattttgaatctatgtgtatggggatctcatttttcaatgaattttggtccttgcacaatttgcaatagattcgtacattccctctttgagggtgaatcatcatgtctcatgataattcactctcatttgatctttggatcatccatttgacttgtggctattgttttgtgtggttgattgtgtactagccattaactaaaatggggcctaaatgttcgactattcctttctctccaacttccatcaaaattttgtgaaaaattgaatctcttcaaattcccggtgcgattcccttaaaaaaattcatttccaaaagtttgcaaaatattttcatcaatattccggcgaaaatcttccctttttggtgcttagatgccaaagggggagaagatctatccttttattatggtcgaacatgagtggtttttatttgtatgagacatgtgtgtttcttaaattagtttaatgctttgtaagacattattgtttaattatgaatgcttgggatgtaatggataatattgtgattgtgatgagcaaaatgtgatatatttattttctcgtgagcttcaatgtggatgcaaagatttagggggagatctctacttgctttaatgcacacttttaggggggcttttactaaatctttgcaccaaaatcatctattatattcattctctcttgtgatctaatcgtattgtcatcaatcaccaaaaagggagagattgaaagtgcatctaggcccttagtgatcgtcaaggttgctacggccccgtcgtcatcttcgtccatgcctccgcgtcgtcaagcgttgcgccggtcgtgtctcgccttcgtccaaagatcaccggcgcaatgtcattcgttcgtctctgtcgttcccgtctgactccgccacgcccgttcgtcgtcgtcgttcccacgcctcatcgcgtggtggtaagggcctgaaagtgcatctaggcccttaatgattttgatgattgattacaatgcgattagagaggactaacacttttattcaagcaaatgtgaaggttgttatgtcctcgacatgttgtaatgagatgcataccacatgaatgcgacatcacgatgcaatgcggcaatgatcagatggtatattgtatcttttaccttacattgtgtcataggaatgtcatactattaagagggataccacatgcatattattggtagaatacaagtgctcaaaatgcttcatctttgtgtgagttgaaaaacctaagtcaaaatttcaatcccgaattgtttcacttgtcacaacacttacaccgggtttctttgcaagtttttcaacatctcttgaaggttttggaccatgttttatgttgggtttgatagcccacgaaactagctttccatagagtccaagatcttcgaaatcggagttcggagtaaaaagttattgcagttttacttgagcaacatcagaatatctgatttgaaatcggactatccgattttttacagaacttcactctctatcttgatttgaaaaaatcctatcgagtgagtttttctaagtatcggagtatccaatgtcggatcacatagtccgatgatacagagactccgaaatttcatagaacttgagtctctgtatgaggatgaagtttttgcttttaaaatatcagatactccgatttaacatcagatagttcgatgtcttggaaagtccaaaatttcatcgaacttcgttctctgtttctcgttgccttggaggtttaaaatatcggactatccgatcttgtatcggactatccgacgtgggctgaaagattcccctccaacggccacatttttgggggggtctataaatatgtcacaccctaaaaatcctaaatatataaattgttgtttaattggaattattagaatttattttaaaagcctagaagagaagatctagttttaattaataaattccaatataaaatggggccagataaaatttcatttaatactttgcttaattctttaattcctagatttttctgggatttatttgaggtaaggaagtatttttaataaatggaattgcatttcatgaataatttaaattggaaaaggttttaaaagttctcttttggctttgggccgaaagtcggcccaaaaccttctctctcactctccccggcccaagccggcccagtccgcccgcagcagccgcgtgcgagcgccctcggacgctgacaggtggggcccgcctgtcaggtcgttgtctacctccggctgcccgccgcccgagccctagcgtcgcgccgccgccatctccatccaaatccggccgcccctttccgtttccgatgaaattaatagaggggaaattatccccgggatcccctctatcttttctcttatggaatcatcggctaatttcgtttggaaatccatggattcgatctcgaatcggattcgtctctctccccgaaccctagaccttccttcgcgtcgccggtcgccgtgggcctccgacgccgcctcctagccgctattaattgacccccaagcccgccgctacccgccgccaccctcgcctttgcccgctgccgtctgtagcgccctagcaccgtgcagccgtgcgccgccgtcgctccggtcgtcgttgctgctcggggaggtcaccgtcgtggtcaccaagtcgtcgccgtaggtcgccggagcatcgccgtaggtcgcagatctcgtccacccctccgtcgtcgccgtccgttgatcttccgccgctgttttggtcaccggtgagttcgccacgtcgccctctacgtgttggtgtcctccgttcgcgtcgtcgcgccattgtccgccggcgagcttgcgcgcccgagccgccgccagtgatgacgtcatcgccgacgtcatcgttgccgtccgtcgtagaccggtcgtagaccgttagatcttggtcgtccgttgtggataggatcgatctcgaccgttcgtttccgtgagccgccgccgtgcacccggtccatcgcgaaccctagccgctgacgcaataattcccttttccttttcaaaaataattcattattgcgtcataattcaattaaaacccatataagtgttttaatccaatttaatctttaaaaattcataactaattcatcttagctcggatttagttggttcaagtctctaaatttttctaaaattgagatctacatgttaaaaatatccacatgtactgttcatgcctgtttatgtgctgttttggtgattttgctcctttctgtctagattccgacgtttccggagagtccgtttttgcaggaaaaaaatttgaagagttccaaggccagcaaggcaagtcacacagatcccatttaaagctattgtttctattcaactattgcatttattttcgaatgccatttggtggaattaacctattgtttgttatagcccttttgttcttgattactttattccttgataccttgggttactataacttgactagttgagctttatatattggttcagctagatatcagatatgattgcttagccatgcttagaaacattagcacactattgggataacttataattcactattatttaatgatggcttaatgatagttcacgatggtcaatcgtgattggttaattaattaaattgccaactaaaacttgataatggtgggttgtgagcacatggttttgatagtcgtgcccatgacaattaaggaccggttcacgattttcggatgtgaaacattaaccgtgccaaccacaagccagcgtgggcaacggctttaccttttgtatagcatggttcattgcggagcaccagactgagaagtggcggagataagcccatgggggttgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacatctctggccagagtaaaactattcgaatagccgtgcccgcggttatgggcgggtctaacaatgtctttcatgattagtctcacacttctcatcataataaaagatgctataactggtaataatttgattagctcctggtttggaatggttaattcctggtttggagatagaactgtgcagccgggatggttgttcagaatggttgggcctatgcaacagggtatgttgtatagcgttggattaatattgtataattattacttaactgttttattaaattctgaaatgtttattaaatgctgtttatgcaaatgaaacccaactatgccatcctttgttattctgtgcacttgcatttttgctgcgtggcttgctgagtatgtcatatactcaccttgcaatgattcatcagaggaggagttctacaatgatgctgatggtgtagaggattaggtgtagccctggtcaagctgcctgtggagtggagtcgtctgcgccgtttatcttatttttccgctgcttagatctttattgattgagaggaactatctacctctgtaatgacattttatttgcttattaattagagtaataattgtactctattatcaatttgttattgtgtgtctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaactaatggcacatgcacttcataatctcttttaatggtcctcattcaaaatttattccagtgttattagtactgtacatctattactgtactaatggctcattttaccagcaaaagttttacaatattgttttatttaatcttgctgcaagaaaataaatttagcatgttgattttataactttcttttatctctgttggaacctgttgttcaaaagtacaaaatttgtgaccttatttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccacaggatttgggactgcccctttttatgcctagattcctcatgatcgtcatgaagagaagtgccgagtcaaagtcactttgaacagtaatagtgaagatatcccctcagtgatgttcgaagctggaggaagaaactacatccatgcatgtcaggaggtagcaaggatcgccataggcgagctccgcgatcgctacagtgatcagttggccgacactgagtatcgctaccattctcgtcaaccccagggaagtgaccgtggcagctaccttgagactgagggaattgagaatgatgctaccacaaggcatttggttgagatgctgtgggctatggatgaaacccgtgcagagactgtgttagcagctcaagatcgtgaagatcggaatcgaggtaagatttgcaagctagaggacaaagtggatcgattggagaaggaactagccgcgttgaagggagaagcaccaccgcagaaggccaggatttgtcttaccgcaaggaagagagctctatttgtccctcgctatcaattggcaccaaaggtccgtgtggtggaaaaagaagttaccccagccctagcggatcctccggtcgtcaacgtaagtgatgatgaagaagaagaatcgaagcgcacccattccaagattgagtggggagcaacttaagatgatgaagacgagccgaacgagccttcaatcaactccgatgctcggaagaactagaatgccttgtcaagccgttgtcttagatcgttgtattagtttgcttgttttaagtttggttgtgtgtgtctcgcatgtgattacatcagtgatgggatgtaagtgcatgcgtttgtttgctttcgagtgttaggtagttggtgagcttagtggtgtgagagtcttcagtttgtaataatgaaactcacttaagaccaataaaagtcaaattaattctctgtcctaagtagtttcccccggtttctcttcttgtgccctgtccatgccagatggtggtcactcgcagcaacgggaatggccccaacaacaacaataacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcctactttctctagtaccactaatcctgttgaagctggcgattggctgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgagttcaccgctgctttccggaagatgcatataccatcgggagtggtgtctctcaagaagaaggaatttaggtcgctcacccagggatcccgctctgttacggagtatctacacgagttcaatcgtctggctcgttatgctccggaagatgtgcgcactgatgaagagcaccaggagaagttcttggaaagacttaatgatgagctttcttacccactcatgactggggattat

SEQ ID NO: 71707 - DNA, 1613 bp, Oryza sativa
aattgaccctttcagggcccctccccccgctgccccgtcctcgtcctttcggagtcgccccgtgcctgttgtgcggttgtcaatcccggtacccgtgtaccggtgtcgatagttgttcgtgtgtgcatgtggtgaccgtgtttgtgtgcccacacggtagccacgtggtttccacgtgtgtagcccgcgtggtgtctagtggagtccgtttgtcggccactcgcctcggttgacataaggggtctgcttccgtcgacccgtggaccgtctctgtgtactcggtccaccgtggtcctttaggttgacatgtggggtccgcatgtcaacagcgtagccttcctgtcttttccaggctagcgctcacacatgttttatagttgcaaagcctaattataataatccgtaattctccatgtaacagcattaaacttcggatgatcatatcttggtcatacgaactgcgaatcgacccgttcaagtctcttaatgtttgttataacctaaagaaccctgtgctttctttttatgtattgttattgcttctttataggcttgtagctttgcttgtgtgcttcgcgtagcttctgtcattctgaggttcccgaagcatggttcgcggtcgtctccgaaggttcggaaggccattctctctgagcaaggcaagtcacatcatccttgagcatattgaatcccaatttataaaattattttgatttaaattattgcattaccgctttatttaaattcccgcgttatcactgttttgtttagcacttgctattaatccttgttatagccttatcattgctattgtttattactaccttattcaccctaggaaaataaaaccccaactagtgggtactctattaatggttccactagtatgaatttaggtatatgcttcgctgattaattaggcaacattaggtggttttataattttagactttgggagctctcatgtcatttggacattatggaatggttggctataacgtcctgaaaattaccgacaataaaaatcactaaaattttgaactttttaaaacttttgcatcatgctggatgttatgattgttattgctcgccaaactataaaattgtcacaatggaaaaattaaactaaatatatatacatctaagtaataatcacaataatacattatttattattaaccacataaatatttatgcacatgatagcaagccaaataaaacacaagtcaattattaatttctataatgtaaattacaaattgtatgttaaatacttgaaccatatcgacaagtgtcatgacatctaagtaattaggaaatagtcaccactacaacgaccctatatataaaggagtgttccactagaataattaaattaatatttataacttttatcgagtccctcatggaataacattgactcacataagataattggtcatgaaaacgaataaagctttatatataaaatacatttatgtgagtgtttaattaagcatttagaccaatattgtaccaagcctcaatttacttttatgacataatagattgaacatgtccatgtaaaatacattgttatacaaataaactcgaccaatgtgctatggtattat

SEQ ID NO: 71708 - DNA, 6570 bp, Oryza sativa
  unsure (1)..(6570): unsure at all n locations
cggtgaagacgtaaccgcccaacaatggcggcataaaggccatccgtgcaggcggaaacaccagtcggcggcgacggaggcaggccggcggtgaaagcgtagacgcccaacagcagcagcataataggctagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggaggcggagacaaatgatttagacaggttcaggccctctcaatgagaggtaataccctactcctgtttggggatttgaatccgccgggtgtattatagatctgacgatctagttgtctcatcgtgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctatactagtcgaataaccattccgtatgggtatggggtacccataatatccacactcagcaaccncggagcgcgccncggtcctgacgggcaacccaacgcgcaccgcccagacctccccgtagatgacgtccacggcgcacggctgcgagaagaatgcgacggcaggcacacaggcgccgcgcgccacgcgccccgcccacgggaggtgcgggtcgtacaccagcacgcgggggggcctccccgcgtcggcctcagagcggagaagggcgcgcagcgtctcggagcccacctccgccagccgccgggtgtactccctggcgtccccgcaggccgccatgccgccgaagtcgaagccgtcggagatgccggcgacgcgaaagggggcgggagggggtggaagggtgaagaggacgtggcgggtggtgacgagcgtggggaggaggccgtggtgcgccgcgaggtggcggccgagctgcaggatcgggttgacgtggccatgcgcctcggggaaagcgaggaggaagatatggccgccgccgccgccgtgttgggtggaggaggaggtggtggtggccggtgcgctctccatctcggctgtttcgttttttcttctctctgtgtcgcccgggaggccgggacatgatgcatagtccaagactagtccatcctaccatttttggtttttcttctagaaaattattttacaaaattgtgttttcttttcagtgttagaaaagacaattttgtaaaataattcttaacattttttagaattataccatctccaaaatatatatttaactatatttttcttattataatatataataaataaataattttttatttttattatagtatttcctaaagcaaatctatatatttttatttagcttatattcttttaaatgtttagagaataaaattagctggaagtttagataaaagaaaatctagatttatttttgattcataatgaaaaaaattgttgcaaaatttacatttagatgtcaaactaaacttacataattattatttgtgccatcttctctagtgtggttcattatttttcacggtctccattgctgcttgaccctcttatctttcccttaatttctattggtgtgtctgctttgaaaggacatgttatgagtttttgattttaaattaaactaaaagctctacatattattatcaaaatcgtcttagcttttttttttcatgcacagttttttacatacaagtgtgctaacctatagaattaattgttgtaaccaatgctaatttaagttgcgttcgatctatctgttttgagatttttgacgcaagcaaaacgagaaatctcattagcataagattaattaagtataaataattataaacttgaaaaataggtttatttgaattttttaaataacttctatatataatttttttgcaaaatgtatcatttaacagtttgaaaagcttgctaacggaaaacgaggaagttgaagtttgaagttgagaaatagaactaggccttaatcatagggacttaaaaagtacaatgtatacttttttttttgactaattttcagattatactaaaattaggtggtggttttgccttttgttttctgaattttgtaaatacagtcatgtgcagcgtgggactgtggattgcttggaaagccttttatatttgggttaattggatccatgccattgcaaatatggtaaattagaaaaatactactgctattcgcgatatctgctgggtgccactggaattttggcaaattaaatccatgccatgccgtcgcattttccgtccttcccccgttaatttcctaactccgtgctgtctttctagttcgccgttgaaagcgtcgccgaactcgacgaccggcgcctctcgggggatggtcgctggcctcgacttcggcctcctcaactcgtcccgcgccggcctactctaccgcagtgccgccgtcaagaccggcacacacgtgtttgcggactcgaggacctcgaccccgccgccttcgagtcgccgtctgccgaggaggacgcggccaagtgcccgcagtctgtcgacgagtttcatgggaggggatgcgtggttgacagctgttggaatgtgatttcctagtttccttgtacacggctcaccttccatttctcctcccgatattgtttccataagtcggtggagagagtatggagggtgatgccctatacatgtaacactctgtgatgtgaatcaaccattgcatcaagcgcccntgtgttggccaaagcgtcgnccatgccagcacgnccgacctcttccgggcagacggcccgacagctccagnccgctcnccagccagcggcccagggacagcaggccgccacctcccggtctgccccagcatcgcctcaaggcccacccgcacgactggcctaggcggcccaagcgtcagctccagaccggcccattcacttgggccggtctccccgacgcacgccatcacaagtccggccgcccattcacgtgggtcggccgcccagctctctgacgcctctcctgccagatcgccaggaccctcccacgcctccacgctcaccctgccaccacatgtcgccatcccgacccggccacggtcggctcgtcttcccggcgtgcctactccaccatccctgctcggtgcgtcacccgtcgtcaacgaccatggcatggtgacccgcggcaagcacggcatccgcaaggtgtcagatcggctcaatctccatgcggcggccctctcaccgattcctcggacatatcgggctgctctcgccgacccacactggcgctctgccatggaagaggagtactctgccctcctctccaaccggacttgggatcttgttccctgtccctcgggcatcaacatcgtcaccggcaagtgaatcttcaagcacaagttccaatctgacggctctctcgatcggtacaaggcacggtgggttcttcggggcttcacgcagcgccccggcatcgatttcgacgagaccttcagcccggtggtgaagcctgccactgttcgcaccgtcctcagcttcgccgtctcctgcgactggccgatccatcagttggacgtcaagaacgccttcttacatagtacacttcaggagacggtctactgcatccaaccacccggcttcgtcgacaccgcccaccccgacatggtgtgccgcctcaacaagtcgttatacggcctcaagcaagcaccccgcgcctggtacagtcggttcgccaccttcctgctgaccctcgggtttgccgaggccaagtccgacacctcattcttcgtccttcggagcggcaccgacaccgtctacctcctactttacgtcgacgacatcgtcctgacggcgtcctccaccaggctccttcagtggaccatctccgcgcttcaatccgagttctccatgaaggacctgggcaccctacaccactttcttggcgtcagcgtaactcggcagccctccggactgctgctcagtcaacgtcagtactgcctcgacattctcgaccgtgccggcatgacagactgcaagccttgtaccactcccgtcgacaccgcctccaagcttccgacggtacaccggtcgcagacccgactgacttccacagcctagtgggggccctccagtacctcaccttcaccagaccgaacatctcctatgccgttcagcaagtgtgcctccacatgcatgatcctcgcgagcctcacctcgccgcgctcaagcggatcctccggtacattcgaggctccctggatatgggcctccacatacagcgatgtcccacgggcgacctcgttgtctactccgacgccgactgggcgggctgccccgacacatggcggtccacctcgggctacgccgtcttcctcggtgacaacctggtgtcctagtcttccaaacgccaggtcacggtgtcttgctccagcgccgaagctgagtaccgtgctgttgccaacgccgtcgctgaggtcacctggctccgtcagctacttcacgagcttcacgcacccccgcccaaggccaccctggtgtactgcgacaacgtgagtgccgtctacctctcctccaacccggtacagcatcaatggaccaagcacgtcgagatcgatcttcacttcgttcgggagaaggtcgccatcggcgccattcgagtcctccatgtacccacatcatcatagtacgccgacatcttcaccaaggggttgccgtctctggtcttcaccgaattccggtccagtctcaacgttcgttagacacgacgctgtgactgcagggggtgttggaatgtgatttcctagtttccttgtacacggctcaccttccatttctcctcctgatattgtttccataagtcggtggagagagtatggaaggttgatgcctatacatgtaacactctgtgatgtgaatcaaccattgcattgagccatactctctctcacaacagcagcttgcgacgcagcagcagcagcacaaagccaccgtgctgcagcccgccgccgcgcgccgacaacgaccaccgccggaacgaaactggcttgttgctgcttgtagacgatgggccacgacggacgacgacttggatgaggttaccacgattgacgatgaggacaaggagacggtgaggatgagcgatgcgatggggacaggaagaggcaccgtacgtgacgggcggcttcaacgagaaccgcatccagcgccaaatccggctgggcttctgctcggtgaatgtcaaccactagatgccgaaacggctgttgttgcttgatgatgtagatcgacgacgaggttgctacttgatgcagcttgacgagggatgcttgtggctggcatgccggcagctaggggacgacggactgggatggaaattggatatgactggttgctgttgcttcaagatgaatgggccgacgactgagaacgatgccggtaagcgccatcccgtcgtgcgcgtcgtccaccacgacggcgccgtaacgggtccgcggcga

SEQ ID NO: 71709 - DNA, 8143 bp, Oryza sativa
ctctgctgtcgcccatgtgcgtgcgtcccgtcgcccccattcgcgcccaatggataaaacggagcctcctgccacagctagagctagaacgcacagactttaggctttaggtacgatgatggagccaggaaaccttaattgagaaggaaatcaagctttatcccgtcatccacctcattgttcttacccaatcgccattagggctctagctcgtccaggcatgtgttggcaatcttatccccaacgtttccttacacgctaagctaagcccccaacaaaatccccatccctctctgccttttcctccaatacatttcgtcgaacaccttgggcgcgtgctgcagcttcttccctgctccaccaccgcgacatcgaacttcgtcgttcctccttccctcggtaattcctcgctcctgtgactcctcctagtcccctagggattaaatcccccatcaatttcgttgattaggtccatagcagtgccaagccgagctccaaagctccacccatggaggtcaccgtggacatgctatcccgggggctctcccttctattttactggaaaaacggaaccctcatgcgccatagatgctcactctctcaccaatttggtcgcaaaccatcccgttcgccgtagctgcttgcagccgagcttggccatggcgttgccgtgccgcaacgctcgcccctgcccctccttgcaccgccgctgccggtggagggccgctagagctcctccgcaaaccccctgtccaccgccgtgccggcctcgcgccgtaccggctgcgctcggccgagcccagccgtgccctgggtgctgcctcccgttcggctggaggtagaagaagggtaggagagagaaacagaaagagagcagccggacccacttgtcattagctccatcctatttccctttagaaaattaatcctgtgaaaaagaaaatcaaagcattgaccccatatgtcatcagctgttagggataaggatatattttggaataaacataaatgaattaggaacagtagcttttcgtaatttctcggattaattcgaaattgaatctttaaactagtataacttgctcattttaactcggatttgagtgaaacttgaacctaaattcatataaattcataatctttccaatggtatataattcactaattaataaaatatatttataattataaaataattaataccaagaaattagatactagttaacttaaaaatgtgctaacaaataaaactaatattttacagtaaagtagatgtaagaatatttgtctccaacatgtcttgtcactgtaacaaatacacaaactaatttaaatgatgtctcatattaatgtatatattaatgtataggaagatagtactatttaatggttgtataattaaacccatgacttacgaattatttacataaattttagcctcatatttagtaactaaaatataaacacataaagatgaatcattaacttgtttaggagaataataacagagctagatgtgaaggaatcaccaaataatttaatcaatgcaataccatatagaatagcatgtatagacctaaattggttaccacttattagtaacccaacagaaccagtgcttaaacttgccccatcacatatataatatcactcatagaaactagctaatgtataatttaactacaatatattcaggaatcacttggggcattgggtagtacactttctaaatggctcatgtacagtaggcgaccaaaaccatatatgttgttgcacacacatataatgtacattccattataactatactattgatttaccttttccatacattaaactggggagtatatgacaaacatgtatattagataaacactaattataaatttcgacctcctgtaattgatcgttacgggaccacaactacaaataatctgtacctataacctcacagatctaacatacaaagcatggataattattaacccttttataatttataatgacaagtaaaatatgatcataattaaaataatgcctcattggaaaaatgataatataaattaatcgatgtaattatttgtttgaccctaaatccatccaacaacagaacctttagtataagaccatttatagatgtatgcgtagtcgtataaccctcccataaccctgtagcttgactaaaccacatattagctgtatgtacctcattcatattatactggttagctcccaaatgaactgccatgacaatagaatgattaagaaatcttagccctagcatgattggaatccattagcaagcacgaataatatgaacaaccctaggttcgacaccatcattatattttgcttgtgcacatttgattgttgtttgaatattggtttttatcgcgtattacagaatttgtatatcggttagtcgtgaggcaacgtatgcagcttccaggaggtgaaggttgatcaagattatatcaagaataagaattatcctgagcaggcaagtcatcaccccatcccttgagcatgttggtcctaattgtgaaactgttttgtttacaaataaaattgcatgcagtgatgcatatcctacttattattatgccatgcctttgattattgcttatctcattattcccttggacccataattacgtatgagtccctagtcacttatgacaaatgcttagtaatgctaatttaggttcatgcattctcatatttatcaaatgctttatgcttaggcaactaccttggggaaggtagttgagacatgagcgccacattgccatgacattgatgagataatttgtgaaagaaagttaaaactaaagaaatgttttcgactgggatggctggaggacttaggtggtgtccggtaaaggctagtgctgtccctggtcagttaaggaccgagccatgaagttaagcatgaaacgacccccgtacaaccgtacttctcgtgtgggtatagacctagcggagtaaatagccgagcggaggtggtacccaagccgtagtggttttcttgttgtgtgtgaggtagggcctacggtggggcagccattggtaggaccgcatggggcgggtgcctacagtggtgtcgccatcggtaggactgccatgtgcaaacctaaacttaactataacttaatgaatgtgtgagtctttccccctcgggagcaccagaactcctctcactgctagaaaccttggacacctagagtgcatgaggactaaagttcatggagcgggtactgccaatgtgaggttattgaaaggctttgccgtggcaagtctcattcgttgagatgtaggctcatgtgttgggcaagtcgcggagtacgggtaaagtgtacatccactgcagtgtgagtaaaccaaatctattcaaatagctgtgctcacggatattgagcaccgtgacatgtattacacttggctagactctgaattcttgaaatgatgggtgggatgttgcatgatgattttgtactggtggaacaacttctcgagaggcgagaaggggtagaccccagaaaaccatgacgaccagtggcgggaagctatccttgggaacacaatggatggtggatagaaccgtcgctgtttaatgaacaatggaactaaaacttgaacagtttatgctaggtcttaggtttgtgaaatgatatttgaaaactcagctttacgcaaagtaaccatagccactctttgtaatacccttacattactgcattttgtgtggtggcttgctgagtacttttgtactcattgttgctctatatatatcttttagcagagtgttgaagagaagcccttgttagtatgcttgcgtacctagcaagatgatcggagtgcggttccattctaggtctcgttccccagtcgactgcttgtggcatgtcaactgtcacgtcctgataaattcatcccgaaataaaaatcattttctaaaaggaataatagaattaattaaaattcgaaaagaaattggcaaacactaaaatgcgtacaagaaaaatttgaatgtggcccggagaatttttgttaaattctccttggtctaaaaggagccctcaaattttacttgaattttcagagcatcggaaataattattaagcaacaaaaacaattatcagagtttattaaaaagaaaaagctaaaaataatcctccttttcttttgggccaagtttggcccaaagttccccccctctctctctcccggcccgcggccaaagtctccctctcctccctctctttttccttccctctctctcttgggccagcccggcccatctccctcccctctccctcctctccccgcggcccactcggcctctccccgcgcgcgcgccgctgacgggcgggcccacccgccaccctcgctgacgggtggggcccacctgtcatccctgtcctcccgccgctcccgccgcctcgcccgtgccctaacgccgccgccgccgcgaatcccgccgcctcccgccgtccacacgcgcaataaagtggggggaaatattccccgtgattccctccctctttccccccatttttccctccctctctccctcggattcgtttggaaacctctcccctaacctcgccggcgccatcaatggcggccggatcttccgcgcccgtttcctcctcgtccggccgctctctcccccttccaaccctatataaaccctccccgcacctcctccgttcgtttccgcctctcgccgctctctctccccgccggaatcgagctcgcgccgtcgctctctctctccgccgtcgccgccgagctccggtccgccgccgttgccgccgagctccggtccgccgccgtcgtcgccccggaccaccttccccctcggcgccgcctccttcggcttcgccgcgtcctcggtgacctcgtccacccctccgtttcactcgccgaccgccggaacgccgccgtccccgtcgacccgagccgcgccgccgccttcctccgctccggctgcctttccgtcgtcgccgtcgacctagggtgagccgtggaccgccgcttcttttcccccttccctccccctctctcggcagccgctccgccgtgcctatggccgccgccggcgaccataggggcgtgggcgcgccgcctcctgccgctgcgccggcgtggtcgccttcgggcgcaccgagcggctgccgcgtggggcccggctatcagccgcccgcgcccttaggtgcggctgacgcgtgggacccacggtgccggccggtgtgagcccgggtgcgcccggtccaccgtgggccgtggggctgccgcgtgggccccacccccgtggacccggtccgcgcgcccctcccctcggctgacgcaataaatccatttttttaaattaaaatttaaatgaagaaattcgcaaatattcatttaaatagcatataaccttcaaatggccataacttggccatttgaactcggaattggaccgttcaagtctctaatttttccttaagaagtcaagaacccatttttgtgctttgttcctgcttgttatatggagtttattagagtaaagccttttcttttccgttggtcgtgtagacgctgcagcttcggaagatccactcttcgtggaggttgaagccgacgtttgggaaagcgagcaaggcaagtcacatcatccttgaacatattgaatcctagtttataaaattattttgatttaaattattgcattatcgctttatttaaattcccgcgttatcactgttttatttagccatgcctatttacctttgttatgaccttgttattattgctattgttattattaccttgttattattaccttgttcaccctaggataaacaaaaccccaactagtgggtaccctattcatggttccactagtatgaatttacgtagatgcttcgctgattaataggacaacattaggtggtttttatagctttagactttgggaattctcacatcatttggacactatggaatggttggcttatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatattattaccccttgtacccccttgcattaatcatgcatctgccggtgtggcttgctgagtactgtggttgtactcattcttgctcaatcttttccccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctagggcacgggcgaggcggcgggagcggcgggaggaaggggatgacgggtgggccccacccgtcagcgagggtggcgggcgggcccgcccgtcagcggcacgctcgcggggaggaggccgaatgggccgcggggaagaggagagagagggggagggatgggccgagccggcccaagagggggagggggaaaaaaggactttttaggatttttctttttataaaatcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttaatttcgggatgaatttatcaggacgtgacacaatggtctgtatatcatggagcagtttcatgactacaagatggctgacaaccgttctgtagtcgaacatgctcatgagatacaaaccatggctaaggaactcgaactccttaagtgtgtcttacccgacaaatttgtggccgagtgcattattgcaaaactacctccatcttggagaggtttcggtactgcactcaaacacaagagacaggaatactccgttgaggggttgatagcatctcttgatgttgaggagaaagctcgggaaaaagatgccgcgtctaagggcgatggtggacagtccactgccaatgttgtgcacaaggcccagaacaagagtaaggggaaatacaaagctcagcagaccaccaacttcaagaagaagaagaacaacaacaatcctaatcaggatgagaggacttgctttgtgtgtggtcaacctggtcatctggccaggaagtgtccacaacgcaaggggatgaa

SEQ ID NO: 71710 - DNA, 15048 bp, Oryza sativa
tagtatttttctaatttaccacatttatagtggcatggatctaattaatcctttatattttgatacttctattgctagttctattccatatgtttttttctctctctaacacatgtaaggcaggcactggaaagttacagaaaaatccagctttcattgatccaatcctacggctgctcttttttttctccatcggtcggtttagctttcattgctgaggtggatcaattgagtgctatttttggattcactgttcacctatggagatttcttctgaaaaatatacttataggctcggacattctctgtatacaattccgtattttcaatagcccaggatttataggcagattagggcttgttcggatcacaggataggaaaaacataagaataggaaaacacaggaataatatagaattgcatatgtaaaacgaaggattgaaaaacatgaagcgtttggaatacatgaatatataaaccataggaattttctaattaatattgatctcatatattatagtataattatagtataattaagcaataaaatattagttcccatctagtcactccaacgtgattagcatcctccctgtggtagctaatgaaaaaaaaatgaggtgtgagtggatgttcataatcctatgaaattcccgcataaaggcctatttgaatcgcaggaatggaaaagcggagtaataggaaaaagtaggattctgacaggaatgcaggtgtaaaacagaggattggaaaatacaggaaaaacacaagaatgaccgtttgattggaccacaggaaaaacgcaggaatcggatgagagagatagactcaaaggaatttttccaagaggttggacctcttgctaactttcctccaaaatctacataggattagccattccataggaattttaaaggatagtataggattcaatcctttgtttcaaaggctttcataggaattttttccataggattgaaatccttcaaatttcctacacttttcctgcaaattaaaggagccctcacagggttgctacagtattcgtaaaaattcctacacgtgcttcctatgaaccgaatgcatgaatatagccaaatccaaaggattcgccaatcctacagaaatcctgtgtaatccctccattccgaacaagcccttaggccctctttgaatcaaaggaaaaaatagaaattctagaggattttatcctatgggaaataatcctatagagttctttgaaataaaggattgtttcctatcaatttgatgaaccctgagttcctctcgacactcaaggctgttgttggcccgatctttcggtgagttgtgataactacgatttgggagaaacgttgacgatccgactacaaccgtacgagacgttgtgttgcgccttagcaatcgatacacctctccgtgggttgctgatcttgccggtgcagatcaaccttattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttagaaagaggactccgagagctttcgatcaagtactcacgggccgaaaacggaggtcgtatgcagattcggtagccgtttgaagtcagcagtgtagtaggtggccgaatcggattctagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaaccaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacatagcccaaagtatttaaagaagatctcaattcacgctcctctacttcattagcaatgtgaacaacatgcttaaaatcagtgcagtataaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctagtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagttaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttttccttttcttttctgttttttttggtgcggcttttttttctttttttttttgcacctttctgccttttttttcacttttttcttgattttttttaacaaaaactgactcaaggaccttaatgtaagattacagggactcaaacataaatataaaatttacagggactcaaatgtaaaagtctaaacccaaaattaaaattatacaaaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcacctttctcctctcgtgcacgacacagacacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggtagcgacgactgtggtacaaaacatgaccagaactcgaaactctaaacgaactagacgctaagaccagcaacacgacgtgacaatgcaacacaaaattcaacaaagcaaaaactgaaaagaacaatgcaatggcacaatatggctaggtaaatgatacgaatttttttttgtatggctattttctggttataggaagataaaaactcaccgagcaatgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgcctaagcgatcgatacacctctccgtgggttgctgatcttgccggtgcagatcaaccctattcctgcaagcaaatcgaagaaacaagtaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgctttttgtgattgcggccaaacgagatagatttccgagatgaggctggatccgttagaaagaggactccgagagcttttcatcaagtactcacgggccgaaaacggaggtcgtatgcagattcggtagccgtttgaagtcagcagtgtagtaggtggccgaatcggattccagcacttggagtacttgatctcgatatcttcttgttcatccatgatgtgagcaatggttgcatccgtggtagccatggtcacatcacaattcctttgaaattcctatggaatgaactttactagagcaactttggaggaaaataagcatgaggtctcacctcatgttttcctcttcaggcccctttgaatcaaaggatttatgtaggaatttcataggattcaaatactataggaaatttttctatttggccctttgattcaaaggattgaagctttccaaatcctatgaaattcctatgaaatgacacattgcatgtggattttggaggaaatttagcaagagctccaacctcttggaaaatttcctttaggtctatctctctcatccgattcctgcgtttttcttgtgctccaatcaaacgatcattcctgtgtttttcctgtattttacaatcctctgttttatacttcaattcctgtcagaatactgtgttttttctattcctccgttttttctaccctacgattcaaaggggcatgtgtctaagattcctgcgtttttcctgtgtgctaatcaaacgacacttggagactttcctgtgttttaaaatcccataggaatccaataagtttggtatttaattcctatgtttttcctatttctctgatttctcaatcctgcgattcaaagggctcttaatatctgtagcattactgctattgattagcattactctgtttttgtactcggggatgctccgttcgtgtattggtgttgccaaaggaagcggagaggaaatgggctccatgacgggcagaaggctgcagagaagggaaaagaggaagcagagaaggggctctccctttctcgcctgcgaacaacacattgccgctgcctcgacctcgaggctggttgattttgactaatactccagtcgttaggcccgatgtgatacctctgtgtaattatgtgcattaggatctaatccctatatcatttatttatcatcacggcaccacactttgtcccccttcttaagccgatttactggcgccctcttagtttagaccataagccgagaaatcaaaaccaacagataatttttttttgtttggcttttataaagctataagtcactcttagactgtgcagcaagggatgggaagtaatccctcccgcacagaaaacgaagtggtccatagcgtgtgattaattaattattatcttttttttaaaaaaaagatcaatatgattttttaagcaacttttgtatagatttttttttcaataaacacaccatttaacaatttgaaaagcgtacgcgtgaaaaataaagagagtgggttcccaactctaggtgcagaagacaaccttacactgttaagaaaaagttaggttgaagtagtttttttttcttatgtgaaatggagataagattttaccattaaacttaaggcttaaaattcattagcttattaaaaaaagacaaaaagtcatcttaaaagcctaaccctaaacaaagaggatatgttctttaagctaaccttttagcttttatcgttcttttttgcttttataattaataattaagcttgtgccctttcttctaaggaaattctgtggctttcaagtctcgagtgtaaggtgaagtcctatccctaattcacaaaattaaaagtaatactcgaacctagatttaatttaggcttaacatggctaaaaaaagattagagtaaatttcacaaaactacatatactttgatcaaactatcataaaactacatatttaagaatgtatttcacaaaactacagatttagagtcaaatatatcacggaactacatatttaaggtattatatcacaaaactattgattcaacaactattttatcacaaaactacacatttaaaaactaatttatcacaaaactacagattttataactttaaataaataatagtgctatgatctaaactctagaatatgtagttctttgataacttcatcattaaatctgtagtcttgtggtatggtgcattaaatctgtaggtagttctgtgaaatgtttgacgctaaatctgtagttttgtgatacacatttttaaatctgtagttttgtgataattggacccaagtatatgtagttttgttaaatttactcaaaagattacaacgaacaaactgactatttgttggggcttaaactttttcgtttagctcatgagcccaaaaaaagggcccatcaaatacggctgttgattttaatagtgcaggagtggtttatagctttgaatataacgaaccaaaatgttgatacaacacgtccaacattacccttaaagtccaattcatgtttcatgccaggttcgtcgtgccgattcctgaagttctcgatctggtgcgttgtgctcgagctcggcctagccaccgtggcccctctccctcccggctctccctcgcgtgcgactcatcggttcccttccttcccttacatcgtcacgccaccgtcgacccagccgttttcttctcatctattgccgatgatgatgcgttgggagaaggcgagaggctaactggagtgcgcaacactcaatccaggggatggagccttgctcgaacggggaacgctcaacctcgactgcgactacgcgagcggtcgattcagcgactcggcgcagcggagcagtgaagcaaaggttcgaggtggcggcgtgcagctctgcaaatggtgcacacatttgcctgtgatgccgtgcctccagcgttgacgataatcccatggcacggtgagggcttgaggtcgatagggcacagttttgctactgggaaagatgattgtggtgttatggtgtagcaagggccagatattcatctccttaatgctggatcgactcatgatctggcctcctgttctctgtccgctgctggcatgccagttacttgcagcctcttctctcttatcagttactggctgtggtcacccctggtactaattgctcgcgaccatctcagccgctaatttcagtttgttagctctgctgactatcggtacggttttgcatccatattgcaagtacaaggaatttcatacgcccctcctgctctgctgagggatcctggcattctgcatttcggtgcagtagtgggatttgagcaatgggaagtgaattaattgttgtttactcttttacttattacacagttattttgtgggtttatattttgcttctttcaaatgaagaatctcttaagtttatgacaaagctagaaactcatgtaagtttcaattttgcaaatgattgtgtgatgaagttcacttggttagttaagatgtacctactgaaggttccatatcatatcccacaagtttgaatgctcatttatactatatgtgttacttgctaaaccatttgtacatttggaaccttacatcccaaaattctttgtttctatttagacatgaacactctttagtttgttgtcaaatcaagtttgcctgataaatgtaacattggtatcggcaagtaaaaaaaagtttgaaactattttaggaggaagttatcctataaatgactttttgcttcattaacataagcagatctttcttggtatctatgcttctaggttcatagtctgtgcaacatataagattctacattgaaacctaattagctcatttctatatagacttgtatatattgtcaccttctattttaagttggataagttaccaatttacaattgattctggactttacctttcaggattcaagctctatttctgagttagaattcaagttgtgtaactatttctgttagaatgaagacatcgagaacacgtttactaatataaatacgctgtaatttaaaatgctcataaaatacatcgattaacctccatgactatctttgtacttaactaactctaaatgggatattaaaaggtcatgatgatttgatctacttttcctcaaggtttgaatgacattgaagttatatataattacagatatgataacatggcatatataatctcattagagctttctaaaacatgccaaatgtttgctgaaatcgtctgcgatattcatgttttgcctacttccctgttggcaatgtgattttcgttgtccagactactcctcaagttccacaagaaatgtgcttcgctttagatgctcttagcagctcttgcatgatcctattatttgctctgtttaaagtactatttaatgttcccctattactagggatgcaggtgggtcgggtaagcccactgacccagcgacccaacccgcgatttatggggccaaaatcatgtgggtcgacccacaaaaattcatgggccaacgtgcgtcgggtcactgtgacccagcaacatagatgggtcgacccatggaattgagtaactagagagtcgctggcttgtagatgcgccgccgtcgccccgctgctgcggcgctccgtccacgccaccatcggccatcgcctacacgcgctccgcctctcgccgtccaccgcctctgcgacaagcctgtaggcagcatgcccttccacgatccatcttctagctgctcctcgtatccctcctcttctccaaagtttaagaaacaaaggggatcgattatctcgatgggttaatcgtcatctgccattcatagttgtgatagcacccatggcaagcctccaggccagcgatgatgtgacgctgtgcgatttccttccgtctaatccatgttgaaactgaacaagatcttgccaagttgccatctaggtcgattcaatgccgcagatggttttcagcatatatatagcatgatgtctaagttcaagctgctgctgttgcttcttcttacttgctttacatatgatcgaaattgcatgcttgattaattagttggcaactgcttccttcattcgattaatttctagctagttcctatgttttgtgctctgcttgctattacgcaaccctcctgctacacgaagcagtacaagagggtcccgtaatgtctataagaattggagacacagagatgtaggggtaagactcttttcctttattcattcacttatgtaatacaatagcacctcctcccctctatatataggcatagccatgagtactttccatatttagtgatggacccaattagtgggcaaccgggctggaccttcatgggccggcggtttcctaacactcccccttgggctctcactgcgtgatgcctatgtctcatcaaaactccacaaaaacccagtgggaaaaatttggagaaagagtacatagcatatgcttgcaacgtcacatgaattgcctcattaaaaaccttgataagaaactgttaggaaaacttatccaagggaaaaagagtacagttcacccaattcttcgttcaatctttctagattgattctaggtacttgaatttctatatcaagattctgaatgagttagcgaaattccccccctgaattttctattcctctaagtctcactattccgatttctcggacacacatattcaagagaagatgtcaataatgagttagtggacaaatctataagacttccacataacttagttcactgcttctatgaaattcatgcgcatagaagagcttggggttcatgtgcttagtgagtttgtttctcacgtaactcattcgcatatatgcaacatatgctgcttttagtttcataagtagtgggggttgagatagtttccaagtcgcgattgctgtcgtgggtaaccatctctcaaaaccatgccgaagctctgaaccgttcaacgatgtttaattcggtttagttcaattagccaagtatttgtgtgctgctatgacacacttgtgtttgggaattccgtcccattttggcgataattgactaatccaaagctatgcaccatgaacatttctaagtgcggttggactgatgtactagacttccatctgtcgcatgcttttagctacaagcgtgagcatgatttgggttcggccaaatatttcaaaattaaactcaaattcaaaacgaacgagtttgcttcttcgattattttttggtttattctttctatgttggttcgggacctagtacttcttcatgtactattatgcaagtgtccgatccaagctcctgaattgcattcattgattctatcttcaatgctcatcaatatttaggttgagttcttcctttcaacttccagttcactaattccattcaactctaagttgactgccaatgagttttgttgtctaaaagagataaaagagacattgcccatgataggtctcattgccaatttctattggttgcatgagactttatgcgagtatccatgaatttatgaggagatgcatttttcatatgcttcttcttcttcttgcttgcttaatacttcttgatgtgggcatgtaccagcgttagcgtgcactccaacagctggttttcttccttgatgggaagttacggtacgcctattctgaggttccgtaccgtttgccagatctcaattggctccccttctattcggtggggtactttttgtgactttgagtatgatagtctctcttgccctattttcaccagacgtctccggttactttaggggtgtgaggagccgaagtttcttgtccaattctttttgttcgaggcctctagacaagatgaggggtacctttactttcttcggtatcaccctcctccggtgcatttcattcatgcaacttagtcaaactcttcgaaatcacaaaagtatttacaaagtgatttggcagttttaattctttatgtaaactgcattcactagtgcggtgtaacatgcattaatcccgaactatcacatttcctgacatttcctatctaggggttcattctctccccctaaatgactggaaataatacttatttgtcaaggaatttaggcttcagaactatctccgtaaaatgttttcgactttcggagagagccttttgcaacgcattatgatattgagatatgcacataaaccaaacagatgcaatagcactagttgcaggatgaatgttcatgccgatggtctgaattttctttcagaatccgctgctttcaggactacatgtccttttctactgcgggtattacaacaatgatattgcaatttatagcttatacttagtccgcctatgcggatatttggtacttcgtgctgccaattcaccaatcatcaaatgtaatgctagcattgtccttgcggacttctgaggatgatttggtgagttctattggagttcacgtgatcttgctggatcagtcttggcaaagacacggtgtctatgagacactggatgtttgctgcttcggaagcgcatatatccatacagtaccaaacgggagccgcagatattcctcgcaatccagttcaggaatgctagaactatatgcggtttatgcactaatctcctgtcggtgcatactggcacacaaatcttcatgatttgggaaaattatgcatatatgtgctataaccatatgagttgtaatatttattcttataattctaagaccgaaaatggctgaaaatccattgctaaaagggtgtagcccaaatcgtcacacttttagaaagttcaacggggttgacggacaatagatgcttctataaagtgcatcatttgttccatagggaatatgaccatggcactttctaggccgacaaattcagttgttgctgctagcaacggtcataatatttccagttctatgggtctggaaatactctttctcttaaagtgttatttgtggttatgcagaccacaattcattgtttttctcttttatgtttggacgctacacaaaattcaaagcattataactatgtgctagaaaggagcgacaaaatagtaaatgccttaaatatgctattttatactggaaataattctctattgcagggaaaatgtgtgctctacttgggcaaggatcatttttcgatgcaatgctctattgaaaaattgcaacaagtgatgacgaagtatattgattcaacgaggtatcctggtacttcggattcaattaacttcatagtgagcttcttgctcgacagctatggcaattatttactatcctgacatcaattttagggccgatccgatatagcataggagattctttgtccatagccatgcaaataggctaggagctctccccctcaattcatgatgagtgttctattaggattgttcttttctttaaatgttcatagttctagattgtttcaccttgacctgtgttctacccctcccctctttcctcttctttcgttgaggtaagtgtaccaggctagctgctcgtgttgtattcgttatcaactgtgctagttggttttggaagacaatgctcttctagtgagcactgtcatgaacattacgcaattccatttatcaactagttaggcatacttcttgtgtgtgcaccagtaatgcttgcgtgcgactttcgtcacgttcgggtagaacatcaagagtttccgcagtattcggtgcaccgtattaccgtactctttgggtcatctgctcagtgaatcatagtcgaaaatgcccactcttgctcatagtccttgctctacgagagatagggtttgcaccataatcttctgagctgcttcttttgtgcagtcaaaagagtacccacacgcttatccatctagcatactcattccatagagcagcttggaggcaccgatgagagattgaagtgcttgatcaatctcgtcgaatcagtaaaataaaacgctaggtttaatgatgtcatggagctgcaaggtccattataatttcgacactgagtgtatatgtcagggatccggcgaacttctagttcgcgatgccagtcatctttggtcaaaaatatgcgcaaattaaatgcaggtaaaatgcacaagtgttgcaatagaatggtacacaaaattcccgcaaataattccagtatatactatgcaattctatacattttatcgcaacgatattaattaaaagtaataaaagcatcacaaataatcaataatcgtaaatgcgataaatttcacaatcatatatatcagcaataaagatacctgtaatgcaaagtcggggtcgaaatccaatgtccatgtctcttttatgcgataatatgattttcggtgatatttgcaaatttcgtaggccttgaggtaaggaaatccctatgcagaagggtaaatgtgtgtttcctcaagttcagggggtttaagtgcaaggtttccaatgcagagaaacatgcacttgatttctgggaaacacaagagccattttgcaaaaccaccggagatcctttcttttttttcttttctttccccttttttttttctttccttaatcttgcttatcctttccttctcttctcccgttgaccatgcaggtgccatgtgtggcacggggctagacggcgct

SEQ ID NO: 71711 - DNA, 4742 bp, Oryza sativa
cctcaagcaaagcggcggcggctgtatcgatgtccgtcatccactcaaaggcctgacggaggtcttggaagacgctggcacttggagagtattggtagtgagtcatagggtttaatgccgcacctacaaatcatgaaacaagatcgatgagagtcgtacaataccaaatttttcattatgtaatgtcggttactcactggcattgattagagtttgattggtgaggtcgtgcattctcctattgacaatttccatgtatgcttcgaatttatccctttcactcgcaaagagactgtcatattccattctcaacaactgatatctcagaagaacctcactcaaattggggttcttgtcctcgtcagcaaatcgaaggaaggagtacatcggctggactgagttgaccacggtctgtaagttctcccaccaagacatgctagataggcatgcgtgcgcatacctgccatccattgtgccactgaatttgctttgcatgaacccagaagaagccatccactgcatgaactgatctcgcctcctaaggaagctctgaaggaacatgtagtttgtgccgaaccgtgtagcattccacttaaccagttcaccacctatagcagacaccatcatggcatgcagcttggaatggttgtatagccatctgcaaattttccttgcactctcaatcaccatttcatggtccggcatttttccaacctccttaagcatcaagttaattgtgtgcgccacacaaggttgccacacaattgttggatactcttggcgcaacagtctgcaggccttcttgtagttagaaccattgtctgtgataatctgaacgacatgttgcgggcctaattcgcgaaccacctttcttatctcctgcatgggtcaaacacaaaataaaacaagacctcaaacactacacttgatgttatcaaatgagactaaagtgttaatggaacgtagttacctttagtacgaagttagcatcttggctatggccggtggcatcaacggagttgtggaaaaacatgattccattgcaatatatcaaaaagttgatgaccgccatacccgccggtcctgtccaagaatcacacattagagtaacaccgtactcattccaatcacgcttgaacctgtcgaattgcttcttgacgtccttctccgtagcatcaaggtacttcccatgaatctccgaaccgcttggggaaggtatgttttcacctacaatgtacaaatacaaataattaatgcttggaacggttagaacaatgtaaattcatatgaaatgcatacttaccccacttctgtgtttctcgaacggcgctgacaaaatatgaattatcagcatttcttgcaggaatacccgaggtgtagaagaaccttgcccaggactcaccaatggcctccctagcttgccttcccttctttgtgaagaatcctgtatcgatgcgtgtctgcacaggagacttggcagatgctagattgtaatctctcacagaaggtgactcctagtgagatgtagcccttcgcaacaaactggcaattgggttgcttcttcctttccgtgcctcggactgagcggatccactgccaccgccatgctcataagtgccacctcgttgctccacacccctcctaaaactcgcctcttgccgtgaggcttccatggctgcttccatttgttcctcctcgtcggcatcacctgataggtcataatagttgaccccagccgcttcaacccttcttgccctctcactctgacgagtatcacctgcatcttttatcctgtccaattcgcgcctgaagaattcgcgaacatctggaggcactgaattgcaatacgtaaccccttttccttttccagccaaatgaattttaagtcgagttgctccaccaccgccctttctttgatgacaatacttacaacgccatccaggtgccatgctctccccgtgctcccacactggatccctactatctgccatatccaccctgtatgtaacatacgcgaaaagtatagtattagaaattaaatcaccaaggccgcatttctatttcactaatgccatacgtataaaaattcgacttacacatagacttacacatagtcgcatatgaaatccaaattacactcaattacaaattacgctcgcacttgtacgctacgttttgttatggacttattttactaccattccactacttttactttttatctgagtgtttcataatttgtagtgataacaaacaagcaagacaattgcattgcgaaatcaaaattacaaaaattcctagctacggtttaccggcgatttgctcgcggtaaccacggtttctacgcggttaccgctcggtatgccgaggttaccgcgccctatagccccctgatgctaaaccctaaagccacggctaccgcttaaaaccgcgcgataaatcgagcaaatcgcgcggttaccgcgcaataccgagcggtaccggaggacttaccgtgggcgggctggcgtcggcggttaccgtctcgtaccgcgcggttaccgtgccctaccgcgcggtatcgtcgctcgccggcgcggtggcggcggatctggggcgcggctggcgtcgccggggcgttggacagagagggagagacagaggagagatggaacgcacggggggacggtagagatggggttagggttagggtcacctcgtttgggcctcaatgggccgtgtgcacagtatcgggctggcccatttttttttctttttccaattttcaagtttttcatccgttttgctctcaaatttaaataaatattgatctttttcgacaaatttcttcaccataaaacactacaaatcaagcactaccgttaccattttttttgattttttttcttttttttttttgaatttttgaattcggatgaaattcggcaaaccgtaccgcgcggtacgggtaaccgtacccccgcggtacggcggtaaccgcgcggttgccggtttttgaatccctgggaacgactcaatctttcactgatatacgggcctcgaggaatactcacgggcccactttcagcccagcccgtaaaagttatagccgaccgtccctccccgaacctgaaactgaaagcaacacgagaccgcaacgaaagcctaaacgcccacgcctcttcagggcctcctctcgcctccgcgcgccattccggaagccctagccacgccgatgccgtcgccgccgccctccggggagctccccctcccccgccggaggctccgcggccaccgccgtccgccgtgacgccgcgatgccccccacccccgccggtgggcgggggcgggggcggccccacccaccaccacgacgccgcctcgcgccctccgacgcggccgcgcgctgcccagggtcggtgcggcgcggggcggggcggggcggggcggcctatataagaaccggatcgcaaccccgcgcgggggtaccacggggagggagagatagagagagggaggctgtttcgcgtgaggaggaggagcgtggatttcggcgactccttccctcttcgttcttcggcgtagttctcccgatatcgtggcggcgagatcgaggggggatttttttgttctctagagatcgaatttgatgctggtgatcgtcgaattctcgccagacccggatttctgcgaggtatgtttacgatcgacaaccgttgctcttgaatttctgtggttttgatttctggcgtgctagattggacttgttcgtcgctctaggtatcaaatccgcagattgatttcgtcggattaatcttgataaaattgcgattatcatcgaattcagcatataagaaaatcgattctccgaacacctgaaaaaaacgaaatcttcttctaaaaataactgatgaatttgacagctaaattagttgtataagcaaaagattttgtgaacaccggaataaaaagaaatcctgctaagaaattattgataaactcaacacctgattttggtgtagcaaaacgattctgcaaacaccaacaaaacggaattcgcaaagaaaattgttgatgaattcgaaaactgagtttggtgtataggaaaaacgattatacgaacacctgaccaaaaccaattctgcaaagaaattactgatcaattcagaactgcatagtttgcaatcttctactccatgtctaggcagttggtgaaagattgttcatttgttactagattcatcaactttttactatgattgatcaacgaaatacgaagaaaacatgaattgccatgtataaacatcaatcgcttactatgattgatctatgaaataagaacaaaggataaattggcatgtataaaaatcaatgagaaaatttaggtcatcaagacatggcatctgtgatttatgtaggttgaatacaattaatatgaagagtttctgtcctttactgttgtttctgatactgttagcttattgatgtttttaatgattggatttaacataaaaagttactgttatttgtatcgaatgtgtataatatgaaagtgttaaaatatcgttgctgtcaatccttgtttctctattgttcattaacacatagaattgggaattaacagtattaattttattgagaaggggaacatgatttatcaaatagtattgctgataatagggttagatccaaacacaatagatatgaagagaaaacagattgaactcaatgcattagttctgttgtgagcaggaactttctga

SEQ ID NO: 71712 - DNA, 8279 bp, Oryza sativa
ttttcccttaattgtgtacttgtttctgcaatgtatttgctggttcctatcttttgcactgaggttgatgaccatgctcactttacgtttgttttgaaggcactgcagctgtagaatggctattcttgaagcactccagcaaacatcgatccctgttactggatcttcttctattgcagtcagtccagaaaactttatcaaatgtttgaagaagttttaccatcattggaaggaagatggatcaaacctttggggatcttcaactgcaattgccattgctactccaccaccttctgatgacatccgatataagaaatcattagccctgagcatgtggttttttaatcgtgagctccctgaaaccataatggttttcacagagaagcagattcatgtcctgtgcaagcagaaaggttgtgatgctcttaaacctttgaagatgcctgtttcaaaagcagtcagcattgaaatcgtgttgcataatttggcaaagggtgacaatggttcttccttaatggatgaaatccttcatgctgtatgttcccactttgaatcaaaaagtgctgttattgggcacttagcaagagagaagcctgaaggtaagattcttgaagtatggtctgagaagttgaacggatcaaggctaaggctttctgatgtgtcaagcggcatctctgatcttctttctgtgaaagatgccacagagattatgtatgttaaaaaggctgcatatttaactgcatcggttatgaagaagtatgtagttccaaagctggagaagattatagctgatgaaatgaaggtacaacattcaaaactcacggatctgatggagaagatattgctttccccaacaaagatagatgtcaaactgaaagcagaaaatgttgatatatgctacccacctatttttcaaagtggaagcaagtatgatctccggcctgctgctgctagtaacaatgataatctgtactatgattctggaagccttattgtgtgtgcgatgggtgcaaagtacagtaactattgctccaatgttgcaaggactttcctgattgattgtgctggggaaaaatgtaatgcatataaggtcctctgccaggcacatgacgctgctattgctgctttggtaccaggtagcaaggctagtgatggttaccaggctgcggtttctttggtgagggataaagctcctgatcttctccccttttttaccaagtcagctgggacaggaattggcattgagttccgtgaaacttggttgtctttgaatgagaaaaatgacaggatactaaaggaagggatggtttttaatgtttcccttggtttccagaatctcccagagaagactggcgattacaagaacaaagaattctctctattgctggctgacagtgttcttgtttgcaaggaaaagccacatgtcttaacagcttttgtctccaaagctgatggtgatgtcttttattcatttgatgaagaaaagacaggttccccttctgtgaaaccatcgttgaatgcaaaagtgatggtcccagaaaaaccagtgccaaaagcagagttgatgctgccgttgaaagaaaacctgcgatcccacagcaggacaccaaaggaggaccttaggaagcagcttcaggcagaaattttacagaagagaactgctgaaattgcaatgaatagtaatgcctccaatcataaattgctggagggacaaggccttagagctatgcgtgaacctgttgcatacaagagcacaagggatattccctgttccaatcggttggagattcaggtggataagcagaatgaggctatcctattaccaatatatggagttattgtccccttccatgtttgtactgtaaaaaaagcagaaatccgtggggatagcaacagaggagtctatgtctgtattacatttaatgtccctggcactgcttccaatctccaagatccctgcctgaagacaaatgcaaatcgcattttcttaaaagcagtcaccttcatttcaaaagacagaaagcatgctgacgaggctattcaattaatgaggattattcaaagaggagtattagaaagagctaagagagctagtttggtcagtcaggaaaggcttcaactatgtgatagaatgactagggacaggattcagttgatggacttgtggatacgcccaacttttgctggtcgtgggcgtaaatcccctggaattttggtgctccatgtcaatggttttcagtattccgcatctaaatctgaaaaaattgaaatcatgttctgcaatgtcaagcatgcgttcttccagccagctgagaaggagatgataactctcctccacttccatctttacaatgatatcatggtgggcaacaagaagactagagatgtgcagttctacattgaagtgatggatactgtagattcagttggtctgaggcgccgaacagcatgggatcctgatgaaattgaagaagagcagcgggaaagggcacggaggagcggaataaacaggcagtttgagctctttgtgaaaagggtcaattccatttggtctcagccaaggtttgagcagctcggcttgcagtttgaaactccatcgcaaaagcttgggttcaatggagtccacggcagaacaacatgctttattgttcctactccaagttgcctggttcaactggttgaatcgccgttccttgtaacttctctgagggaggttgacatcgtatgcctggaaagggtggcgctggggcagaaatccttcgacatggttttcgtgttccaagacctgaagcgagatgttatccgcatagaggtcattccaatgacctccattgatgggattaaagattggctcaatggctgcaacctgaagtactacgaaagcaagctgaacctcagttggcgtaaggtcctgaaggaggttatgaacaataaagagtcagacgagaacaataggtgggagttcttgaacccagatgctagcgactcggactcggagagctcacagacagaagatgatcagtatgaaccatcagatgccgactcatgctctgaatcggatgacgaagacagtgacagtgaatctgtggtggattctggtgaagacgacggtgccatggatggttcagaagatgatggtggtgatgctgccgaatcgtgggatgagatggagcgcaaggcgagggacgccgacatggagatgggcagtgagtcggacagcgaagacgagaggcagcggcgaagggagaaagcactggccaagtctcggtgtcctagtcatccacaggccaagggtgctgcgcacaagaggcagcgaattaactagttctcagataatggaagtttagcttgttcttgtggcactttattatgcatctgtcgctttttacctgtcgttagtttcggtggtgaacttttgatatgttcttctaggtactttgcataagtacattactttgtcagcataagtgactcgaagaatgttcagttttctattatagcaacattatctcgttttactgcacatggtactttttattgtggccaaattacttgagcaactcgttttgtccattgatttgcacatggatagtcgggattagggttaatgctcgttactgtctcctctgctatgacggaggatctcgttccccttataccaagaatattcttgatggtagaagcattggagctgtgtgtggagttattggtgcatagcatgacttcatccattagggtttaaattctgatgccctagaatgttacgtatatgtaagcgggcttttaatatgttttagtgagattggatctgttgctagttttcgtcttcttaagcagttttcaataggctttaatgagattagatatgtcgctagttttttgtcttcttaagcgcatattaaatgagattaagatgtgtcgatttgaacatatgttgtttggggaaaaatggatgtgttagtgtggtgttgtgtgtatagtgtgcgtgggtgtgtctttgctatataatcagaaaaagaattattgttgatagctaaagaatttcagttttgatctaacttatgaacgacaccattgccttttgcaatttgactaaacataagttttttttttaaaaaaaaacaggaactggaaacaggagcttccattaatcacaggctcaattctctttttattttgaattgcagtagactcctgcgcaagttttaggacaggatgaagtcgaacaggaagtaaaatgagaagacataaacgatcgtatctgcctaaacagagcagttaggactccgatccaactcttcgtttgtgtagtaaatgccgcttctagacagtagcatctgtttccaggaagattggagtcattcaagttgtgctgctctatccagaaccacaccaaacagctatcgccttagggtgtgtttccacgtcaaaattgaaagtttgactaaaattagaagcttgaagaaaaaagttaaaagtttatatgtgtaggaaagttttgatgtgatggaaaagttgaaagtttgaagaaaaagttagaaactaaacaaggagttagtctagagatccttcgcaccataaatcaccatccaccttttatgaactcccatgtttcaagacattaaggctgtgtttagatccagaggtgtaaagttttgacgtgtcacatcggatatacggacacacatttgaagtattaaaacatagactaataacaatacaaattacggaatccgtctgtaaactgcgagacgaatttattaagcctaattaatccgtcattagcaaatgttactgtagcacaacattgtcagatcatgaagcaattaggcttaaaagattcgtctcacaatttatacgcaatctgtgtaattagttattttttttcatttatatttaatactctatgcatgtgtccaaacatttgatgagacagggtgaaaaattttgccagacgatctaaacatgtcctaacatttagagttggttcggtttacggttaggtggatgagatatggtcatcttcttttttgttgtatgaatcgatctattttcttttttcttgtattctctccgtccccaaaaccctaacttttatgggtggatttggacgagtgtttgtccagatttacttctaagttgttatttttcaatgatggaaaagtaagtctcagctgatgggggtattcattttttaataggccttgacatcattgaaaaataacttgaagagcaatacttttgttaagaaaaggacagtttaccaacgttcttacaaggatcacacccccaaccctagcacctcacgcgcacctttttaagtaaaaagagggacctagatgacgtcttcatggaaagaagcgacgaaagcactaccgccgctgtccaccaaaggtctcaaaagagaaccgagattgggttttcacctagctgccccactagaggcggagatggcacggcaacgctctcaggaaggagagacgctcgaacatcatcattgccagccctaccaaggccaggctgggctttcacctgccgcctaccgcctgcctatccacaactgacgcaccatttctccatcgccatctaaattttttcaacgtgtgagcaccactgcaccgatgccccccgccggtcagcctccaccgccgcaggcttgccaagcggctgctttcccgcgcctccctccagccacctgctaccttcgctacaagagtcgcacgtccttgcgaccttcagccttctttgccaccggccactgctttcgtgagcctctgccagaccgcgtctccagggtcgcgccaccgcgagctcatcctctcccgattccggctattccgggcttgccagggcggccattttgggcgctgcctcccacgccgaggagaagctccaccgccgccttccgggccagcccctcgggctccgctggtagtgaagcggctagagggacgaaggtggtggtgcgggctgctagggtttctcccccgagccgccctcgtgagagcgacacaagggacctctactaatgctacacgtaaagtgcaaaattcaaacacataatatgggcgtaagagaaatacaatatctttgcctaatgtgtggtacaaaagaaagtatgaacaagaagaacgtcacacaagtgaaaacggcgcatcatctccttgtcatatactacaaaggatgtgcaccatggtggcggccttgggtgcaatagagccagcctcaaccccctgcagaatgggaacacaagtgtggtgggaaagaaaaacaaaagaatcttccaccttgaaagagacaaaactttaattgtaaattcttccaatattttcctacaagtaaattattttttgtgaaattcgcacacattaccccctgttgtttagcaaccacagttgcaaattatcgattccccaaataagattagccactgtcagttattatagcaaagctgcttgtggtcacacatattgactgcagacaactcaatttctctcatagtaagatttgccagcatgagtttttagttaggaacaactgcttttggtcacagattaacaagggaaatatttacatctccagtgagtaaaatcgttggtttctgtctgttctattattacctaaattattctgtacaatatgatactgttcatgacaatggcttgacatctttgacagaacgaccacatagggggttatcttctatcccaacgctggacatggcgtacttgatgatcaccgtcttcagttcaactattcaacactcttctaaggacgtcggcgttccacccgaatacagaatcagaagagctgtcaacacgtccaaggaaaaggtgtcacctggagattcagatattgatacagaatcttcaacaaacttacagaattcatctgtcatcagagggtacccaacgaaatgttcagtgcaattagatatgtaaatgaaaatatgcacctggggatcgagatctcgtgattgaatatcctatcggagattggaggaatatggtcttttttctcattggcgaagttgatgatctggaaaaggacttcctggatcagcaaccccagcgcagcacgcttggagctggcctcttccaacgctttccctgaggggaaatgtcaacagaaattagtttgccgatgatttgctatatacatgtgaaataatacaatcctgaagaatgagctgtaagaaaaaaaacctcgaatacttgttgatgctttggagctacgtgattttccatgtcctttagggcttatgacatgcaaattgatgaaccactgttcccagtaaatcctctcagttttgctggtgaaccagcttgggtttttgttcttttcgtcaaagaaggacaggcagacctaatatattgaactcccccagtattaaaaccaaataacgcaaatgtgtaaacggcagagtataatgattatgaatatcaaacaaacctggcttcttcgatttggatgcttctccacccaagcaatgaactggttgatcttttcatccacctccttttctaagtcaggaagtccgcattgaacctgggggcagaagcatgcagaaagaacaagattatttgtttggaaccaagtccagcaaacgtcatcagatcataattccttaaattggaaaccttgcaaaattgtttgcaacatcaaatagacagatgaaatgggctgtaacatggttcttcaagaaagaaaacagtactcacataggtgatctcaaagagatcgcagtcaacatctttaggccgaacaagagtaagagttcggtggaagaagatcgtatgtaaaatgcctgcaacatattcatacataacatcactaccaacatagcgtggacagacataagaataacacatctggatggaagctcaacttgaaaaaagtaatgaaatcaggaaaacaacatctaagttgcgactaattagattcttgaaccatatatcatgttatgtcacagaagtgctgcagatagaataattagatccagatataacattgcattatggaatacagccagatccccatctctccctctaccatcatagacacttcacacaagatgcttctttataattagggatggactaatcttaatggttgtaatccttattccactaccacctgctagtattcaccatggtcgatgcttcctttgattcactgaaaaagggacttttttctttttttgcaatatacgactccgaaccaaacaatcactagtttgtccctaaaagaaaaaaaaaatctgaattttcgatctcaag

SEQ ID NO: 71713 - DNA, 854 bp, Oryza sativa
atgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattaggtcaatatagtgaaacaaaacaagcatgtccgccgcaagtttctcgtcatttggatcattttgcatgacatccaaacggataccaattacttaagcaaaaagtaacaatataggttgtgttatcatatatcactttataaaaatttataacaaaattagacacacaacataaaaaataaagcttgcgcgattttgttctttacggttaaattaacagtttaatcccatgtcgacttactttattttataaaaaacgaaggctattttctatcatattcttactcatgcaagtcatccaaggccatctccacacccaaggtcatctttgctggtgttctgaattttaatgaaattaattgagacattgaaaacaagataaggttttcttaaaaaaaaatcaaaccaacaccttgaaaatgcaccagtcaagcacaagtggcagccaatagctagcatgtggtctggcaacgagcaacttgccaacgatgcaaaagctcagtgacgactcatggcttagcacatcctggcgaagcattatatggcagcaggagaacaaccagcgatgtacatagtgtagatggatggccaaagggtgctcaccagcaaccatcgcacatgaaaaaacgctataggaccgaaattatcttcaatattagaagctctaactgctcgatcggaaggatgaa

SEQ ID NO: 71714 - DNA, 6582 bp, Oryza sativa
aactattcattattccccacgagggccattagctgagtgcttgtgctagtcgggattcaattatcacatctactttggtattctccatgagggataattactcggatcagaagccactcagatgagatatgcatgatctacatcacccaagatatttatcactcggggtcatattaattgtcgtgttctatacgtcatatttaagggtatcggtagacatactttaggtctaggcctaatatgtctgcagcccatatttttaggtgtggcctgtcacgttcttttagggacttaggcattttttgcttaggcaaaagtgcacgtgattatatgcccaataccttcaaatccttttataccgcagttactcaactttttaggagttggtgtaatgcattttaaaaggtgccaaccagtaaagctttaaataactgcccgctgacttttttatatagtcaggcggctgttttgttttatcaagcaattgataggatacaatattgttgctttttgccatgtaagtgtgcatttttattgaccaatattatggcttaggctgattatatatttggtcattttccaagcagtagatatatcacttggatcatgttattcgtggattcacaccgcatatgctattaatattaagttacttggttgactataattataaaaaccgctcggttggttggattatttactccttgactatatgtttagtttgttcaactaatcacatagtcgtgggctacacctattaggtgcatctagtcgatgcacctaagtctatattcaatttttttcagccctccacagtcttcagatttggtaaaagtactcgggagaccattgcaaagatgattgaagcactcggctttagagtaatctggttcaagagaagattatcttttcgactgtgaaggtctcaggggctactgtggagattataggtaccccatacccacacggcatggttatccgactagttataggggataacttatatctatggaatatgtaacagatcatgacttgggtattacgtttccttgtatattatggaacggcctaaagtcctgatttgataatattgtaaagtagatttaggaaactgataccatattagttaatgtttctatcctatataaggtgggcaggaggccctgtaggtggcagatgacacaacctgatcgtcagatcaatatacacccggcggattcaaatccccaaacaggagtagagtattacctctcattgagagggcctgaacctgtctaaatcctttgtctccgtatccatccacttttaggtctcgtgcgctaccccttttattatgaattcatgttgatattttagagtagaaggttgtcatcgcaatcataccgaacccccatcgacacatctcggtcgtttatgcatcccattattccctcattgataagtacaattttataacaattgctatatatatgtatttaattatgtagtgttgtgctagtaagatcattttggtgtcgtgctagtaagatcattttatcgattggtaaagctttttatcgcgatcggcatcattgagtgttagagatggaatgcatcactgctcagctgaaaaacgttgggtttgttatagggtaaagcaaatggcaaacacctcaggtcaaccagaatgttagcagttcataagcttatctggtgcatgtattgctatctctttttctcctgatggggacatcctcaatatatccttcatatgctttgatcaaaattttctcacgttggctaattgatctttatttatttttctggtggtttgtttctttatttacaactatcaaagatttctcttcttttttctttcctcacggaaaagctaggttcaacccatggaccagagtggataaaattcatagtactctctccgtattttaatgtatgacgccgttgactttttaatcaacgtttgaccattcgtcttatttaatttttttatgcaaatataaaaatacttatgtcatgcttaaagaatatttgatgataaatgaagtcacaataaaataaatgataattacattaatttttttgaataagacgaaaggttaaacgtttatcgaaaagtcaacggcgtcatacattgaaataccggagggagtagtttgttaggtgatcgagctgctcttgcaggttgcagcaggccttggctcatgcgtgtgtaggcgcgtgaatcatgatttgtaatctagaagggcagcatgaccgcgtgagaccgaccgtgcgtgcatgactaaaaatctagaagcacaacgacttcgctatttcggcatgtgtcgcacgattatttggccctccactcaaccaatgatatatatgtgatttttttgttggatgatttccatcgagcatttatctgctagggggaaaaggacacgtgatccaatcggcagcggcaaacaagccgacttgagattaatagataagaagcactagggataggaggatggggcaaatgaaatatatattgcttgggtattatagaggtttgttttacattggttgacaatgaaatactccctccatcctaaaatatttgacgccgttgatttttttaaacatatttgactgttcgtcttattcgaaaaatttaagtaattattaattcttttcctatcatttgattcattgttaaatatactttaatgtatatatatagttttatatatttcacaaaagtttttgaataagacgaacgattaaacatgtttaaaaagtcaacggcgtcaaacatttagggaaggaaggagtatgtatatttggcagtggtagcatggtttatactggggaagagagagggagagagagtgatatagttcgagagattttaattgatcatgagcagctagagggatgagtcctctactgtgaaagagagcgtgaggtgatctggattgtcaaagaatgaaactaataagcaaagcaaaatatttctgttgaatacgcattatatttggatctatgtgtcacaccctaaaaatcctaattatataaattgttgtttaaatggaattattagaatctattttaaaagcctagaagagaagatctaattttaattaataaattccaatataaaatggggccaaataaaattttattaaatactttgcttaattctataattcctagatttttctgggatttatttgagctaaggaagtatttttaataaatggaattgcatttcatgaataatttaaattgaaaaatgtttttaaaagtcttcttttgtctttgggccgaaagtcggcccaaaaccgctctctctcctcctcggcccaagtccagctgcagccgccctcgcgcgcgctcgctgccgctgacaggtgggcccacctgtcaggcccgtcgtctacctccggccgccgccgcccgaaaccctagcgccgcgccgccatcgtctccttccaaattcggccgcgtctttccgtttccggtgaaatcaattggggggaaacaatcttccggatctcctctaccttttctcttttggaatcatcgtctatctcgctttggaagttcgtggattcgaggtcgaatcggatcggtctctttcctccgaacctcgaggtttccttcgcgtcgccggtcgccgtgggcctttgccgccgcgccctagcccctttataaggacccccggtgtctcctctcttcgctgccaccctcgccttcgtctctcgccgtcggaagcgccctagcgccgtgcaacctcgagctgccgtcgtcaccgcagctccagccgtgcgccgccgccgttccagccgtcgccgtcgctcggggaggtcgccatcgtggtcgccaaatcgttgccgtcctcctccgtcccttcgccgtcactgaagatcgccggagcaccgtcgccgtcctcaagccgaagaccgtcgccgcttcttcctcgacgccgccgccgtccgttcatcttccgccgacgttttggtcatcggtgagttcgccacgtcgcgctctacgtcctggtgccctccgttcgcgtcctcgcgccgtcgttcgccggcgagcttgcgcgaccgagccgccgagccgccgccggtggtgacgtcgtcgctgacgtcatcgtggccgtctgccgtgagccgccgtagacccgatcgatctcggccgttcgttttggataggatcgatctcggccgttcgttcccgtgaaccgctgccgtgcgcccggtccaccgcaaaccctagccgctgacgcaataaatccctttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgacgtttccggagagtccgttttcgcaggagaagaatttaaagggttccaaggccagcaaggcaagtcacacagatcccaaacaaccctttgagcatgttgatcccgtttaaatctattgtttctattcaactattgcatttattttcgaatgtcattgggtggaattaacctattgtttgttatagccctttttgttcttgattactttattccttgataccttgggtcattataacttgactagttgggctatatatattggttcagctagatattagatatgattgcttagccatgcttaaaaacattagcacactattaggataacttatgactcactattatttaatgatggcttaatgatagttcacgatggtcaatcgtgaatggttaattaattacttgccaactaaaacttgataatggtgggttgtgagcacatggttttgagagtcgtgctcatgacaattaaggaccggttcacgagtttcggttgtgaaacattaacagtgccaaccacaagccagcgtgggcaacggctttaccttttgtatagcatggctcattgcagagcaccagactgagaagtggcggagataagcccacaggggtcgctggggagtccatgccttgtttataagggggtgattatgatccaggaatggtgcgctgtagtggattgtgttgtgcgaggggtattgtcacagctcctttccgaggtaccgtggtggtattgaggcacatggtgacatgatgtggggctgtgtattgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttgtcatgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaaacaataaagatctaagcagcgaaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaatatttcagaatttaataaaacagttaagtattaaacaatattaatccaacgctacacagcataccctgttgtataggcccaaccattctgaacaaccatcccagctgcacagttctatctccaaaccaggaatataccattccaaaccaggagctaatcaaattattaccagttatagcatcatttactatggtgagaagggtgagactaatcgcgaaagacattgttagacccgcccataaccgcgggcatggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaaaataaagccgttgcccacgctggcttgtggttggcacggttaatgtttcacaaccgaaactcgtgaaccggtccttaat

SEQ ID NO: 71715 - DNA, 5018 bp, Oryza sativa
cactgagatgtatttgactgagaagttacaaatttgtgattcattgtttggatctgtgatgtatttgagtaatttcttaggatattgtgatgtatttgatttgtgtgtacaagtaactttatgatttgtgttgtggatttggtgatatgaatttgggatgttagtttgatttggggattgatttggggatttgcctacttgattcgggagaaaataaaaaggaaaaaagaaaaagaaaaagggatcagctgtactgcccgctattgtcaccaaccgggactaaagatcccagtcccggttggtaccaccaaccgggactaaagatacatctttagtcctggttatttcaaccgggactaaagatgtcctctttagtcccggatccttactcccggttggaaaaccgggattaaagggtgttcccaactgggagtaaagatggtttctccaccagtgagacctcgggtcaacccggcccgacccacctgcatccctacctattaccatccataacatggcattaattaagacacaaatcaaaacttggaaaatctttttttagttggattatatttagcaaccgcagaagtcaaaatcacaattcagaacatggaaacttctctctgtttttttttttggcttgggattcaagcatagattagtctgaaaacgttctttgtgagctggtatgattgagggagcatctagcagtggattttaactgataattccgtggctcgatgtaatcaaataggtttagtgagtgctgtacatttttaatgtgtatgcgtcctctatgctccattcagctaaatgtgcattgtaccttcatctgatatgatttattctcttggaaggtattgttatgaatgcagataagtggaaccttctttaaagagtaattagtgcaaccctattataaacgtcaaatctgatgactccttttgtcttattcatgcaaaaaggattggttgctaccatatatggtgctcaggtatgtcaaaactataggtgtatatttcttcctaatatgtggagtagatttttggctatctagcaaccttgtggctatgctttctcatgttatgctatactaagcagagtttaagatgtatcactttatacccactttgaaaatttgtaaacttgatgtcagtccttgcctcttaaattaagggataagaggaagaaatcagggccgactgttatttttgtttaccaatttttcctgtatctgcaagtggaaaagcatttcactgtcttttcagagttcatgaaagaactggctatctaaattgttgtggtatctgaacttattaggtgatttttttttaatcttgtagtattcagggtttatttctgatcatcatgtaacatcgaaattcaacttatgtagcagcccgtgctagaatgaagtcctttcaaacttaacatttatcaatataagtacatatacatgttctgacttgtgatacttttgaccaataaagtaattattaaatctatcgattaaccactattactatgtttggatttatatgattctgaatgctgtcatgacatggtttgatttttcttcaggcttggattatagcgttgttacatagatatgacagtgcaatttatatttttgcctatttcgttggtatcatttgctctgctttaggttctcctcaacattcaattatacccgttcctgatttacattgctctcaacaaatggtagggcgcagcgaagcgcgcctaaagttctagtttatttagtgagtagagaaaatattgtggtccacaccaccggagagccttatctctctcgtagggatggcaattgtgcccgtttgcccgtttacccgcgggtaaaaaccctattagggttgggtttgttctccattttatacccatgggtatcttattgggtcaaaagctatgcccgatgggtaaataggcatgggtatgggtaatcactacccatgtccgctttgcccgtttacccgcgaaatctaacttacatgtaggctaggagcaaaatccactagaatacataagccaggttctttgttttctacggtttctcttttatttcccttattatttctctcctcttactctatcgccgccagaggagagacacgacaccgaggcggagaatatttgatattttaagttcgattcgaatttagtagcttgtagactttttgttccactgcttttcttgtggcgggtaaacgggcacgcccccgagcataagacacccgcgggcaatgggcatgggcaaccatccttacccgtcatgtagtaatgggtatacccacgggcacaaataatctcacgggcatgggtatgggtaggcactacccgtgcccgtcgcgcccgattgccatccctactctctcgttgtctcgtttactctctctctctcctgcctttatccatctctctgtgtcgccggcgagatccaccgcacctctctcctgtctttctccgactctctctatgtcccggccagatccaccatggctccacgccgtcgttgctgctgccgttgatccgtcctctctctccttgttgctgctggatggtgcttcctcgatggcgcagttcagtgacaagccgattggagcaacctcgctcctcctcatttggatccagccaccggcacggccacatcaccggttcctctgccgctctatctcctccatctccctgtgctcgcccttcccaacgagggcacggcgactcgaagtgacggcggcggcgactcagtcttctcctcctgccatcggcaactacctcaacgggcaatgacgggcgacctggccgatagaaccatcggcgtcgaggtcgggggacgctagatctagtcacctccgacctccatggtgacgtgctgatctctactctactttcccccggtggcttggccggtggatccatcagtgtgtaggtcagagacgggcggatctgggaggtgagatggtgacgccgccccctctcgttcatccttccacaccaaaagcaggagcagtatctggtaatgataatgaattactcttgtgattttttgatgttaattcatgattttttttctttttatattgaggatttgcatgtgttgttcatatggtaaaataaggatatggagattattgtttgttgttcatatattcatcttcaatttggggatttggggcattgtattggggaatctggggctttcaaagactcaatgaacaaaatcgatttatctttctcgctgggttttctacccgattggattttatatccatctttgaatttgtgctttatctgtcttacaggatgtgttacgggagcgtgtgggaaaagaggccatagctcaatcggacttgcagacgagaattggtgtgacgaacggaaagttatcaattttttaagtagttaagataatatttataatcgtacttactattgtatgtacggagtacttatgtacatacggagttctttttccagcccataggaaggtactaatttttagaaatagtatatctaatctaatggtctaaaatattgggtccactgatttaagtgaaaatcgacggtgagagtggacagtgtcatgtggtgttatagaagtatttataggaacgccacgtgacggtttaagagcgtttgtagaaagtttaatagatttttagatagatagatagatagatagatagatagatagatagaaatgatggactcatacgtgccacttgtttagaataactgatacaaatatatatcatatatgctgctttgtaattagtaaccatggactatatagttatatggatgaggagtttggaactggaaccagcttatacattcaacttgagagcatgtatacctaatataagtagtacttacgtacgtacaacaattatgtatttcaaatatcgattaggtactacgagttcggaagagagtatgccgaccaaaagaactatttagtcgggctctgaggctgcgatggctctggcatgacttgacgtactctgacaaaccgtggcagggatcaaacctcccatgtgatgaaacagacaagcaactcttcagggcctccactatcatcatcttaggaaatggaggcaaggtcaaattcttgcatgacaggtggctcgagggcaaagcaccaaaagatacagccccatctttattccagattgcatccaggaaaaatagaatggtcgctaaagaactcgccgacaaccgctggcttcgtcagatgcggagaatgaacactacggtccaagtcagagagttcatcgctctctggcaactcatccattagattcacttacagaatggcgtagaggactcactttcatagagatggaccacgaatggctgctactcagctagctctgcttacaggatccaattcctagggggcatccaggacagcagatcaaacttcttctggaaagccaagacagaaaacaaatgcaaattcttcggatggctcatgattcacatgaaaatcctcacggctgataaactacagctacgggggtgggataacagtgagatttgccccctttgcggcattgaaccagagacggcatttatgcttgctcctgcttgttgctgttctcacttcgtaaagattgggtgctcttccttcgggctgtgagtccctagcgactcctctttgtggcccgtatgtaaattgacccttttctgctccttcttatatgcaattggtagagccccagacgttttcccctcgaaaaaaagaatagtacggagtactagataagaaaaagataagggagacgaatgacaccttttttttttaaaaaaaaacgatggattaaaacctgacgtctacctccaaacatagtaaaaaaagccggaccggtaagtgacccggccgacctctcggttcagcggtccgccggtccgaccggtgacccgggcggtcgaaccgcggttcacaaagtacatgtatattacatattcactcatatacacatgtcgttggatgccctgat

SEQ ID NO: 71716 - DNA, 6154 bp, Oryza sativa
atcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttttttattcgctctcatgcaaaatgatctatgcataaaaatttcgctcttattcgattcccttatttgagtcttttattgctttatttaaatttggatttgagcatgcattgatcctacccctttgtcttctctagatggccggtcacccacccaaccaccgcggagaaggcatgatcaactttgtggcagagttggcacgcatgacactggtggtgggctaccccaacgcgccagagtacacgacgattccaccgctcagtggcgagcttcctcaccgtgttcgcttggaggtccacggctacgtgggtacctgcctagctaacatggtggttgaggcatccggaggctcaacagatcacgcctgtcaggaggcagcatacctgatgatggctagactacgggagcgccacaactacatcttccacgacacggcgtaccgatttcaccctcgtcgagccagtggtgatgatatcagtaccttccgtccgacagccggcgagaacgacaccacctttagtcacatgtgtgctgtgatgaggggattggataggatgcactcggacctgcacaaggcgaccaaggccttgaacgatgggaagctcatgaggatcgtcactctgaaggacgagatagcgcgcctgaagagggagaatgctcagttaaagggtcttcccgcgccaggaggagtccggatccgcactacgcccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccagaggtccagccagtggcaccggaagttggttgtctgctactcccagtggcagccgcgatctcagtagcagcagctccagtggctcacagtcaggcagcggcgagacttacctgccaggctccgggagtcgctcagaggtaccgggtgacgagcaggaggacgccttcgactccaccgaccgaaggagccgttccgagcattaggctcgttttccattagtttatcgactgtctagcttctgcttgttagtttgtgtgtttaggttgcttgtttggggtcagtcgacggtcgatatcatgtgcctatgatatggctgtcttaataaggatttttgcttgctctttaagtgttttaattcagagcagaacaattgcagtttaaattcctatgtaataaagcttagtttctgagcatctgtttttcttcttctccccgtatgcttttcctccagatggtctacaccaggaatggtagccgcgcgacaggcgagggcagcaacggcgaagagcgcactgatggggcgcatccccacagcgattctggcaatggtccgccaccacttcccgagaatccgacgctagcccaagtaatggcacatcagacccagatgatggcagccatgatgcagcagatgcagcagcagcaccagcagatgcaccagcggatgctgcagcacgccgaacagcagcatcaacagtttggtccccctccccctcagtccaagttgcctgagttcctgcgtgtcaggccacccaccttttccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgtaggtgccagatggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggaaaagttcatggcgggtctggatgacgagctgaccaaccaactgatatctggggactacgctgattttgagaggctggtggacaaggcaatccgtcaggaggatcaacgcaacaagatggacaggaagaggaaggccgcacagttcagggcacctcagggaagtcaccagaggccgcgcttcactcccggacagcagggtggacctaccaccatgatcgtccgccagtaccgcccgttcaatcctagcaactttcctcagggcgccagtggcagtcagaaccaccatggaggtcagcccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgctgggccaaggtttatccaggctcgtgtcaaccacgcatctgcggaggaggcacaagcagcaccagaggttgtactgggtacgtttcctgttaactcaatccctgcaacagtactttttgattctggtgcaacgcattcgtttcatttcaaagaagtttgtcgggatgcatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcatcgattgtgcgaatcacacagtcaccttgaccaacgagaagggagaaaccgtggtgtacaaatcactagtctcaccaaagcaaggggtctctttgaatcagattgagacggaaatcccagtcgacaccgtggagaaaaacttgaggaaattggaatatatacccatagtctgcgagtatccagaagtgttccccgaagacctcactaccatgccacccaagagagagattgaattccggattgacttggcaccgggaaccgctccaatttacaagagaccgtacagaatggcagccaacgaattagcagaggtcaagaagcaggttgatgagcagctgcagaaagggtacattcgaccaagtacttcaccttggggtgctccggtcatttttgtggagaaaaaggataagacgaagaggatgtgcgttgattattgcgcactcaacgaggtcaccatcaagaacaaatatcccttgctgcgaatcgatgatttgtttgatcaactgaaaggagctgaagtgttttctaagatagacctgcgatcaggctaccaccagttgagaattcaggaagaggatattccaaagacggccttcaccactcggtacgggctatatgagtgcacggttatgtctttcggacttaccaacgcacccgcattcttcatgaatctgatgaacaaagtattcatggaatttctggacaagtttgttgtggtgttcatcgacgacattcttatctactcaaaatccgaagaagaacatgagcaacatctccgtttggtactcgagaagttgaaggagcaccagctatacgccaagttcagcaagtgtgacttctggttgacggaagtcaaatttctgggccatgtcattacagctcagggtgtggcagttgatccgtcgaacgtagagtcagttaccaaaaggaccccaccgaagaccgtgtcgcagattcgaagttttcttggacttgcgggatattaccgccgattcattgaaaacttctccagaatcgcccgacccatgacttagttacttaagaaagatgagaagtttaaatggacagctgagtgcgataagagtattgaggagctcaagaagaaattagtatccgcaccagttttgattctgcccgaccagatgaaagacttccaagtctattgcgatgcatcccgccacggacttggatgtgtcctaatgcaagagggcagggtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacatggttttgtagccgctctggaggcacggcctacgctcgtggatcaagtcagagcagctcaagtaaatgattctgaaatagcagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccaatgagtgaaggcagagcaccaaagaccagcaggtttactccaacctcttcaaatcccggaatggaaatgggaggagattggaatggacattataacgggactgccccggacatcgtcaggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaaaaattggggacccgtttaaatttcagcacggcctatcacccgcaaactgatggtcagaccgagcgggtcaatcaaatcttggaagatatgttgagagcttgcgctcttgattttggtggagcttgggacaaaaatttgccatatgcggaattctcgtacaacaacagctaccaggccagtctacagatggcaccgtttgaagctttatacggccggaagtgccgcacacctctcttctgggatcagacaggcgagcgtcaactgttcggaacagaggtattagcggaagcagaagagaaagtcagaatcatcagggaaaggttgaggattgcccagtctcgacagaagagctacgcggataaccgtcgaaggaagctcacttttgaggcaggagattacgtgtatcttcgtgtcactccgctccggggagtacaccgttttcagacgaaaggcaagttggcaccacgattcgtgggaccatacaaaatcctggaacgaaggggggaagttgcttatcagttagaacttccatccaacatgatcggcatccatgacgtgttccacgtgtcccaattaaagaagtgctaaagggtacctgaagaacaggctgattcggaacacattgatatccaggaggatctaacatacgtggaaaagccggttcgtatacttgataccagtgaaaggagaaccagaaacaaggtcacccgattttgccgagttcagtggagtcatcattcagaagaggaagcaacctg

SEQ ID NO: 71717 - DNA, 17085 bp, Oryza sativa
atgggagggggcacggggaggggagccatgggaggggtccccgcaggggcctgtggcatgtagttctccatggaggagagctcgcgcgaaggcagatggtggccaccggcgagagctgatggtgatggagggaggaagaagatgagaggagggtaatttggtccgagatagtattttagcgtgtaaccatgtgttgaaagtggcattttaacgaagcccactcccagcatggcatttgggcgaaacccactttttgaggatggcacaatgtcaattttctccctccaaacgggatatatatgtgtggcggccaacaaacggatggcacacgcaaaatctcctggatatatatggccaggaaacacaatcacgaattcacgatctggaaactgggagtgttggtggctcgatcttgctccagcagtgtatagcttcaaactaaagcagggtttctcagatgctccgccagttgctgccgccaagactccatgagtgcgtcgtcaaaggtacccagaacccgcacttggttgagggaaactggatgctttagcccagaaagctgcagtaacgacccatcatggcagtggatcttcagcagctctagcttctgcattgcttcttcgtcaaatattacatgtaagttggacctgcaaacaatctcaaggtgctgaagtttgctgaaaagatgagcccgaaattggaggacaccatcttgattctgcttgacatgaaggcgtagagttcgcagacttgatacgctcccgaggagcagtacgttctgtgtgaatagtgtagtattcatctctaggcacaacttccttaggttcctaagatttttgaacctccgagccgataacatctccacatgcccatacagcttaaggctccgcacgctggaaggaggggagatgtcatcccaacaaacaacatgtttctccttgtccagctgcagtgacaaggattccaagttcttgtgattgatgatggcatggcacagatgtttgctgtttttccggttgatgcctgacacttcgagcttcctcatctgtttaagacggtagatgtcagccagaatggcctgtccgcttgaagaattgatgtggacggcaccaagcgtgtgcagggccttcaggtgatggatcccgtctctaggcatcttgacgccttgacaaggtccaacaggtccaccacgtctcaggaacttgggcaagtaggacgacgccacactagcgcatgagctgatactcgatgcctcgtaagccaagcctttaccaccatccatccatggcgccgtggtgcctgcacgaatgtactgcagctcatgtagcgtctgcagcgcaatgtagacaactgaggtgtgcctgatatccagagtctggagatacttgaggccagacaaggaatccgggagatgagtgatttctcggtgccctctcagtgagagaaacctgaggcgaggaagcagctccaagatccgcttgagttcatcgtcaccaaaaccaacatgagtagtgccctctagatccagcacccggaccgatttcatcttgtaagggacgaagagggacttccaagctccgtatactgtcaaagactggagatgcgacacgtccaggtcctcgtagtacacatactcctcgtctcttttccagctgctcccaatgactaggtgttgtcccatgacttccgtggttaggctgcgactcccatccaacacagagactaccaatggaaagaaaaccactctctcttccatgagtcgtgagttgatgtactcatggaagaagctattgaaccgccactcgggcattgtatctgtctccttggcaagcctgtcgaagagctcgcccgtgtaatcctccatggttttgctgtcagtgcacttggagtagccctccgcgatccaccgccgcacaaaatggctccgccggattctcttcacttggaacactgccagatacaggatgcatggcttgatggagtgcggtaaagcctcaaaactaaaatgcatccagctgaacagatcccgcaagctaacaaactcggggttggtctccagctcgtgcataaagttgtctttaagatggctcaacttcctttgccgtatgtcctcttgctcggaggccacatatctagctaaagccattattacttctggaattccaccgcacttggctaagatatattttgcttcctccagcgtgtgtgcatcccttaatgttccaacccctcgaaattcctgttttacaataatttaaaagctatcagaagatatttttgtgatgttaaagtaagaaacgtataaaaattttgctatatatttgtcgataaatttttttctaaaaatttaacaggtataaatatagtacaatctgttaacatcgaaatttggcaaaatagactcggatttggagttagatatcgaagcggaatcaaaggagattaaatcttgccaaaacagattgcgcatcggctagcagtatatcggctgaaaacagagtcggaatctaattgagccgatatggcaagtagccgatacggcttgacttaggctcggtttgggctacgattgagattaaccgttattgccatttagagaaaaagctcgtttaaggcaattgtatctattaattaggatatttatgtcggtttgagttagagatgtggtaagagtccgccatgtggacttgtttgtattttatctttaggaaagttttgagtcgtgtctataatcggcaagttttgtactcgggatataaatataaacccctgaccattgtcatgcaggagacaatcaaatcaatacaactttcggcacgttgccacccttttcttttactttttgttgagttcttgcttaatgccggggcatcggctgcgatctctcgacaagaggtaatttgtctcgatgtcttgcgctatcggggctattatgtcgatttagatttattagtccttttaccgtggccattgctattacgtatcttagttaatccagtctcagcatctcaatttagtcttatccatcgatttccgctttagggtttatgccggtatcagctaaattgttttactatattagagctaaggtatctaccattcttaaaagtggttaattccttaattatttagactttatgtttctttgcatactttgtgatgcatcctctctagccatttttagaatcataaaaactaacctgaaattaatcataattaagtacagtattagggtttcagccgatcttatctaatatacatgatagcgcatgtttcatgatatgtttatgtatatttgccacttatatagataggttgctttatataaatacatcaagctagattgatctctcttaagtttcatatctagtgatcgattgctttttgatatgtttatatagattagtttattaggataagtttgtattggagtattagctaatacattatctatatttgctctaaatactgatctatcggctatttctttaatactgtcctaaaatgattgatgcaaacctaagagatagtattatagctgatagggcatgtttagggttttgctttggattgactatcataaagccgcagccgattaggtttacccatattggccctatcggctatcgttaatctaattatgttttctctttcttgttgattgcaagatcaaaccagctggcacacttttgacacttgaggcaagccttggacttgcactggagttagcaaatctcttaggctgtcgtgttttccgtcaacacaatcgtagtgtaactacaatgtatcttgaatataacttttacatagttttgaacaattagatttgtttaaagaatcgtgtaagtgagatagcgaggaaggaaaaaaatctcacaacacacatacatgtgggggattcggttccatgatatacgttttatgaaaaagacatgttatgaagggatgtataaaagttatatacaagttacgatgtaattacatcacgtttgtattataattatatttgttagaatttttaaaagtacatttgacgacaaatgtgtagacagtcccaacagataacacaaacactcaagattggggatgtcaatggttctttagaatatttccatatggtcattcagtaatgacatgccaagtcataccatatattgacggtagatgggtatatagttggccatatgggctgccctgcacggcacggcccaggcccggtcatgcctgggccaagacatgtcgggccgtgccgggccatgtcgtgccggcccacgtgctccacctgtggcccaggcacagcctaataagggtcaggccatgctaggccagcacgaaggcacaggcagcccatcgtgctttcatagaaataagtctattccccctccctcctttttgtgttgtgacatatataaagctaaaataagtctatttacgtccctattctttggaccatgccatataatacgtctatttgtcctccctatttttttgccctgacttacatatggttgaaaataagtctatttcacgtccctgaagttcgtgctgtgccgggccaccccaacagtctgatgggggtatagctagttgataaactcttcctcttcctattatttattttaatctgaatttaaaatatttctaaattgtactcttacatgaaatcttttctccattatatttactcttctatatgaattttaagtatttctaaatagtatttctacaaggaccctttctcttaatattaatactatttattgttaatttgaattatatattttctattgcatttctacatgaacttttatctcaatgttgatttttttaaagcgaagttaaattattgttttctaagttgtatttctatatggacttcattttatttttttatttttctctgaatttcaggtatttaaattatatgtctacttcaaatgttttttattaatgcgagaaatttttaggtcgtgagagcgaacatggtggttcattttctgttactttattaagttattaatagacattacttttagtagtatagtactctatgtgtttcaaacgataagtcgtttctcttttttcttagtcaaactttttctggtttgatcaagtttatagaaaaattagtaatatctataaacgaaattagtttcattaaatttaacattaaatatgttttgataatatgtttgttttgtgatattactatatttttctgcaaacttgatcaaacttaaaataaaattaactaaaaaaatcaaaacaattataatattaaattatgcaatatggagggagaactttctttgtcagcacgtattgtgtgctatggacaaatatttggcgtgcctcaccgggagaattatatagggtgtcacttagggtgtataaaaaaactaattacagaatctgtcagtaaaccgcgagacgaatttattaagcctaattaatttatcattagtgaatgtttactatagcaccacattatcaaatcgtagagcaattagtcttaaaagattcgtctcgcaaattagtcgcaatctgtgtaattagttattttttagtctatatttaataatttatgtaggtgtttaaatgttcgatgtgacatcgcgaaaaattttaagatgggatctaaacatgccacagtgtaaaaggagtaattaatgagtagggggtcacacacctgtttgaaaatctcgagggctgcctcagatcctagagcgttgactctgtgtactgcggcatcgtcttgcacggcacaatatttggcgacgttttcttctgcagtaacgacaaggatgcaacacttagaggatccatcaatcaacgactttatcgagtcccactgttccctggaccgcaggccatcgatcactataaggcatcgagaattctgcagaaactctctacactcttggatgatattttcctctggttttggattcatgggcatgtacgcatactctccttgtgattgttcgaacatatacgagtgcattcttcgacagaagtcgctaaaattgaatggataggacacatcgacccagccataccaatcaaatggggatgtcggattactcgcttggcgtcgcctgacggttcttactagaaccgatttcccaagaccaggaaaaccccatacagagatcacatgagatctgtcgctatggcgtgctgaagaaatcaggttagagagtttctcctcatccgagctgcacccaacaaggtgaacttcgttggacatttccaataaggaaggtccaccagccaccatgccaacttcgacacgttcaaaagcctacaaattaataaggatagagagtgatcaattgcatgcttgatccatgagagaataaccaatcatgctcgaatttacggctcacacttgcttggttatttcaacacggaattccttacggtacaatgattctacactaaaattcagcacaacaaacattgaattattagtacgatatatccaaatatatggaacatgcataacgaattggccttctgacatttaggaattaaaatttgtataatgttttgagccccactatggtgcggaaactcttttaatcacccggatgaacatccacctgtttattccatattaactaaatggttatgaaaagaattggcaagatagatcaatatgtaatatatcactccacgaacgtgtaggttaaattcaacttctacaaattgtagcaaagatccatcttccactacggtgttctctactagtagtagaaagtaatttgaactgttgatttaatttgatcaaagggtttaaatttatttatattaacacccaagttaacggtagtagaaatgttgaaggggtattattgaaaaaaaaaaggtacggagcggtataatcatcatttagcattgactaaaccttttttcttctattttggatttttcccatggaatatgagcaatgccagcgcaatggataatcatagatagatttagccaaaaaaaacataaataacagttactcctaatcgtattatttgtaaattactaatttaccctaataatactgctagtatatataatactactagtagagagcactggagtaacgctccatctacaactgggaatcttactctagagtttagatgtgtgtagaaaaaggccgttgcattgtacctcgtggaaaaagacacagatggagtcattgtctgataatttcttgagctccaatacttggtagtgttgccccgcgcacaatctggcaatctcgagttgctgtgtagacacgactatacggctcccatgcttaccgtctggtagatatgtccggacggcgtgccactctgccatgttggacaggtcttctaggacgatcaggtatttatgcttgttgagttccttcacaaactccttcacgagattggtgccttgggccgcgtccatccccgtcagaacatcgataccggtgatttctccttgttgttctttccatgtgtttcgatagaactgatgccccaagcttcggatgaactcctgggggttgaagggatgtgctagcttcaaccaggcacgagctctgaacttttggcatatttctggcttttcgtaggcctccttgatgacggatgtcatcccaccaagaccgcctccggttccccacagtgatatcactcgaagggcatcactgttctcggtgaccagcatggtgagatcaacgaagcctggctgcttcttcgcgttgcaccatgcctcggtgaggacgcccactgccgatgtgccgacggcagaggcggcggacgccaagtgtcgcggcatggcggcgggcttggagccggagtcgttgatgaggctgtagcgtatgttccgattgctgacctcctcgacccgggccttgagcagctcaatctcggcaacggcttggtccagtggcgatgctgcttccgacttgcagctgcacgatgccagcaagcggagacacatggtccagaacgacctatttgtgtccaggaggaggatggatttgatgcagtcctcggcgtcataagacagatcacggacctggctgacccacgtcctcaccacattgttcttgatccgttcccaatcggcggtcttgaggaaggactgcatcatctcgaactcatccttcatgaacacagtatcacgttgcacgatctgccacagctcctcttcctccttgatggtgctcttgaccttgtttacaagtgcctcaaccatcgtcttggagatcccaatggcaaggtctgccattgctctctgcctctctctgtctctcaagttttgttcgttggtgtggtggaagctgaggattgtgatccaacccagcaattggagtaggattataaagagaagattggctaagcaacagctagcttagatttgttttttttttttaaaaaaagacttgactgacttgtggttaggcttggggtcctaatgtataacaaacaaatttatgttttagacttacactctttaaattttgccaattgcccttaagctaatgaatcgtatagaaggacgagatggcacctcattaattcatagcaatacagcaagcacatgcaataacttaatgaggcagcagggacaaactgattgcacatgctgtcacatgggggtaggtaatatggcaatttcacagaaatacacaattacactctacgaccgcttaaacaaactggaagagtacatttgattgcagtgatattggggccaggaatggacttgcaattcggatcctctgctgtggaggagaaaattcagaggtagctacagtgcccggcattagaagaactgtgaagcgtccgatagaagatggatggatcagatgagacgttacagtaaatctgctacagtactaaacagcggtgctacagtacattcatccccgtagctacagtaaagcgcgactgtgctgtgcattagaacactgttccctcacatattactgtagctaaaagtgaccctctgcattactgcagaggatccgaatccatggacttggagaggtgtgtggcactggaaaattcaaataaatacccagcgtagacttgggaacgaaagcttaggtaccggctagccgcctccattggcaatttggcagcagcgataaatccagcgttgtccgcatacagaattattgcactaaacatcatccaaggatacaactgatatttctcatccgacttgtggttcgttgacgtgttgtgcggagcatgataatagaatcaaaagagagaaattaaaccaacgagatcgagatgggtaaatgattgcaaaagacaaaatatatatcaaaacttttaagtataaaaaatgaacaaaatcgcaccaaattgaaaaagaccggcctacaacaaacccgaaataagaaaatagattgcttaaaaactacggagacttcccacaactatttacttgatctcgtaagctttttattaaaaaaataaaagaaattcgctcttgagtgcaaactagaaagagaggaaaagtataaaccctactttatatgaacatattcacggttcataacaaatttgtttacaaagtgcatccacactatttatcactaatctcatgaggtacactctctagcctctagatgagggagaaaaagtataaaccctaattttcctctctattaagcctcaataatagatcatggtaagtgtcattaatagatcatgagtgtgaaataagaattgaaaaagcatatcgtattgatcagcatcatctattatatactaaaggaaaaagtacgaattacccccctaaactataacggtcgactggattaccctcctcaacaacaaaaccagacatttaacacccttaattttctaaaccggacaaataacccccctcggtgctgtacaaggtgggtttagtcctatatggcgtccacgtggcaatgtattaatccagtcagcaacatctcaataaaatgaatattctaaaattaggtggtcccacatgtcatgctcttcccgtcttccactttcccctctcttcgtctcgtgcagcgcagacagaaagcgacggcggcggtggcgctctccagggcgggcgggggaagcggcggcgtccagggcggcgaccgcgccctccagggcggatgggggaagctacggcttccagggcgggcgggggaagcggtggcggtgacggcaccctccaggtcgggcgggggcagcggcggcgccctgcaaggcgggcgggggaagcggcagcggcgacggagccctctaggacaggtgggcaaagcggcaggggcaacggcggcggtcgctgacgccgtcgcggtcttcttccccttcgtcgggaagctcacgtacgtcctctctaccggcgacgtcgtcgttgactgctcgccatctgccgttggggacggggcgacagcgacgcgcgggcgctgtcagccgccgagaggcacgatgtcccggcgttcttgcggctcgtgcccagcctggaggcccccgagctccccacgccgttgctcgccgtgcaggtgacgcggttcgtcggcggcggggacgggggtggcgttgccgtgcaacacgccgtgccggacggccaaagcttctggcggttcatggacgagtggtctgcgccggccctcggccagccatctgccccggcgccggtgtttgaccggtcggcgatcgtgcaccccatggccgctgtcatggctcagcgcatcctccggaaggtgacaccagagctaccactggtaatctcatttttgtatgtgcgcatgtgcatttttgatgaaaattcattaagtcatctgatttttagcgtgttctacaaattttcatcgaaatttgtagctcctcaccgcgaatttgttgaggcgaacatggcaacaccacgacacgaccacgctagagctcgagcgccaccgcatcgccgatatcaagaacctcatcgtggagctcgacgaggccaccacatcccccgggcaggtgcggcgaacggcggcggcggccgcagcaacagatcggcggcgtccccccgattccccctcccatccgcgcccatcgtcggccagagccaccaaaccgtgcccgcagttgctcgcccagtgacgcccaacaccaacgtcagagaagggacagagaacaaggggttaatatgacatgtgggccctatattattttattttattttattgctgattggatttccacgtcgacgtcacgtgtatgccacgcaggaccaaaaccgttccggattgagtcaggggggtaattcgtccggtttcaatagtttgaggtttaatatgtctggttttgtggttcgggagggcaattcatactgtcgcaaaagttcaggggtgtaattcgtactttttcctatactaaaagtccattaaacttcctacaaacgctctcaaaccgccacgtggcacacctacaaacgctcctgggttgccacatggcactatctgatcttaccgtcgattttcactattagattagatttgttattaaaagaactaaagtatacgtacacatgatatatatccacacctatgtacgttaaacacaaacaaagcttacctactgttccaaaaagaagaaaaatagtacacgcgtacttacggaaagaaaaatataaagtaggaaatacatatgtgatatgtacctctaacagcaatgaaaaagatcaacgacaaaataagattttctacaattaataaaatatattgattttataaaaatcaatgatcttaaaaataatattttctaccgttaataaaatatattactttacaaatttacgtaaatatacaccgttaaactagatatataatataaatataaagtattcaatcaacactgtttaaacgttcagattattttaaaattatatatccacatagcactatctattctcaccattaattttcatctaaattggtggctccaatattatagaccattagatttattagttaaaaagtaatacattcatcatgtatccgtataaaaaatatatccgcatgtacgcattattaaagaaaccaataaaacatacctactctttgcacaagaagaaaaaaataacagacgcgtacttactaaaaaacgatagagcaaaagaatttaggcacgtctaatacgcgtgggaaaaaatcgatgggctttaaactagaatttattttctacgattaataaaatgtatttctctacaaatttagcaaatatacacagttaaactagatctataaatataaatataaaatatcgaatcaactctctttgcacgttgtcttagaaattattttaaaattatatatccacgtatctctatatagtctcaccttgattttcacttaaatattattaaaaagtaatattttcctcctatatacatatacatgagaaatatatccgcatgcaaatttaattagcttaactgctgttcacgggaagaaaaaacatatgcgtacatctaacatatacctgtggaaaataatcaacggtctttaaaattggattttctacaattgataaaatatatcaatttacacatataagcaaatatacgtagttaaactagatctataatataaatatacaatattcactcaacactctttaaacatcctatattttaaattattttaaaattatctatccaaattatgatcctgttttattttttttgttaactgtacatttgatgtttatggtcctaaagacgtcacaacacatgagaccgacatgtaataataatattatgatatgtatttaaataatttccatcatattttagggtgttaaatatcatttcacgaatataaaacactaatttaaatctacatatgtaaaaccaatcaaaacaacacaatttttttcatgcagattttcaaagtttttttttttggattttttacaactatttgattgcatttgagaagtgagcaatatagatgtgtaaatattatcaaaatattttcaaccaatgaacttgctgtgtaatagagccccttaatccatcgtgagatttatgcccatacatgtatgtattttctctgtgccaaatagttttgataacaaataaacaatcacgtaccatgtgcaattaagtacttatcatatattttgttatagttgaggaagtcctccatgtcagttattacccaaaacatgtctaaaatgaagtcaaagaatttttcaaaaatatcatcacacataaacatttataagaaaaattcaagcaaacattaaacaaggtacattaaacaaggtccattaaacttcctacgaacactctcaggccttcacgtggctcctacaaactctcctaagccatcacgtggcactgataaattagaaaaatctaagaaattccaaggaaaaaaaaggaaaacatcctaccattgattttcacttgatatggtggacccataattttacaccattagatctatgtatgttaaacaaaaatgtcacctacatccacacctctcccacctctcctcatacttacgtacacccaaattaagtacgtctccccagccctgtcttcttccttccatttatactagcaaaatttttatatataaaaacgcagtaactaaataattagaatatcttgtaatatattctattttaatttgaactatatttaccatatattggcgtgtacatatataagaaatatatcatttgacataatcccttttatatcacaactaaatagtaataaaatatttaaaaaataacatatatcatgccaacgtgaatgatctattatgtctcctgctcactttcttatccatattttctatagccagcagctcaatacgtaaacaataaaaaatgctatatattaaaagttcattaaacttcctacaaacgctctcaaactatcacatggtgttctacaaacactcctaagatgccacatgacactcaaataaactaaaaaaaatataaattacgataaaaaaatcaaaccattgatttttctttaaataggtgaacccaataattataactactacatcgcacataaataaatctggtactcccacctccacccctaccgtatgtgacacgcacgtgtgtatgtactccctccaccgtcctactctcctataggatgcaactctcatctcctattttagctaacacataatatataaaaaataatagctaaatgataatgactctcaagttacatgtacttttctcagtttatttgatttactgtgctatttataattaaatacataattcaagaaccacaatgcatatatttactatataaaagttaaataatatggttgttctgactacaaatatttgagcaaaatagcacttcgaaaacaactaatgaattcaaatatgtgagtctaatgtccaagttcaatcactaccaataaacttgaaactatcatgcatactctgggcctgaacccgacgaaggcggagctacaagacattattagcgaggtggacatcgacggcagaggcaacatcgacttccacaagttcataggcctaatagcacgttagatgattaggtgaagggcaaggactgagaggaggaccagagggagacgtgacgttccatgtcttcgatcatctctaccaccgagcctcaccacataatgtccaatacattaagagaggctcactcatgaggaggtggacaatgatccgcgaggctaatggtgaaaagcgaatcactacaaagagttcgtaattaaatttagaaaaaaaacaagcaattagattaaaatatatattaaaaaaacattaaaactaaagaaaatataacaagattccatatagaatataaaatatgaagagtccatttatacttgcataagttataaatatttgaaatttagaataataaaataagttttaaaaaaagagtccaaatacaacacgtacgagaacaagtacaatttaaaatccctagaaaagacaatttagaataagaatcacacaataactaaattaaaaatacaacaaataatttaaaaataatttttatatctttattgattcacatgcataaccaattgcatatatatgaagcaattaaagagagacctagcaggatggtaaaaaaaaaccagtttgttgagatttcttcacgaaaaataccttactttaatttcaatttgttttgttagaactattttcgaaataaactaatgtgcatgcccgcgcgaatgcgcgggctgtcttcctagttttactaatagcacttaaaaatggtttttccttcattttttcactgccaacggaaaaagaaaacgccacaaaaaatgcaccataggcacctagttgtggattgtctcgatttttactggtggaagccttaataggaccacttgtaaaaaagatcatatttttataggttgccctcttaatagaccgccagcaaaaatcactaaggccttataaaatactccagtgacacccctctccctcacccgttctcctcatactcactctcatcctctccactccttctccctcttcactctctcccctagcaatccatgggacaatggcgggatggtaacggtggccgatctccactcgtcccccctccactctctccgccaacagctccattaggcggcagccgaatagtgacgacagggcatctccaggctgcactagcaatggtgggccagccacttgatgggaacgacaacggctgccatcgatgtcgccagatctggcagcggcagacttcggggccactagcagatggcaggcctcggcggatggcgatggcaggccagcctcttgctggcaatgtcagcggttggctggcctttcaacagtggatctcgcggtcgccagatctagcggcgatagactttggggccaccggatctagcaccagcgggcctcaacagacggcgatggtgcccaatctccactcattctccccctccattctctccaccaacagctccgtgaggtagtgggctagctttgagctattgaagtgttactcttcggatgtgacggagcttggggctcctcaccgggagaccgcgcaggcccctctttgccggttcggccgggggcgctaagtgaggttcttcgccctcgatctgaggaatgtcagcgagaagaatcgcacaagacacgggcgacgtagacaggttcgggccgctgagaagcgtaataccctactcctgtgttctggtggatctgtgtgtgaaggaatacagctcgagagaaccagagagagctcaggctctagaaccaagtggccagagtccagccccctctcctaggcctgggcctcctttttatgtggtcaggggtcaccacatgggcctctagctgcctaagaaaggaaacatgctttttacaatgagggctagtctacagccggaagtgacctctgacaagcactgcacacgccttctgctccgctcgtaagctctcccggtggacgcccgtttcaaccttcattcaatggccagcgactttcttgccatgcttgcgctgaagcctagaatggatctgaccgggactgacataccaactccaggagtcagcacgccagctccggctagagacgagagctaggaaactctcatcattccgacgggacggggcgaggcgtgcgacaggccgcctgttgccacctaacccgcgatctgaccggtctgtgaccggtcacataccgcgactggtcacggaccggataagcgtgcgctgcgccgcattaaatgcggcgtggcgcgctcgtccaacccgctataaatgcggttaggtgagccccgctaggctcacctattgtaacatcctaaaaattcccaacaataaaaatcactaaaatttcgaactttttaaaactttttgcatcatgctggatgttatggttgcttttacttgccaaactataaattgtcacaatggaaaattaaactaaagttatacagctaagtaataattataataataagatatttattatgaaccccataaatatttacgcacgagaaaacaaagccagacaaagggaaggttaattagcaatttaatttatggatcaaatattaaatacttgaac

SEQ ID NO: 71718 - DNA, 1475 bp, Oryza sativa
ccgataggtggggcccacctgtcgggcccttccccaacctccggccgcccgcccacgtcgccaccgccgccgaaaccgccgcaccccgcctcctccggtccacgtcggccacgcccgtgcgtgcgccgcgcctcccgcacccactccccctctctctctcgccgcgccctcaaccgagatggccgggattcaaatttgaatcccgccgctctctctctctctctccccacctccaacctcccacgtcgccggcgaaatcgggctcgcctcggccacgtccgtctctcccgagcccctataaagcatgcccgcactcccctccactttttttctttttccaccgctctctcccgtgccctccattgctcccgcgccatgcgcccatccgccgccgcctctcccgctactccggccgcctctagccgccgctacactcgccgccgcaccgcgccgtcgccgccgttgggttcgcgcggccaaggtccacctcgtccacccctcctccgtcgaggttcgccgccggagccccatccccgtcgtgcgccggtgagtgacgccatggccgccgccttcggccggcgccctcgtcctctcgcactctcctatctccctctaacccctctccttttgttcgttaggaggttccggagctcgtcccgccgtcgtcatcgtcctccgtcgctcgccgtcgtcgatcgttgtcggtgaggtctctcctcctctttctctctctctcccgcaccgtttagctctccaccgccgcttagccgcgtagctgccgcttcgccgcgacgccgccgctctccgccgccggtcggtcgccgccggccgccgtcttgtgccgctgccgcatgcgcgccgcgccgtcgcgcgccatggccgccgggccggtttgcgccgtgcccgcgcgcaccggccgcgagctcccgccgccgtccgatctacccttgggtagatcggggccatcggttcggctgacgcgtggccgccgcgtggtgcgccgctcctccccggtccgtggacccgatccgccgtggaccgccctccccgagtcactgccatgcgggtcccgcttgccggcgccgcgccccgccttgatgacgtcagccctggaatatattgcgcaataaatgatttaaggtttttcttttatagtaataaacacagtgaatcttctaaaattcataactaattcatccgagctccgtttaagcccattcaagtcttagtaaatcaagaaaaatgtgtagaatccattaaaaatggttttgttctctgtttcagtagtcttatagcttgtttgcaatgtttgccttgtatgtcgctagactccggcccctccgacgctccggtgtacttcgagatagtcgccgaggttcctccagcagcagagcaaggcaagtcatgcttgtcatttgaacatgttgatcctatattgcaaatgctctaatgttttctttcaaatattgcattgt

SEQ ID NO: 71719 - DNA, 1008 bp, Oryza sativa
ataaatttatgttcacaaggaacaagtattatgtgaagaataaagagtatgcaagtcatttcaaggaaaatcatataccctagttaagacgtcctagtttattgtaatcttgagtttgattttccagatatttttcaatagtaagaaccatttaaactaaaaattctgggaggttcagtgaggaattgtgcaaaccattgctcatgggtggttcggccgaccacatcttagtcccgatcactttgtcttttcttgtgtggttcccaaatcatgttgtagcatagatatgggaatctcatttgcgtacgtgactggaagcctgcgagatttcccccacactgtacttggattagaatgaatgcctttgcctttgtaccaagatttcccgcaaacttgcctttgcacgcctttcccctgcaacaaaatagtgaaagcaaaaagactcaagcagtttgcgagccggaggattgtaaactttatttgattgaattaaaatggataggcgcattacaatggaaataaatgaaaataaatgaaatgaaagtaaatgcaacttaacttgtgtctttatcttattggaggattagaaggaggcctcctggggactacgtgcacgaaggctgtgtaggggcggcccaacccatgggtcgaacgaacaaggggttcggccgaaccatggagggctcccttcttcctcagctcaggagtcatgataactggtcttggtaaatgcgtcaaaattgactaaatttaccacgtgtaattttttattttggttttcgagcaattaattctaggaaaacttttaaacgatgaccatttgcattaaagattgtgtcagccgtcttgaagcataactactccatgtgcagaggtgtcaatgatggtgaatggtcccatccatttgcttcgaagtttttcgtgcccgaagagtttcacatagaattgaacagcatcactttatctcttgccatgaactccttcccttttattatcttaccatgccat

SEQ ID NO: 71720 - DNA, 4994 bp, Oryza sativa
ccccacccctctccattatttcccactccattcatttctcctctccctctttccccttctacacacgccgccgtcgtcgtgccgccgcgccgccgcgacaaagtcaccgcgccgcgccgcgacttgcgccgccgtcgccatcgttgccgccgcgccgccgaccacggtgacgccgcaccgcaccgggtgccgcgccgcgtcctgcgccgccgtcgccgtcgtcgccgccaccgccgccgccggtgagccgtctttccccccccctccacctcgcgcccaccgccgtcgccgcccgagggagaagccgaggaagaagagaaaggagccgggagggagagaagaaagggaaaaagagagagaggagagaaagaaaagaaaagggaaaagagaggagagagagaaaaagaaaagaaaaagagaggaaagaaaaaaaaaaggaaaaaggagaaaaaggaaaaggaaataaataagaaattaggaggatttaggaaataaaaatggtcggggttaatcatagattatttttgaaaattcctcgagcgtaatagtatttcggtcgaaattccgagttaataataagaatatgtgtcttgatcagattagattaaaattggtagtaatttagatataattaataactaaacaattagatgaattcttatagattattatagattatttttggtaatctctataagtcattggttcacggtagaaattcagatttaattactaggaatcttagccgtgtattatatcgtttagtcatagactaaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaatgaaaagaaaatcaaaaccttgactccacctgtcggtcactgtagcttgtggataaggttgtattataaataaatgaattagggacagtaccatttcgcaattattagaattaattcaaatttgaatctttacgctagcataacttattcatttcagctccgatttgagtgaaacttgaacctaaattcatctaatttcataagctttccaatgatatataattcactattggataaaatatatttataaaaattaaataattaatatcaagatgatgcataatagtcaacttaaaaatatgctaataaataaaattagtattgtacagcagaataattatctttaatatgttctgtcactgtagcaaccacataaattaagtataattgatgtttgaagttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtatgtgacgaacatgaatattagataaatactagttatacatcttgtcctcgtataattacagatcaactgtaaatttggattattcattgtaaaattatgtgatgggataatccgtaaccataatatgattaacctaaacaattctaacatacacagcatgggtaattgttaaccttttataatttattttgacaagtgaaatatgtacataattaaattaaagcctccattaataaaataataatacaaatgattcacagtaattatttgaccgatccaaaatccatccggcaacagaacctctagtgtataaccgttctatttagatagatgcatgtgtaaccataatccttccttagccattagctagactgaaccaccatgacaacagaaagactaagaaaccttagctcttagcttgattagagtccattagcaagcgcgaataatatgagcaaccctaggttcgacctcagcaaatatattttgtttgtgcatatttgattgttgcttgaatattggtttttctcgcgtattatagactttgtgtatcggttagtcgtgaggcaacgtctgcaacttccaggaggtgaaggttgatcaagattatatcgagaatagggattatcctgagcaggcaagtcatcactattccttgagcatgttgatcccaattgcgaaattgttttgtttataaataaaattgcatgcaatgatgaacatcctacttgtgattatgccatgccttgattattgtttacccttaaatctttgtaaccatgtttacgtatgagtccctagtcaactatgacaattgcttagaaaggctattctagaatcatgcatactcatatttatcaaatgctatatgcttgggcaattacctttgggaaggtaattgagatgcggcatgtggagacatgagcgccacattgccatgatgttgatgacatgatttgtgaaagtggaaataaaattaaacaactgttttcgactggggcggacggaggatttgggtggtatctggaaaaggctagtaccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggacagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagaaaaccaaatctattcgaatagccgtgctcgcggttaatgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccatcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagtgtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttctgattttcaaaatcgggggtctacagagctggtatcagagcatatcgactgtaggtcgagaccctagatagaatggccgttagttgcaggaccttatattttacaaatatatttttaaaatgctaaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatactggttctatattctcatccacatttcaaaattttagaataagaaccgaaagcaattaagacgctatagggatattattgattgtgccgaaacctcatcctcgaaagtagatgattgcaacatgattatatgaaaaacaaagtaaagaaaaacaaaagaaaagaacagaaattaactcatcaatcatgataactcatgattgttagtactagtttcctctagtcacacactcgtatagtagaagtgaagtctcgactaagccgttagtgaccatagaagctcgacctgcgacatggaagttcataaagaacaataaagagaaaagaaacagactgcgtatttatgagaaagcccagcaagaatactaaacatacaaggatctaaagattatggatcaagaaggaacataagatgctacgtagatatggaaattcaataaaaggaaccctgatttggataagagtacatggacgaatgatgaaagagatttgaatttattggatattagcttgagggttgcttcaaaattccaaggacaagtcgaactcatatggcttaaatcctctgaactttattttataaaatgtctttagaaaatattgcgaagcaaattaatttttgcattttgaaatatagccttacaaaaaaaaattacttcaaaaaggaagaaaatgtttgtttcaaactatgtaattg

SEQ ID NO: 71721 - DNA, 3784 bp, Oryza sativa
aatgtaagtgtttaactcttttagcctaaattcattcgtgatatgttgtgatccaactatgtatgtgtgtaccaactactgatccagggattggtacggataaacacagaagatttccgattttcaaaatcgggggtctacacctatcccacacacgtggcgccaaaaccacagggggtcggggcgtcccagccctcggggccgaaacgggagcggcccgacccctcggggagacagagggaggggtggccacgtcaccctcgggcccgacccccccgagggagtcgggccacgtgggtgatcgcggctacccaagcctctagtcacgatacccccggccccatgtcaccgacagtagcccccggcgttacgccagggcgaccgcccccctcgagggaggcactggggcgtgacgccactccttaggcccggtgacaagtggggccggtccctacaggcgggcgggaacccagcggtcgcaaatcgcgcgcatcggcaaggggaaaccgaccgacaataatgagtggcctcttcaagaccgctacattactcgagcggcgcgcgaatcgggacgagccggttcgtttcgcctggagacatgatgatggcgcttttcacggttggcgagcgtagttgatgcgcgcacgatctgtcccatctcaactgccacggtcgcacatacgccgcgtgcgccgcaaacgggcgagtggggttagtggaggcgcgagcatgagaaacgagggggcgagatagtgggcgcgggaaacgaggagccgggcatagcgttggcaagggtataaagaggccgaggaagagattcgtttccttcctctcgccactattccccttgccttcgccacttgcgctctaactcctcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggatgcccggcgccacactacccggggtggtccgtcttcttcctctctttcgcaatggcggggctggtcccgccattctctgcttttttcatggatattctggagttttacgatctccagatggcgcacctcacccccaacgcgataatgacgttggccatcttcgcacacctgtgcgagatgtttatcggggtgcgcccatctctccggctgttccggtggttcttcaccgtacagccggtgtcaccgccgtcggtagtcggtggctgctacttccagccgcgggggcaggtgctgaaccgctacattccctgcgtcctccgcaagaagtgggacgactggaagagcgatgggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggtgactaccttcgtcgccggatcgcgccgctccagcagcgcgcccggggcgcctgggagtacaccgggctcgaggactacatgaggacccaccaggggcgccaatgggactgggaccctgaggacttcaggatggtggtccaactggtgctgaatctcagctccgtggaggcatccctcatcccccaaggggtcctccccctctgctgcgatccagagcgcgccaacatcctgaccatcatgcaggaggtcggggcgtcgggggaacggaccccccgaggccacgatggcgcgggcgggagccgcaagggggaacaatctaccccgggagggggtcgtgcttctgggccacgtgacgggggcccggggggcagccgccctgccgacgcccgggggaagagaaagcaggagggtacccctcccccatctcctccccgagggggtggggcggtgcgtgccagcagcaggcgcccgaagggtgccgtgccggcgccgcagcccgagggggagcgaaagaagaaacggctccgcaagatgggggggaccgagccattgtcacgcccagaaattcccgaatagaatttcaagcagaatgtgcattaaattccccgtccaggaccagccggggtacacaaacgacaatgttgacattcagatccacgtcttacaaacatcgtaaaagtcttacataaatgcagcggaaggaaagaaagacaacaggagctaagccttgactagaactgcagcgggaacaccactccacaggcatcctcgacggcacggacgaagcctactcctcggagaaaccttcatctgacacaaactcgagctctggggttgggaaaagtagagcaagactgaatactacccactgtactcagcaagtcataccggaataggggtatgatgcacggaattatcaagaagagctagagtggttcatttgcataaagcgagcatttataaacataagtcgaaagattaaaacagttgtaataattaattaatatcaactatccactgtccaacgctaacccacgttgcgacaggcccaaccatccacctaaactatccaaattcaaaagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgttaagttcttccagggcatcccgcgaaccggtccttaactgccatgggtgcgaccagcaaaaccatgcacccacagcccaccatgtgatttattttaattaaccaacaccaaagcgatgtcactaatccaacaaaacaattagaaccagcagtctaaacattaataggattttccccaacgtgaactagttgaactaagcatggctaagcaatccctagtcctaactctaatcatgttggaaccccaagttgacaaagaaacaatgtacaacaatagcgtggctatgacaataggtaaacaacccatagtagtgttataaaacaatgcaatatttgaaacaaaacaatagagcatttgcaatataggatcaacatgttcaagtgacaagcatgacttgccttgctctgctgctggaggaacctcggcaactatttcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacg

SEQ ID NO: 71722 - DNA, 1804 bp, Oryza sativa
aattcctgcagccctattatgagattcagattctacatcaattttcgttagcacgtttttaaaacagctaaatggtgctaaacaactaaacttcctatatagaaaaattacttcgacaagtaaatccatttttcaagtttatactaattaaaacttaattaatcataagctaatttttttcgtgtgcacttacttcatcataaccatcatccatctcaaacgggacctataatatatattgatcaaatatatggtaaaaaaagaatcatctcctattcagaataaggtaaaaataatgggcatattccttgtgccataagaccatatagagctagtcaaatgtaatatagtgacatgcatgtttggccatttttagggagatatccggttgatgctcttatgctcctactaggggacaactttgtgctccccaccatgaggaactataggctctatatattatgcatcaatccaaaaccgcgaaagaaaatttttgccaaaacagaaagcccctggctcttgcaaccgataatttttttctccaaagccatgaaattccttagcatggataaatgtgtccccttttagttatctcgtggtgtaactcgttttaagaccgctatatttgatacatatcgtactataaaggctatgtttggaaggagtttttactatctactgttttttttcaaaatctttagctccttaaacgatgtttaagatttttactcaaattatgagaatatatggttgtatcacactaaaaagccataaccatggaaacccataatttccaaaatctcattggccacaccccagttattccttgttactagaatttatcagtttccagaacaggaccaaatacagttgtacattccccctggataactacaatccaaacccaaaaagaaaaaaaaaacaaacaactgtcaccagaaatattaaaaaaataaaaaagtactagctcatattcatggtcaacgagtcaacggtcgtaatccccctcgccgaagaaaacaatataataataaagaaataaaaaaaaaagaaggatcatactccaaagaaggggtactttgcaaccggcccgaatcggacggccaggataacgcccaccctatcttccgggaatctccagagaaaccacggcgaaaacaagaacagcaaacacacgcggccgacgacacggtcaccgcccgtgggccccacctcccctctcccctctctcttctccactcgactcgactcgacgacccacctctccaccaactcgcaactccaccaagcaaaccaaaaaccccaaatcccccaccccgaattcggaattcccccccaaatccctcgccgcccgccgattcagccccgcggagacgcgattctcgaaggaattctggttcccggaggcggagcaggcggagaatcgtttggtttttcttttgggatgggggagggggtgaaggcgatgctggcgcggccgatccagctggccgacgaggtcgccaagcagtgcggcgcggcgcggtgcttccgcgcggagtgcggcgagctcaaggcgcgggcggacaagctcgcggcgttgctccgacaggcggcgcgcgccgacctgtacgaccgccccgccgcgcgcatcatggccggggcgcagcaggcgctcctcaaggcctcctccctcgccgcgcgctgcgccagcggccacccgcgcctcaggcggctcttcacgctcagccccgccgcggggttcccccgcaccgtcgccctcctgacaccgcgctcgagacgtcgcgtggctgctgcgcatctc

SEQ ID NO: 71723 - DNA, 8464 bp, Oryza sativa
aggatcataagatcccctcggccaccttttgccagcaatagcctgtatacgtcttgggttgcctgcgtagtatacatgggcctgcagattagaggattgcatcggagatatagagtaaacctagcccattagttccatctgtggggagggtaacagcctgctttgctggcttcttttcctcttccttttcgttcaattcttgagaaattgttcttcttaccatcgagtaagagagctgttttctccctaaaagttactacaaatctttatgattttctcattatatagaaaatccgctacaaaccctggcgtacgtgcacaaacatatagggaataagttcactttatgtccctcaatttatcacctgagtctgaaattcatccttaaaccgaaataccagatataacaagtatctcaatttataaaaccggaccacctgagatcctaggcagtattacgtctgattttagttgacgtggcaagttgaatcagcgtgggacacgcgaaccccacatgttagtgactagcattttcttcctcctttctctcatcctatctcttctcctctttctcctgtcctctcctctcttcccaatcccctcctcggcgacggatgacgggaagatggcgtacggtcatcgggtaagtcgtccctcctgaattgcagtgaccttacgccattgacaagcagcatcagccatgccgagaagaagacgagaggcggatgcagaggacgcctctccattgcatctcatccggatgcacagcacgttctatcttcttgtctccaaggtagatcaggggcagtatcaggatgtatcgatttcttattgttcgataggaagatcgaatcagggccggtcctgacattttggaggccctaggcagacttgacgctatgggccttggagttagcccttaaggagttatatctattttttttacttctaatacatacaatatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagctttttcgcgaccttatgagttatgtatagcacccgacaaatgtttctaggtaacattgtaacacctgaagcagtgaaattgcaaagtaaattgatagaggcatagctgcatagagcttctcaattgacttctaggtctgtgacctacctgcagcctgaagaagaggggtgaatgggaaatggccgatgagccgatgacaatcacagatcacgcgggcagggcagggaccagccaccatccaggcagccggcaggaagcatcgacagcgataccagcttgggggcttggccgatgggcgacggcgatcaggcgctataggctagtggcgccgatgcggtctcggcactcacggtggcctctcgcggactagggcatcggcgagacggcgacgaagcgacacggctcggcctgggcctgcgctgcggttctcgtggtgtggggccggtgggcagggcggcaggcgaagcgacgcgcacgcgcactgctccctggctgatcgctgattcgctgagcagttaagggcggcctgaggcgcgcgtctggggctctgggctgtggctaggcctgttggccgggctggggtgggagggggtaagtgatgggccccctctggcctgggccctaggcggtcgcacaacccgcctaggcccagggccggccctggatcgaaaaattcacgattttattgtactcttggacattaatttcttcgggacgtccttttcaagaaatgtcaagggaaaaacagctcagccgagccagccgatcaacatttcggctcctggcttggcccaccgttggaaactcatggagggaagcgaatcaggtttcattatgccgcccgtctctccgccgggcgctgccttcgtttcccaccggctgcagctcgtcgtgctgtccttcatgccactcgtcaccttggaggggattgggaagagaggaggggagagaggaagaatatagtgctagccactgacatatgggaccagcgttcctaccctgactcagcttgtcacgttagctaatactgatgatactactagatttcaggtgatgcggttttgtacattgagggacttcttgtgttggtattttggttagggatgactttcagacttggttaaaaattcagagacttaaagtgaacttattccaacatacgagttgggctgtaagtgtgtagggtgtggtagtcatggacaaaaggggaaaggaaaaagtccactttgactcccttaattgttcaccgaatctaattcgtgacccttaactacaaaaccgggcaggatgactcccccaattattaaaaccagtacaaattgaatccctcagcggttttggagggcggttttgctgacgtggcatgctgacttggcccattatgctgacgtgtcagcccagtcataaggcccacatgcaattgattagggaaaaatataagaaaacgtagggccagcttgtcagggccctcttctctctctatctttaaaaaaaaatagcagagcaactgccgtcggcggcgatggcgatggcggtggtgcggggcggcagcggtggatggcgatggcgatggctgtctgtagcgccgcttcgcctcgtcgccctcctcctcctctttcgtggccgactgctgcgtcgcgcacgccacccttgtggagcgcggcgccgctctagccaaccgcctggaggtggcgcgctcgctcctcggcgagaacgactacaccatcacgcgctgcagatgcgggcccgtgtggcaaatcctccggcgcaaccttgtcgccgagatgctgcacccgtcgcgcgtccgcctggtggggaggccgagggaggatacaacagatcaacagcaactcgtgtttcctggtaacaactgcagagctgagcaggacacaagccgccgcaagatttcatcagtgataatcttcttttgaaaattaatcatcagtgataatcgagcagggcaggcgtatccttgagatccatcccctggaaatgcacatcctgcatgcacatcacaagcaagcaaaaataattcagtcatcacaaacctacacaaagcacacatcaagcttgggaattcacacgcacgcacgtaccgattcgaaatggttgacgtcgcggtggtgcgcctcatcggcgcagacaacgacgacgacgtccttgagcgtggcgtcggcagggagccgccagtagtcgatggcgatcggtggcgtggggacgttctcaatcttgccggcctcgatgtccttgaggtactcggtgtaggagccactgctagaaaaatcatttgttgccacgaaaaaaatcgtgacatcaatactaaaattgtggcaatacatacatgttgccacaattgtaaaatcgttgctagccgtgataataggttattgcaatgatttttattttgtggtaataaatttagatgttgccacggaatggatgtggcaaaaagtcatattgcaacacttcacatcgttgtaataaaaattattgccaccactccatatgtggcattagctttacgtaccaaattaaaagttcaaatattaatctatcatgctatctatttatctacttattttttttgattttgtgtcttggctaggattcgaacccaagacctatccttcacgcgtgctctcctttaccaactcacctacgtatcaattctgttggaaaatgtatatcgttccatttgagcctagctaactgagatttgaatcatagatttgaatatctaaaagatttcaaatgaaaaagttatcacctacaaaattgtagatctcgtcgagagctataattttcatataaaatttgtctcaatccgtgtccatatgaaaaaattaagttaaattatgtgacgacaatttttttattgcaacgaatttgttgatcgtggcaacaaaaaatagtgaaaagtaccatgtactatataaattgccacaaaaattaaaattgtggcgatagaacatgttttttgcaacagtacgattttttgtggcgatatctcattttctatagcaacaaaagtactaaataaaacaacgattgcagatcgttgcaataaaaaataattatttgccacagaaaaattatcattgcaatatattgctacgaattattttttgttgtaataatttggtggcaatagctcaattatgttgtagtgagtggatggcctcctcttcgaggtagccgatgacgcggtccgcgagcttgggggagaggaggtagctgaggaagtaggcattgaagaagacgcgctggtcggcgagcacgagcgtgcgctcgtaccacctcagcttggccacctccatgaaggtcatgaggtgcatctgctcgttctcggcctcctctaacagcgcgcgtatccagccaccgctgtgctcgaagctggtggcgctggctcagtcccgggccttcctctccgactacctcatcaacgccaccaacggtcaccccttcatcttcgagggtgccttcttcctctccctcgccacccgcatcaacttcggcacccccaccaccgaccccgtccgctaccccgacgactgcgtctgggagtccgacatggcgcgcagcccaacttcctcgttgaggtcgcgcccgctaccgcctagacctgaccgaggctcgagagcgaagctcggcggccgtcgcccctcgcccgccgtcgccggcgtggccccccgcccgccgtcgccgccggcggcgccccccgcttgctgaattgggagggagagagagataagggggagattggggaggatgaggaagggatagactgacatgtgggccccacaaagtcttcttctatgtgaatgacgaatgggtcccacgcgtatgtttttagttataatgccacctaagcgtcacgtcaacagcagaccaagtcaacattgccaggtagacgccacatcaacgaaaccactcttcaaaaccgccgagggattcaatttgtactagttttagtaattgggggagtcattctacccggttttctagttaagggtcacgaattagattcgatgaacaattaagggagtctaagtggactttttccaaaggggaaaccaacagacaagttgggctgtaagtggttagcggcccatggaacagccttagttgtgcgtgtgttagctagaagctggttatattacagagtaaattttagaaaaccatgtgtattaagacatgtggcatctaacttaggtattatggttttaaagtttcacaaaatcccatccttatgcgttttgagtgtaaatttacttaaaattcaatagcaatgagagtacataaaaaatttagttattgagtttctattaagattggtaaaaatccaaaataaaatacaaatagtccgatcatcaaacgggtaaaaatttaaaaaggaaatgtgacccgagtcgatcatgtggccaaaaatagaaaatccgagttgatcgtgcgctgctccgaacatgcggttgattacgaattgacattattttcccacgtaacgcagatataggccacgcccacgacgattggatatgggaaaagtctaatttatccactaaactattgggtgagtacgaattaccctcatatcccgaaaatcaaacatatttcaccctccaccactaaaatcggatgaattacccccttgaccaaatccagagtggttttgtcctaccgcgtggtgtctgataaaccaatccaaaaataaataaataaagaaggctacctcacccctctcttttttctctctgtcgaggcagcctacattgtgggtgctcgtggtggtgtccatggcaacagccagccgtccacgccgaggtccatccccttctccctgttgcgcgtctgcaatgccctcctggcctccgccgagctcgatgcccctctcccctcttcctttcttcctcattttggcggtcgaccgacggcggcatggcgcgatgcgatggagtagacggcaggggcaaggcgtgtggcagcatcggtgatgacagagatgacgcggcaaacgcagatatgatgaggacatcacttcgtcggatacactcataacttcacacgttccaatgataattccaagtccaagttcaattcggcctccggagacagcactgacttcaaacggacctagcgccttcatgccaactccgatttgggtgatcttggacttagtggaaagattatctcgctacctttcaaacgcatcttgtctcatgtccaaattcatctcgagtcaacgggaatcgccaaaacaagacagtgctgttgctaaaaccgaacttgggccttgggccttgtaatagactaggcccatctcggaagtgtctccctccacctctacaaattagcacttaaccctagctttattttcctctacaaatagctttatacatcctaaaaaataactgggttttgtttagttgaattttgccaagtgccattcaccttgtctctagtcctcgttcgattagtcggcgactattgattcagagcccccaacagttggtgtgttgatttgccgagtcgattagatctaccacttcaatcgcaactattcctttgtgtttaatcacctattcgcaatatttagattgcatcttatcttgttcttgcagtgttctctcgtttgtattgcagggatcatcaaccgcacgtcacggttggtacgacatcgtttgtggtgtagcgattgcacgacgtcctggacttgttctggttggtagccacgtcgcaaacgtcgcactcgatcaaagcgagagttatcccctcaccagaaaatcaggccacgagagagagcgtcatcaagataggcgcaacaccgagcctccgccgccactctgagttgcctctcctgtccccacccattgccgccgtcctcggctccccctccgtcgtccctgccctacctccgtcgtcctcgctcgccgctgccgtccttagctccccctctgtcgtccccactcgccgccaccgatgcaagttgctccctatcctcgcccgccgccgatcttagttgcctatcccgtccccgccctgcctccgtcgtccccgcccgttgtcgttgttctcagttcaccctctgccatccccgctcgccgccaccgctccgagttgcatcctccatccccgcctaccgctgccatcctcggctcctcctctaccgtcccctcccgacaacgccgctacccactgccaccgtccttggctcccctaccgccatccccacctgctgcctccgctccgagcctcctcccccgccgccgccatcctcggctccctctccgacggctgctcggtgatatagagagagggggagccgagaagaggagagagagagaggattgggagagagagagagagagatagagaggtgaggggaaagagatagagaggatgagactaataggtgggaccttgctgactggattgccacgtaggaccaaaaccactctggtttaagtcagggaggttcttcatttggtattggtagttaagggtgaaaaatgtctggttttcaggtctgaggaggtaattcgtactcacctaatagttcaagggtgtaatcggactttcccttagattaaagtgatgggaagaaattaaaatgtaccattcatcctaaaatataagggattttaatatgatgtcatacggtaatttttttttattttaggacagagcgagtaagtccgatacatgaacattttgaccatcttaaagtgatggttcttaaggttagctgtacgctgttgctttaattttatgctgacacggcgatgatcagagcaagctcgatacatcgcgctagcgccgtgctgatcgtcaaaatccaaaaggctcgtaaaaagcatggccgatcgacatgataatgaaacatgtcattttccatatggataatatatagtactatgttcatatggataagtcgtcgctgtgctgcgaaacttcgtcttgattactactattccagctgcttaatttgcacaactttaattctctttatctagctaagctaggtccatctctctttcttatccttctagagatcaaccacacaaaagggctcgtacgtctccctttttaattccttgcatgcatcctgtcatcatccacctctttctgtcctccatcgattcgatatccaatatggtgtatatggtctttctcctaacacacgtttaattagtatcgtcatgccttacttcagtttcttacttaaattactttttggcacatgatcttctgtctgtccttgcaaaaaagatagcagttgaggggact

SEQ ID NO: 71724 - DNA, 18412 bp, Oryza sativa
agggtatcgggtcttggcgtcccggagggcctcgctaacgaagtagacgggccgctgcacctttcggcggggccgatcctcttctccaggggccgcatctccagggcgctcttcgtccgagaggccacgcggggcgcactcggcttctgtgccgacgacctcggggtcagagggcaataggtgcggccttcccgcagtggccccggggccatccttggggtcgggggcgcctggcaccgtcggacaagcaggcggagggccagctccggccgtcgggggtcttgggccgccgttcggctcgggggcctctcctccctgctctctcccgggtcgagtcgacacaggatggggatgcgcggagtgagggttgtcctcgtcgcgctccacgaccaacgccgcgctgaccacctgcggggttgccgccaggtagagtagcaacggctcatctggctctggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctaggggggcgcatccgctctatagctcgtatcttctcggggttggcctcgatgcctcgggcagagaccaagaacccgagaagcttgcccgcaggcacgccgaacacgcacttattggggttcagctttatgcgggcggagcgaagagtttcgaaagtttccgctagatccgagagtaaggtctcttggttgcgcgtcttcacaaccaagtcatcaacataggcctcaacattgcgtcctaactggctacccaaagaaattcgagtagtacgttgaaaagtaggacctgcattctttaacccgaaaggcattgtcgtataacaataagttcctattggggtaatgaacgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccaggagtcgcgccacttcctcgcagatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttagacgggccgtcgcccagggcaacctccttgaccgggacctcgtcgcacgtgaccatccgctgcctcggggtggcggggacggaggtgctgagcctctcgtcgccacccgcgggcttggacgccacggcgaggtggtccgcacgctgctccatacaagcaagcgcgactttgaggtcgccatggacggtgatggggccaccggggcccggcatcttcatctgtagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccctggcgtcacaccgatgatcggctgggacggccggagcaccatccccggggccttgatggcgtcaaaggctacgggggaaaggatgttgagggctgcacccccgtctatgaggacacgccccaacttcacattgcaaacggtgggggaaaccaccatcgcgatctgtcctccccgggcaacgcacggcgggtggtcgatctggtcgaaggtgagggcaacctccgaccaccgcgcccgccgcgtcgcctcatgggtaagggccgcggccagaagctctcgcttcatggccttgaggctccggcgagaagcgtgagcgcacgctcccccatcgacggtggcgacggtggcctcaggctcctggaaccccaggtcatcattgccatcgtcgatgtcctcggcggtggccttctgcttggcctcacctcgccggttgccggcgggagccgccggggccttgccctcacggcgctcctgcctcttctcctcctcccacttcctcgtccgctcagccaaacttttgaccgcgcggtagtccgcgaggtcgtggagggaggtgttgtgcacggtacaccacttgccggtcgggcgctccctactgggagcgccggcctccttctttttgtcgctcgcaggcctcccctttcggggggcccgcgaagcgccctcgacggcgaggacatgaccctcgtcgtcggaacgggccgacttcttcttcctcctcctgtcccgccgccctggctgtgcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgcccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattaaccaaccccgcgcctggcccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgtcaaccggggacacggggggccggcccccgtgcccggaacgaagtggcgctccggacgaggaagcgccctccgttgcgtgggcggcgcgactatcgtcgcgccggcgctcgatatcgagccgggcatccggccccccatgcacatcttcttgggtcggaggcgttgacgagggaatggcggacgaacggcgggtaacggccgccgttcgccgcgccctccgcctcgacgacgtggagccggcggcggcagcgccagaggccttgttggcggaggactgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgggcggcgaagtcgcggatctttcgaccccctcgagcgcctccccccgcccaagatttcggcgagagggggacggtggggtgcgagcccgacggcgcgggttctgctccccgtcgtcaccgctagcgctcggagagaggttgtgcgccactgcccgttcggccattgggctgagcgggagaagcttggcgcacacgaaagaggacgagggcttagaaagacacgcgcgccccctacctggcgcgccagatgacggagcttggggctcctcaccgggagaccgcgcaggcccccctttgccggttcggccgggggcgctaagtgaggttcttcgccctcgatctgaggaatgtcagcgagaagaatcgcacaagacacgggcgacgtagacaggttcgggccgctgagaagcgtaataccctactcctgtgttctggtggatctgtgtgtgaaggaatacagctcgagagaaccagagagagctcaggctctagaaccaagtggccagagtccagccccctctcctaggcctgggcctcctttttatgtggtcaggggtcaccacatgggcctctagctgcctaagaaagaaaacatgctttttacaatgagggctagtctacagccggaagtgacctctgacaagcactgcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaaactctcatcattccgacgggacgaggcgaggcgtgcgacaggacgcctgttgccacctaacccgcgatctgaccggtctgtgaccggtcacataccgcgactggtcacggaccggataagcgtgcgctgcgccgcattaaatgcggcgtggcgcgctcgtccaacccgctataaatgcggttaggtgagccccgctgggctcacctatcccacacacgtggcgccaaaaccacagggggtcggggcgtcccagccctcggggccgaaacgggagcggcccgacccctcggggagacagagggaggggtggccacgtcaccctcgggcccgacccccccgagggggtcgggccacgtgggtgatcacggctacccaagcctctagtcacgatacccccggccccatgtcaccgacaggatgtatctcaattgtcgcttgaatctggttgacgacaacatgtgtcatatgatcttgatgacatgtccatggacgtctgtagcagcctgtaatgagaaccctggttcccatttatctgacaggtagggtagggtgttgatgtgatccttcctggagacaaagtgtgagtgtgtgtatatacatgagcgtcaatcactattcgtcattattatgcaacccctcctgctacatagtagtctaagagggattgcataattctagaaaaagtgttgacacaagatgtaggggtgagacttttccattgcatatcactagtgtacaatacatcacctcctcccatctattgataggcatagcctcatgaactttccatatttagtgatggcccattagtagataacctaggccatgccttcatgggcctgtcggtttcctaacaatccctcttgagctttcattgcatgatgcctatgcctcatcaaaactccacaaaaacccaatgggaaaaactccacaaatatgcctatgcctcatcttgatggcaatgattttctatatcaagattttggaatgagtcagtgaaattctccccctgaattttgcatttctatatgtctcattgttccgattcctcggacacatctattcaagagaagatgtacaatgatctagtggtcaaatctgcaagaatttcacataacttagcattcaatattttgttgcttgtacgaaattcatgtccatagaagaacatggagatgcatattctttagtgagtttgttcatgtgactcatttgcattgtgcgtcatatgctgcattattctaaaatgatgggtgataagataattttcaaaacatgattgctggggcagtgtaaccatctctcacagccatgtcgaggctcttcatagttcaacgatggttagttcagtttaatgcaattatccaagtatttgagtgctactatcacacacttctatttgggaattcctcccaattttatctataattgactacttcgaagctatgcaccttggacactttctaagtgtggttggactgatgtacttggcttccatctatcaaagcttttagttgcaaccgtaagtgtgatttggattctgacaaacatttcatttcaagtcaaactcaaaattcaaaatgaacgagtttgtttcttcaattgtttccatattattctactcaggacttagtaattcttcatggactcttatgcgagtatctgatccaagtgttggtatttgttacgcacacagataaatccgcaagcccatagataccactatagcacttccctttagagtattataatggtatcgaacacaatgaacgtgtgtgtatatctaaaaacaagattcaaccaaggacaaacaactaaatggtaatattaggatagagaggattcctatgaattcaactagctaacttaagttaaaggtaaaactttatcgaatgcttcgggccactagtccagaaaactctattagtgccggttgaaaactggcaataggtgtcggttttccgtccgacaccaattggtcggcacctatgtcggttttccgtccgacaccaattggtcggcacctattactggggctggcacctataggtaaaatagacccggcacctttatgtctgcacgagccaaaaaaaaatcccccggctcgaatcgagccgaatccagaaccctacacatccttacatccaaaagcaaaatcctcacgtccaaaatcaaaatcctaatcacacatcaataacaaacaacaatgcatggagaagctcccgatttcacccaagaatatcaagaactctatgagcatcaagaactcaagaacatgagcatcatcaaggcatcaacacaaccacaaacaggaacacgttgacacgccgtcgccgccgccgcacgccgctgccccccgtcccgctgccgcatgccgggcagccggatctggcagaggggaggtcgcggccaccgctgccgcggcctctccacccgctgctgccgcatgccggctgcgatccgccgcctctccatgcgccgcccgtggggacgccacccatgggggggcagaggggaagggggacaccgcccgtcgcgtaggtggaaggggggaggggagggcggcggacgatgaggtgaaggaggaggggtccggaggggaggaccccgccgccgccctgcctccctcactggctgtacctgcgccactggctttgggagctcgcccaccgccaccctacgtccctgcctccgcggggcagccgctgcgagagagaggggggaggcagatcgagagacgcgagagagaaagggagagatatgcgagagatcgagaaagggagggagtagatgtaacgtcctgcctctcctaggccgggcccgcttacatctggcagctttcataggttatagactgccggggagggagatcgagatgcgcgagagagaaagggagagatatgcgagagatcgagaaggggagggagtagatgtaacgtcccgcctctcccaggccaggcacgcttacatctggcagctttcataggtcatagactgccctcacagaccaacataagtcttttctgcacactttgtcctcactcgtgcgctcccaaattgttccaggccaagcacgcttaaccctggagttctttggagatcggtttccgaaaaagaagttgaaacttgttgatatgagtattctattattcctattaagccttaggctgggatgtcacagtagataaggatgcggtgggtgcggtgcaccgtgcgtgcgcggatggtatcggctcatcggctcggctcaaaggtataggtgccggttctagcatggttaaaggtgccggttctacatttttctattactgggaggtgggaaaagctctataagtaccggttttaaatgaaccggcacctatgagccggtccctatgagggtttttgtagtagtgggcaccggtcctctcctgctctgccaggctgagtccggccttaagctctatcacatacccgaacatggagggatgtaaaggacggatagggctgtcaccacctatcacgtacctcactttctgtggagcacacaacaaacggaggtaacagctaatctacacaccatgtctacgttatcgattaatactctagcctcggccaagaactttcttctttatcccgagtcttagtactagagcactctgtataagtgctaagcgacaaatccgcaccaatgagaatatatcccacttaagtaagctaattaaataccataaggaaatcccaaatacttactttattgaataaagtatccggcattcctccaggactccagtggagggagtgccgacaactccggcactcctacggaattcccctacattgagagaactctttactttgaggcactcctttgtgagcttctgtgatgacctgcacttttaacactgaagataaatgtgtcagactgtagattactagtcgtcaacctgtgcgttgcacgggatgaatttatatattgctattcgtattataaatgttaaaatatatacgtcaaatttataagtaaaatttgttttagtggaagttatgtgtactaatatttttaatttatatgttccaagaaaacaaaattagtaattatatataaaccattataatatttattttgttgatttatagtttctaagtctaatggtccatgtgatttttacgggcaagttctatgaattacggaaatttgacctactatagaatccatatagcgaatagtaggcacaacacaaattaaatgagttctaaaagtgcctgaagatatcaaatgctgattagtctgctaaattatttttatcaaataaattacatatattgattggctgaaatagaacaaatgtttccagacgaagcaaccgatttattagtggtattgggactactatcatgtaaaattgacatagaaggataaaaatccaatgacatgtccatgaataatacgttatacagactcgacgtaatgcatacaatatatatactatctatatatgttcactgcttaaaattattctacgatacaatttttcagtgaactttatcattcaatagacaaaacatcatcagcatatttattacttcaattgaaaccaaaatccaagaaattcttaaataagtcatgtggcctatgagtttgatggaactacaaggtaccccgcgcgttgcatcgggacattgtgcatgcaaagaaaagagaacgtttgatccatcacaaatagaaatagtgtatatgaaaaacattacttttatgaaaacattttatcatcacattttacacattttattagtcgaatagatccaagtattttccaactgaccttaatcttattattagaccgatcataggaaaatgagttggttgaataggtccaagtatttttctaacaaagcacaatcttatttgatcaactataggaaaatgaattttattgactacaaatgttgaaaataggtaaaatactaaccttctgatgtgatcatgaaagttgagtagtatgtgccgtgtaacggccactgtttactgtgctctgcttcaaactaagtacggatcagttgcacaattatttcaagagtggtaatatattatttgatagaaataaataatattgtagtataagaaataagctaatttgaggggtacagcctggaatttctagaaatcaatgcctctgaagaagaaactgaatctcttccgaatcataccatagctgaaatatgatttaagatagaaattagtgaccaaaatttacattctaattaggtgagaacatgcagcataaaatccatcagcaaaaaagtatatgatcttcatctaaaggaagggggaatctgatattaaatcttggctggcatactgaagacagacacctgggacatttcttttttacagtactaaatgggaaaaaaatgagtacagccgatgaactcatccaaaagacacatgttttaatttggtgaaccaataaactcaataggggagaataagggaaaagaagaatgcacctgatccaattgggaacagaaaaaaatagtgcaggccaggatgataggaaacaccgtcgctggtgtgtgcaatgcaacaccgtcgctgcctcgctggaggatgaattagctgaggccgtttgcgtccaataatccctaatcaagatggagattggctaatccatctttttttttatcaaaagaacaaattggctagtgtgttgcaacaattagttacatagcaaaggcggagtctagtattcatgggctactaaaccaccagagctacagatagaaaccaccaaacctgataatcacccgatggataccagttatatagactcacaatacctgtgatgggcatagcactcagatttaaatgcgtcaatcacggtagccatcaaggagcagttgaggtgtctatgccgttttcctgattttgcgcgcacgaaggctagggtcacgaagagggagcagagcgatcaggcgagaaaccgtcgtggaggtaggggaatcgggcgggggaggggaggggaggggaggcgtggagagggagcgcgatgcagctgggacggctggacgggcgcgatccaggagaaggagaggatgcggcacggcgagagcgatgcggtgagggcggcggagcgtcgtgatgcgggacagggagagaaagcggtgcagcaagcacgctgtggtgaggcggcatggcgtgatgcaggagagggagccgacgcggtgcgagtgcgaccatgcgggtggataagagcaaggataatactatagcttgctgccggcggtagattatgtccaagtcatctgaagacagcacagtagctggatggtataatggtttggctatacattgtctggatagaagtttggatacatttattgactgcatgtgagtatgatcaaatctagctttcatttgtgtgaccatctgtgtgtcgcatgccggatgagagcagaatcttttgcatgttgcacttgtgagagcaggcagaattatttatgcacacgggatcaacaataactgcgtaactaccatccgcacctgctgcgggagggcggcaatgcctgcgccggcatgctaacgctcggcgcttctgcaatcgcccgcttcactctctttcctctttttttctcctccacgtaggaatatgctgacgtggagtttcttatcgccaacctagtcagcactattatacttgctctaagtcgatccgagcaacggttgatcgctcgattagatcgaacggatagggggaaagagatgatgtggaagcaccaggaagcagagaattgtagtagtggggatgatttgtataggtatataggatacctttatagattgtacattggactatcaccaatagatcttcttgaatgcaaggggatttttcgatttgtgaatttaatctaaaacttgaaactcatggatctatatgatacatggcttgggcgagtaatgattcatgtcgtttcagaattcggatgagagaagaacagaattataatctaatcttgattggaaaataatacagtagaagctaaaatcgagagtcctgattgattaaaaaaatagaattgtacctgagcagttcagcacctgagctgtagaagtcttcaggttgcgtgtgctcccgatgagcctatcatgaagtcttcgtgtcgcaaggtagttctgactctaaagcctgtaggatcacgcactactaaaaaaatgattttccttgtacagggacccatttagattgcagacggatcataactgatcgcgtctgaaaaaataagctcatttaagctaaaatgagccaattttcgcatgcggacctattaagagggccacacgcaaaaatatccactccctcttttccctctgacccactttaatttttcccttctttctctcctctcctgtctatctctttttcttctctcctctccttttttcctcttcccaatcatcagtcaacaatagcggcctcactcatctacgccctctcctctcctcctgacaacggtggtgggtgtagacgatggcgacagcggcggcggcggcggtggtggaggtgcgggatccggcgggcggcggtcaacccccgcacggatccggctgtcgggccgccccttacccccctccccccccagggattaggctcccctccactccccttccttccctccccagatccggtggaggggaggggcgtcgtggcagtgcgccagagaggagcacggatccagcggcgggcggcgcggagtcccccgctgacgacgacgagggcgggagcggcgttctcggacgacgacgaggagcggcgcaggcggcaccgctggattcaagggttttcattttttgaaattttatttttttttggatttttgtttttccgtgcaggcgacatatctcgtgtgggtgcgccctagaattttctgttttttctctccaatcgcgatttttgcagatctctgggtgcgtgcgggccgcccaccagcatgcgaaaaccggttttgaccgcacgcgagaatctttctagtagtagtgacggtacacaaatcgttgcggatatatatctgaatggatgaagggcgattggagagcgttcgtctgctcgcgtgaagtcccatctgctctcatggagagatatagatcgatgctgtagaatcgaatcacaataactaagccaaccagagggagggtgaatagttgttatacccaaaaaccgaaaacttttagcggaaataaaagttaccctcgaattcgacggaagtcggtctgaccgagattaatctgccggtctgaccgtgtggatgccgtcagtctaaccggtatagatcaaccggtctgaccgccaaagtcgctcgccgcacctgtcgccgccgccggtctgaccgtcgcaaaaccctacttttcgtcgttcgtttgttgaggctgtgcgagagggggtgatggctggcggcggtgggagattcgtccggcgtgacggaggcgatggaaccaaccaagctgccgctggtgttcagcacttcaacctaggcagaggagatggaggtggacgccgcatgcgtggaagaggccctaggcgcggtcttcgcggtaggggccgaaatccgtatcacgcagccacaggttctggtacacgccacaggggctgatgctgacggccacgttggaagaggtgatccagcggggaggggtcgtgctgccgttggaggagatagcagcgctgttccttcaagtggcgctggcactggtggagctgcccacggcgtggcggcggtcgcagctgctcctgccccagacgcaacggagaatgaagttgtggctactaaggcagcaaatgagaccgcggctaagtaaaaaattcgctgcttcaggtgcaaagaaaagggacatggtgttactgggaaagaaattctctgcggcagtgccgcaagccacaccctatgcaacaccgcgtagaataacgacgcgtgtccattgtccatcagcgcgctgcagccccagccggcctgagcccaactttggagccgagccgatgcctggtatactacacccacacacctgtcagctcgttgaaaatgctaccgagccgcatctactggctacacatgaagcctgaataatttcatttttcaatagagcttttttatgcaactgttgctgataatatgctggagatttttctagtgtaatatataaatcctttacataaactttatcaagatgtctcgggtgctcagaaattacattttgatgacataacaaatcacggaacatttaaggagtactccctccgttcaaaaaaaaaaaaagtccaatcctagcttgtgtctaggttcgtagctagagtttgtcttttattggcatagagtagtagctccgaaaatttttaattgtacaggtgcggagctatatagccatataggaataccaacaacatgaaagcctgaaagtttgcaacatacaaaccaattctagcgctatacccaacctgacaagtaaaaattacatgtgttgattgacaacttaaaagcacacctggtgttgaaattaggttggcacgtttacatcatatttatacagcatgtaaaatcatttggtctatattgcagaaataaaaagagaggcaagacaccacccttacataggaacccgaaaacttacagacctaatacaaaaactattcatgtgccctggacagcttgactccaataagcagcggaagaaatggactcggctcgacaccaaccaaagagggctcggcctgcagcaggagattaaacacgcgtcgctattctgcggggtgtcgcacgggttgtggcgtgcggcactgccgcagagaatttttttccgtgttactgattgtaatgcagttatttgtgacatatgtgaagacccaggtcatttggcacctaagagcatccccagcagttcctctaaccggtcatccgtccttcatttgccgtatagaaggggaaaaatcagctcgagcagatacgctaacaggccctccaaaaggggcggatgcgccaaattaggagagagaagaagcaaaaatggagtgtttctctcctcacgccattttgcaacagccgcctctcccgcccccatccagacttttccgcgacgcgacctcacctccagcgcgacctcccctccatcgccgtcgtcgccggccggtgaaggtgagtcagcggacggtggagagggagggtggagtgagagtggagatcgagaggtgtaccagatctggagccgcgccaccgccgtctgtagccgtcgccctgcccgtggctgaccgctggcgccctcgcgatgcgcgcggccgctgcttgcctcctccgccgccgccgccgtcgccatgctcgcggccgccgcttgcatcctccgccgccgccgtcgtcaccatgcgcgcggacgccaccttccgccgtcgcccagtagcccgcaccgttgttcagctcggcaccaccctgccctgcagcgccgcccgcgccgtcccgcatcgcccctccgtctgccgcacgcacgcacccgcgagaggataaggtagggtctttatttttttttagcgagagaaggtccgttcttttctgtttttcttttttttaagcgagaggataaggtcagtcgctagcgctaatgtggattagaagtccattcatgtaaatacatcatcaattaaaaaattattcattaaaactatatcggttaaaatttactcatttcaaaatattattgcgataaaaaatgcagttaaaatttagtagttcaaaatatatcccttaaaaatataaatataaagttagttggaagatattattaaaatataggagggtgggatatggatgatgtaatatagatgatctgttagagttgaaaggaatatgaatgatgaatcttttttggatgaccatccatataggtatttggaggatcaaatatggatgagctgctagggatgctctaattgcccacttcttctcgctcctaaacccactgcaattgtgtggctggggtgtagagggtggtggcttcttcatgattcctacaccagctaaggtatcaggaagaccaagggagtttagtaagactgcaacagttcgcgtagagaatggtcacatttcaattgataatctcaccactgagctgcgccggttggttcccgtcagatttgaagtaaaggagacggcacaggatacatttgttgttcagtttccctctacaattgaattagatagattgcatagggttggcagagtccgtagctttgattttggtgttgatttgttatttaacaaatgggaacaggagattgaggcaaagtttgtcctgaagaagacatggtttcgtgtctatggtgttccatatgaaattagggactttcttagccttcatgctgtcggttctgtcattggaaatacaacgatggtggatatggtttatcttcggaaacacggggtcgtaagaatgcaggttgcggtggatgatttagcaactttgccgcccagtgtgtacattgtgttccgtaaccatgggtatgagattttctttgaaccagaaatgcccgaggaggaatcgaaaggaaaggaaaagttagacgaagatgatcagcgtgatgacagtgaacaaaagaggaacgatgatgatgtcattatggaagatcggaatccaaagcgactaaaaaatgaagctgcgtcatcctcaatgtcattaagaggaggctcagttacagactctcagcttaattcacattgtgtttcagcgatcgcagggttgctcactgttgttgatgattctgcagtagagcagcaagctgaggaggttttgccaacaatttgcgtggcttctagcttggaaacggtgatgaacaaggctccagaagagagctcaatgcagatcccaactaccggacagaacgtgaccttggcaaatgaaaaggtggctgctttgtctttggctgtaccggatagtgtggttgccatctcagaggaagaatttacaacgacattgacggatgcgggagagatggcaccggcaggttgtgcatctctctcggaggcttcgacgggagcatcaacactagaaggggctgtaactgtgtcattggctgctcctgttgtcatggacgacgcagcccaggagatcgagtcggacaaggtgggcttggtggctgccgatgctccaactttgtcggtcgatgcaactcaggtcttgccgtcctcgtcaactggcacaatggacgctgctccaatggtgaatcaggaggtgacagaggtaaccacatcacaagactcgatgattttggatgtcgggactgcaggtgttaacacggtaattgagttggctgccgatggggcacaacttgatgcagcacgcaccatcatcgctgaagcaaaggtgcaagcagaagcaggtgggaagcgtccctctcaagaagctaaacgtcgctctcgtcgactgattcatcctacaccaacacgtcaaagtgaatgacagaaggcaatggcaaacggggatgcaccggtggcaaaccgagcagagtttctaaaaaagattcataacctcgaagtggtagcaggtaacaaattcaaccctacaagttcaattctatctttgcctaacaaaactctacttgcaaatatttctaagctaggagtttccctgggtagaaatgacatagaagtagatgagtctatttatggtacaaaaatttctgaagttgatagatttgtagctctacatgctagttcttctgtttacaatggttcttctagtaatgtagataatgacaaggatgagcttttaaaattatcttctatccagcacttatgtagtgattggcaagaagaaagtgagggtagcgctgacgagtcttttgattcatgcaacgcacctcaaagaaagaaaattttgacaaaagccaaaaataaagtggtatgtccacctttggctaagccaaaaatgaaacgcaacaaacataaaaaatgaaaggaattttttggaatagttgtggtttcggtgatccagctaaattcagatttatctctgagtgtgttaaggaacatcacttggattttattgctatctttgagaccagaaaaccgtcattcacttcagcaaatcttagaaacctatgtggtggaaaagattttttatggcatgagaaacctcctgttgggaggtcgggggcattcttttaggggttaatttagccgtttttgatatcggttcaatttcagagggagatttctatgtgaaatttcaacttagaaataaagaagatggttttaaatgggttctaatggcagtatatggtgctgcgcaacccgatttaaaagaacagttcttaacagaattagcgcatacttgcagtaatgagtctcaaccccttttggtaggaggagactttaatatcatcaggtcgcaagaagaaaagaataataattcatttgatccccgttggccttttctttttaatgaagtgatcaatagtctcaatttgagagaaattgatctatcggggaggcagttcacctgggcaaataaccttgaaaatccaacttatgagaagttggatagagtgttaatgaacactgaatgggaacaaaaattccctttggtaacatgccaagcactaccacacgccatttcagatcattcacctattattcttagatctggttcacatgcccattttggaaacctctcttccgctttgaactaggttggcttcaacgggacggtttctatgaaatggtccctaaagaatggcacaacataaataaggggaacacccccatggagcgttggagtcataggattgcccacttgagacaacatttaagtggttgggcacgaagtacaagtggcgcatacaagaaagaaaaatt

SEQ ID NO: 71725 - DNA, 12546 bp, Oryza sativa
tatatatatatacatatatatatatatacatatatatatatatatatatatatatatatatatatatatatatatatatatatatatatatatatccagccatcactcagatcacaatcacatgccatgctcttgtttgcattattcattaatactataatccaactgcatgctagttaatttgatcagggtcacgaactcgcgtgcagggtaaattgaaaaacctgatatttgcgtgatctctcttgatgcgtggctacactactttgcagcttaattatttaatttgctcgtgcaaattaaagtgagtcgttcctctccaaattaattagcttagcgcatatgtacgtgttactttcaagtgattactatttattcgttttgttgactgcacgcgtgtggaatattgctctcgccttttctatatacgatcagtaggaacaatatttcccttaagtaatctagagagtagtacatataaaccaaagtactttgggggttaaatagctatagtgttggggagtaattaaataaacttgtccggctgattattaatttgtttcttgggttgtgacggctgccacgcacgtgcagagaggaaagtacacctggcacattatggcatggcatatcgtgatgttacttctattttataggtcccacacaaaaattttatacctgtcataacaaacagttgaacacatgtataaagtattaaatataagttaaaagttaactaattgcacatattgcgaccaatttgtgagacaaatcttttaaaccaaattactccatgatttgacaatgtggtactaagtaaacatttgctaattatgattaattatgcttaataattcatctagctatttattgatggattctgtaattagtttttttattaatgttcaaacaccccatacgataccctgtataagtacccgacacattaactggatctaaacaacacattaactgcttttgcattctgctgctgctgctgctctagcatacacaggcctgtcagaggaggaatcaaccaacgacagcttcaagaaccaggatctgtttgatgttgttgcgtcctgtgtgaaacaaaccgctgatgctggtcagcagcagccgagtttcagttacccagcagctagtactcctatttcagtactacaagttctgcgtcccagggatcctaacctcaacttcactggtacactatttaattagcgatgaagtgtttatatattaattatacagtttcaaaatgcatgccaatatgaccactggtatttgcaaattaataagctatcggttaaacttgaaaaagtttgacgccacttattcatatcagctagctagctcacgcagtagttctattaactcataatctgtcagtccctaaatatttgacgccgttgattttttttaaatatgtttgaccgttcatcttattcaaaaagtttaagtaattattaattcttttcttatcatttgattcattgttaaatatacttttatgtatacatatagttttacatatttcacaaaagtttttgaataaaacaaacggtcaaacatgtttagaaaagatcagcggcgtcgaatatttagggacggagggagtacgtgtgtatatgtcggcatgcacactggctaacgcccattaatttccacctccatgactccatttgatccatgtattagctgtgctggtgggtgaaggctcaaggaagcgcaaagatgagccaaatggatgtggagctcatcatttgggaaaggaaaatatggagaaagaccaaccctccaaagacatggcaacatgcgtccactgctccaaagtatatacggcaaaatcgactaacggtacatctcatctcaggaggcacctcacaagcaagtgcctcaagagaaaagggctcactgaggaacttgctaagctcaccagtacaaagaaggcccgtaaaattcgttagtgatatatgcgacttaaatatattaattgcagtttcaaatttaagtaaggcaagggtatggtatgctcgaattgtactgtcggtgctaatatctgtattttttttatttttaagggagtggtactccgtattcttgtgcgtgagtgtgcttgttgcacctatttgtgcttgcgatgttcaatgtaagtttaataacattgttgttctctttatctttaattttattccgggccgtcgataagggtgttcaagctggaacagggcccaaaaaattaggaccccaaatttcttatattttaatctactagcaaaaatgcccgttcgttgcaacgggtgaataaattctaatgataatatacgtttttcatgcataatcatgtcaatgataatgtttgtattttaatgagcggctttttttttataaacgacgcatttctttctaacagtttcttcctagcatgtttttttgattttttttactgacgacaaataccatagttttctcccttttttgcttttcttttctcacgcgttttttgcttttttttaatgttctttttttgctttttttcccaatacatgagaatataaaacgaaataaaagccgtgtaatagatggcaaaaaatcgatggatcctatccgactcaagcgtccatcaattaagcgtttttttctgacagttttttctagagcgatttattttttaatagacggtgttttttcttgcgcggttttttcaaatcattttttagaaatggcgcattttttcttacattttttttccttgcatgcttttttgaaaaaatttaccgatgatggaaatagtatttctcgcacgtttttttaatggaagatggaaaaaacctttttagcatttttttgcgtttttttctcacgcattattttgaaccgtttttatttttctcgtgcattttctctttttaaatagttagattagattatagatagagaagagatatatactgattagaaatcggaatttgtttcgccctttccatttttttctcgcgtgtattttttattttgtacgaaccagctttttattttttacgaaccattttttcgccactttcttaggaaatcggacgaatttttttagatgttttttcagattttttcgcctttataggaatcagactttattcttctgtttttaaaggaatcggatctagcctttatttttcaccactttttttttgccttttataggaatcggatctgtggtttttttcgccacttaggagaaacaaaattttattgttattgtttttctctttttcccttttttttcttttttttgcagtttttctttttctttttatgcacctttatgcccttgttctcctccttttattattttttcttcaaaaaaaaacctcaagtatcttattacaagattatagggactcaaatgtaaatataaaaattacagggactcacatagaaaagtacaaacccaaaaattaaaatcatataaaaatggaatgctctcgaccggtaggttccgtttttgcaaacagatcttcaatccggcacatcaatttttttcaccaagatgaatgggatatcacggtatagattgaaaccgagaggagtgtgcctaggatctcggactcaaaccgagaccgagaggaggggtgtgttttattttccgtttttaagagggaattggatctagagttggactttttttttctctgagagggagccagacttttttttgatttttttcgctatttattttgttttcacgggagtcggacctgagatgagagggagtcggacattttttttatttttttcgctatttattttgttttgacgggagtcggacattttttttgccatttttttttgacggacgaaggaaactcttatttttcttaagtagtagagatagagatatataagtaccgtgtcaaatataatatgattcgactttttttttaccttgtcacatatatttttttttttgggaatccgacagatttgtttttcttttttttttttgctctttttttaccacgtccacgcggattcttttttttctggccggtcttttttttcaccttgtttttttttcgctcgttttttaggaatcggacagattccttttttatttctttcgctcttctttttaccgtggaatcagattcgtttttcttttcctttttttcgcccttttttgatcggacgttcttttctttttttttttgttcggattttttcccgttttgttttggatcggacagatttttttcgtccggttttttttatggacgacggaagcacctattattttttaagtagtagagatagagattatattgtgttttaatatatttaaaaacctatcatattgtttcattttttaaattaacattttggacatgatttctgttggaattaatagatgggctaaggcccattcgaaaattaattctttggaaaatcacaaaagctcacttcatgggatggcatgcatgtggagtttagtaccaccttacttattctaggaaatggggacctccttaaaagggaggatgccctcctagccatttgaagcatgtgtggtggagagaagaggggaaacacacacgctcgctcgcctggcctggcaaggcaggcggtacgcgtcgaatggtccgcaaaattggctcctcacccttgagcagatacagcctccttttgcagttttattccgaaaaaatacggatttgttttgttttggaaacattccgaaaaatccagtgcgtgaaaacggcgtggtgtccggataacttacggccagttcggttacgcgggcgccctgatcaagcgacctatctctatataaaccgagccgtcgccttcacgcaacacacgcgaaatcaatctagggtttgcctcctactctgtactgcgccgtcgctcgtagactactccatcccgctcgccggcgtacaccggcgatcgggagagcaggtctccggaacctctgtcttcgacgtcctgaaccgggagaaggcggcaataaggtttttgggaagcttttcgcgcgactactccttgttcgtccgcgacggctcgccttcctctccgctcgcatgctgcgcgccttcgtcgacgcccgcaaccgcgagtagttcctgacgagcaaccggtctttccgccacctcggtacgtgttcgacatgttgcgcatatttgatctgttcatgttttactgcttagtttacatgtgtagatataatgatgcgttcaatctagtttacatctgcaatgtcatgatttatttatggaataaattaaatcattatgtgcttataatttcaacaatccaaaaaccttattttaggcgctgtgattttactatggctggttttgccgatgcactgaggccagataaattcaccggtatgcactttaagagatggcagatcagggtcactctgtggctgacggctatgaaatgcttatgggtaagtactggcaaacctgaaggaattcttaccgctgatcagcagaagcaatttgatgaagccactactctctttgtgggatgcaatctcagcgttcttggcgattgtctggtcgaggtgtatatgcatatgaccgacgctaaggagttatggaatgcactgaatactaaattcggtgctactgatgctagtaatgatctgtatatcatggagcaatttcataactacaagatggctgacaaccattctgtagtcgaacatactcatgagatacaattcatggctaaggaactgctccagccttcacgcaaatacgcagccgcacaaaacagccaagcgagagcacggcaaatttctgctcgcctgcatgtatatatgtgatcatcagcctggccagaagcttgtcgactatagcacatttccacttgcaaccagctgcacgagtcttcacctctctgatctctatgtgcatgctaacgcaaatagtactaattaacgcaaaaaccttccttgactatggttaagctcagctaatccataatatttccattccaagataaatgctaagcctccctagcacatccgtgcgcacacatttaatcggctctcaaactaaccactccaaatcatgacagctaaactaagtaatctggcttacccaaataaaacaaactaatagccaaattgtgctacaaacataaggcatcaaatagtatcagcttgagtgaagatacttctacatgtttgtttcctctaagatttaatctgctgattaatgatgtggcaaatatcatattctcatggtcttaggtagtaattatataatgcttttgctaaaatgaaaatacagtctatgttgatttcttcgcaaaagtaacaggatatatattcagtaactggagtaatgcccctcttgtattgtatattataggctgtaattcaactatccatgaaggcaatgtaacacatcatgaatatgaggtttgtaaaggaagagatgtcagaatatgtacagggtgaaggtgtgtcaaatggaactggcctggagaacaaactccaagaagagcttacaaattaaggagatgcaatcatgacaatccccttcaggttgctattggttcgcagtctctggtccatctgggttgatctgatgacccaccgcaggatgcttcgcatggacccgatctcatgtcccatgggatgccattggcacgccggccagagcttcagccttaagcttccggctactgctctcccggcacaggcccagatgcaggtggtacatatataatccacttatgaattacacacactaattaagttgattaactgtagatgcatactatccagcaggaatagtactgtagtaataatgggagagctagagatggatgacagcatcagcgtacttcttccatcggcttccatgcatgagcagctgatcgatggtggccgagctagctgcaccacccgcgctgcccagcaacagcaattaactactacatgtctctctagcgacaccgcccgctcccggctcccgtacgtggtcgtggacagttaatggccccgagacttcaccggccgtacgtacgtatacatgcatgtgagctgaccatccaccgtagtccctccgtattttaatgtatgacgccgttgactttttaatcaacgtttaaccactcatcttactccaggatagagttcaactcttactctagtcctaatacctattatacaactccaagtcctaaactgtaaccaactaggtacttattcgacacaaaactctaacaaatttcaccttggcgaatatgccacgccaacctgaatttgttacttgctcgaaccttcgtatacccagacttgagttggttccttttcgccgctcacgccgagctgccccgacaaaccttcaccatactcaccataacagcatacggacaactagctcccctttcttccccaaccagattggccatggtaggtatccctctccctcgagcccatctagccccttctgcctgtctccccacactctgctcgtggcaagagcacagcgccagtagccgaagatccctactgtgaaaccctggatgtacattgggtgacggctgccggagaagattcagaaggacatgtcggcggcgccatggggaagagggtgcgtacagctgcggcggggagtgttctgcagtggggagggagacgtcgaacgcgcaggattggggaaggagatggagccacccacattgtggggccctctctctgacaccctcgagggtatacgtatgatatgtattcggtatgggtagggcggtctgtgtggggagtagttgcgtatttgctatgaaatatataaaattatatgtatacataaaagtatatttaacgatgtatacataaaaaattgaatgtagagatggatgattttgtgtaatatgtgaactcacttggtataaatatctagtagtaagagatggatttacaataattttattattaattttgtggacatatctaggcggtttggtggctgccacccccacgaaatgtatttgctggctaaagtagtgggagaaatcatgtttcgtgacagctattgccatcacgaaaagattttccttacagtaaacacattactctcagtaaattagccaaaacaaggaatagccttttggtgactgccatacaatcactaaataacttgtgacggcttgccctcgccaaatattggatttcgtgaccaatcaagtgtgacaggtgtttcgtgacggcatgatgccgccaaagttcttggtgacggcggcattatgacttttagtgacagtaaggggcagtcaccaaagatctaatctctagtagtgccacttaaccgtgttcgtgtgccattactggagatatctaatctctagaactataagcttaatttgcatcgatcctccgtaatgcgcatgcatgccctctcttttttaagctgcaggggcacacgtctctctctctctctctctctctctctcttcctgttgtttttttttcttctcaacccgatatcgatttacctttttccaaccatattttgtggataggtccatgttttctcaatatacttaacaaggctaaggtggtgtttggatccagggacttaactttagtcaatgtgtatttagacactaatttagagtattaaatatagactatttacaaaactaattacataaatgaaaactaatccgtgagacaaattttttaagcctaattaatctataattagagaatgtttactgtagcatcacataggctaatcatgaattaattaggctcaatagattcgtctcacgaattagtccaagattatggatgggttttattaatagtctatgttcaatatttataattagtgtctaaacatccacgatgtgatagggacttaaaagttttagtcacatctaaacaggtctaagatcgtgccttggtttccaagggtacaagggcgctcgctccaccgcgcctctctgcactcgcgaaaagctatatatactccatatccgatctcgcgagctcgaatacgccatttaattagctaggctgatcgatccatccatccatccatcgaccgatggaaggcagcaacggcactcactatccccaatgctcaactggtacgtccatgcgtcactacaatactagttaaccatcttttcttcactgatgagtaatatcatgcgtgaagatgaacatatatgtcgtctatatataatcaagtcaatagtgtgtgttcggatccttgttttcccaactctctgatctctcgtattctacgcacacgcttttcaaactgataaacggtgtgtttttttttaaaaagtttctatacgaaagttgcttaagaaggttatattgatccatgtttttttaaaaaaaaatttgctgatacttcactcatgcagggatggagaccggatcgtcgtcctcacacaatacttcatcaccttgcagcagcagcagcagctcaacatcgtcgtcactcccggcggcgccacagcagctgagtcgtagtcgccggaggcggggatgaggtgtgtatgcgtgcgtgctagagtagtgttgctactactactgctccgtttcagattagaagactttctagcattaccaacattgatataaatgttaataaatatagacacgcatatatgtctagattcattaacatatatatatatatatatatatatatatatatatgacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgtttacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatatatatatatatatgaacatggacaacgctagaaagttttataatatgaaacggtggaagtagtatatactgtatgctatactgtacaacgtacgtctatatatacgtgcgcgtgtgcgccgtatacgtatgcatacatgactttcatttgtactgtatttgtttgccaactatatatatatatatatatatatatatatatatatatatatatatatatatatatgtatgtgtgtgtgtgtgtgcatgcaatgcaggtcacaacattggttcaattattggatctcggacccgacttcacaggtaagcggtacaactcaagctactactcccttcgttttacaacgtaaattattctagcattttccacattcatattcatattaatgaatctagacatatatatctatttagattcattaatatcaatatgaatataaaaaatactaaaatgacttgcgcggtgaaacggaggtagtatatatatacttgaatggtgatgatgtgttattgtagctagttaatatgtactcctaaaatattgtacatacgtaattactccctccgtcttaaaatataataacttctccaccaatattctcttttcaaccaataacaacccaccacaatttattttattttcccacctacctccactactaatcgaaccacaaccctccactattcacttctacctattttgctaataaccgtgtccaaactctaaaacttcttatattctgggatgaagctagcgagtagtatgtatgtagctcaattattctcttttatttaacttatataattaaatattaattttttggactgtaactaatacgttcttgcatgcatgcatatgtactagtcctccctgattccatgagatccatgttacatgcgatagaggacgacgaagacgacgacgttacgagtggcggtaacaataacccaatttacaatgaagcatcagtcacggccgtacgtcggccgtcaaggagatggtcagccgtatgggcccacactgaatttgtagatccttcggaaaattacgtcaagtgcagttactgcgccacgatactgacggctaattccaaagggggcacgagccacgtcaagtgccatgtcatcagatgcctgactagacttgggcgacataacgaatgtgaagaactcattgccaagaccaaaaaaagagcgagaaattaacgtaagtcctggtgattccaatctcgtgcgaacgaaacgcaagaatcttccacagcaataatacgtctgcaccgtcctcaattctagcaaagatcaagaaggaaggaagaacatgggtcaaagcagaggctgcaaccttacaggagtttggaattttgggagatatcgcctaattcctgattttttgcttttttttccttttacgggttattctattgttttcgtcgaaccttttatatttctcggtataattttttcttgctctattaatatacacaagataaagcttttgtctttccttaaaaaaaaagaaattcacgtacgtgcatcaatatttggcatggtcgtagtgcatgtactcttacagtatctgtccctccattacatgataaattaatctcgtataggatataacaaatattatactactacgaatttatctatgtgcgtagaactataatatatcacatgttatactggttaacttattttaggatagagagcaaatatttatttttgtccttgtgcgtacttgcttgtcatggatatgagcttatatatgaatgtatagtacgtgttcattggtggtgatcagatctacatcgatcgctattgtatatataatgtagctagtcatattatttcctcttgggttgtgcttttatatataattaacaaatatatatatatatatatatatatatatatatatatatatatatatatatatatatatatatatatatatatatatatatgtatgtatgtatatatatatatatatatatatatatatatatatatatatatatatatatatatatatatatatatatatatatatatatttgttaattatatataaaagcacaacccaagaggaaataatatgactagctacattatatatacaatagcgatcgatgtagatctgatcaccaccaatgaacacgtactatacattcatatataagctcatatccatgacaagcaagtacgcacaaggacaaaaataaatatttgctctctatcctaaaataagttaaccagtataacatgtgatatattatagttctacgcacatagataaattcgtagtagtataatatttgttatatcctatacgagattaatttatcatgtaatggagggacagatactgtaagagtacatgcactacgaccatgccaaatattgatgcacgtacgtgaatttctttttttttaaggaaagacaaaagctttatcttgt

SEQ ID NO: 71726 - DNA, 763 bp, Oryza sativa
atttgaagatgttaaattacttctactaaactgatctctttttttgcatgcgaggtcctatatttatcaccaatctttaaaagtgatcattatttcaataaaatcgcatcttttgctcttcattatattttcttttcttcatgctttaagttgtaatatagtaatatcaatctgttccatcaggctattgaggaaaatggagtagaagagagccaagaagatgctgttgaggttgatgttgaagctgatggttcgactgatggtgctgtccttgtgaacggaaatgataccgaggaacagtggggtacgaacaacgaagaatcatcagcataaaagctgtagttgagcaagtgtacagtcctaaaaccctttttttggtcctcgtttatcctcccagtgcaccaatgatcacaatgaaaacttgatgctggtgtcctcaaaaagaaagaaagaaagaaagaaagaaaacctgcttctggatacaagtgtttattctggactatatcctttagtttaatctgttgggataatttcagttataatttcattttggtattcgagttaatctgttggtctgaccagttttcttagacagtttgaacatgagagcaaaatttgtgcttgctatacatgagttgttgatgttttctaacgactatcttgccttttgcagtattgactcctgaccaatagtgaatcagcgggacagcaacctgatacactgattcagcttgtaagggtgaagtgtttttcatctatacaa

SEQ ID NO: 71727 - DNA, 1507 bp, Oryza sativa
tacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccagatactgtcaggagagacgaaagcgctatctttgatctcgccgggcacgaactcgaggaggaaggctaccctgttgtcaactacgagtcagaccttcagaccgccatatcgacaacagttagatagactaccccaaatattgtactagtgtgattatgatgaataagagcaatgaccggcatcagccaacaggatgtagggttattacctgacaattcaggggcccgaacctgtataaaaatccctatctccatctcttttacctcagtctcgtgtatatcctagtaccaatgatccccataccatgcgaataccggaatcgcgacatcaaacgtcgacaggagggcaggagccagcgtgggtcaagctgtcaagttgtatgctctctcaccagcacgagtatctcgcttgtggtcaaggtggcctcgacatatcctcgctcatcaacgacctcaccgtcaaaaataccggaggcttgtgtcatccatccaactgcaactgtacctgggattcccacgccggagaggaagaagagaagatatgagaggggcagtgaggtcattttctgtttcttttagtatgttggccgtcaaaagtgataaaatagaaacaatttggtgaatcacgatgacaaacaatcaaatttactgggaaagatggatagcatttgagaatgtgccattcaatagagtggcaaatagtccaaaatctcgcatttgtatggcatgtcacatcaacgccacgtagcaagctaaaatggtccatagctatcttggaccagaatgacacacttttgctggaatggtccgaacagagtagaaaattggagagcaaatcgaatcaaaaaaataatatatgacaaaatgatcttgaatggctctcttggcacttaaagagaaatgttcagacttaattttcactcttaagcaaacggccggcgagcaggtgcctgcctttcactggatatttcggattgttgggccgggcattaccgggccaggatttggctagcttcattcgatgggctatagcccagtctaaaatgcctctcgttgagcactgagcccattgggtttgtacatcgctggcactttcgaagcgcgcgcacctgcgccaagagaggatcgatggtgtgcaccgccaacgcggcatctccgacgcgtgtaacgttaatcgcctcccagcatg

SEQ ID NO: 71728 - DNA, 14812 bp, Oryza sativa
ataaccttttgcaggagtatgaggatgtcttttcagctaagataccccgggattgccacctatgagagggatagagcatcaaattgatttgattctaggagcttcattgccaaaccgcgctgcttatcgaaccaacccgaaggagactaaggaaatgcagcagcaagtccaagatcttttggaccgtgggtatgtacgtcaaagccttagtgatgaggacacaactagctcagatggaaccaagactaccttatgtattaatcaaccaaacgtgcatatgttctacattagttttacttgttatatatttgaacaaccattgctgcacaaataagtttcgtgtgtttttgtttgcagaggtacttgcttgggcgaaagaatagagaccgagcgtaaggaatgcatggatgattgaagaagttgattggggaccaaaccaagaacttctccaagtcttctttcatcttaccacatcacttttagtccatagaagacaagaaataaagttctacacattttggattcagattcgggcctcctgatagcatcaacttaaaacggacctagccgctgatctaggaagaatttcggggcccatgagtacttgttggaaagattatggagtctactttcagatggacctcaagagcgtacacgttcaagaagccggatcgatttgtgtcgtgactctgcccaaatcattgtttatcagaaccattcggaagatcgggacttaacaccctcattagttggaatcacagcgcggttgcccattaggttatttatcttcctataaccagaaaattaccacacaaaaatatttattctttacctagacaatttgagctgttgcattgttctattagtttttgcgttgttaaattatagatcgcatcatcgtgtcgagtgttggtttagttttagatttaatttttagttttgagtattgcatctgttcatcacttaggtctagggttctgtcgacgtttgatagtcacgactagggtatttggatagtatggggatcgttggtaccagggtatatgcgagattgaggtaaaagagatagagacaagaatttttatacaggttcgggccccttatctgacaggtaatagccctacgtcttgtttatatgggattgatatagaaaccacagagtacaataattgggagaacctatcgaatcattgtcgacttggcggatagataaccaactcgtagtcgatgaaaggatagtctttctcctcgagtatgaactcgtcgagatcagagatggtgctagatccctcttaccggcccctgtaggcaccgatggggttttcctaggcttatctctgatgtcgatatttggcgacgtgtgttggcttgtagctttgtggtgtctattggtctgtcccctctcctcctaggggggcttgtatttatacccatagatgcccccttatccaagtaaaactagggagtcaagtatggatacgattcaagtactcctcgtcgtttccatatagaactctatttgtccttccttatccagaactccttctatatacgaggtttgtttccgtataagacttggtatatggtgggccccgtcgagcttagtcgattactattgggtatgtggtatccacaaccctgtcagtagcccccgacttcaatgcaaatgaatgagttcatgttctcgaccgaagactttggaataaccgttgtcgtactcacttgaccgttctcggtgtaatcagtgatagcgctagattcctcttatcggcctttgtaggcactatattaggtttggctagtttaatctccgatgtcaaccgagaaggtacggagcatgcgactaagtcttccgtctcactctaatcgagaatttggattgaagtcaagaaattttgtctcggcaggtacaccattgcttcattccatattccttgtcgagctccatcaaccgttctcgagtaatcgagtaggcgtagagtctgcgacaaagccttgaagtctgacttgattgttctgatgtctgattttcctgaaatcaatacccaaaacatttaccgtactcgcttagtcgatcccggtgtaaaaccgtagagacacggagtcttcgacaatgttgaatagaactttcctgaaatcaatactcaaaatagaatattaaatagaaatagcccccgagcgaacgcttaagggcaacatgttataatatgtatggaaatatttgaaaataaattgaatctgcgtgtgacaataaaagagtacgctcgctagagttgccctctgcaaacggagtttggtactcctcctagcccccagccttgtcctcggggaaaccgttctcggaggggaaggctcgaagactcgtaacttgcctagctgaaaaagcgatttacctagcccccagccgtgaagttggaaaaatcaattacaggttacacggcttagttaatacaccttttgaacactcttacatgaccaggtcttacatagtcgtttggctctcagaatctgacaagaccttatctgctttgggcatccctagccgaaattcccgtaggtttctcggaggcttgtcgaaacggcgtaaagggtcagtaggttcgatttcaagagtatgtgttatcgtggtaagggatcaacggacaaatattgcacaaataaacacttacataagttgatgtatatgaagtgatgagacgacttccacaccggtgaagactaggtgtatagttgtactcaacaaatcgcagaggtaatgggagaatcgctacgccgctggtcgaagaccagttgtagctataactcggccactttaagtggaggtacgagagatcgctacaacatactagtttgagaatcaggagtagcagactcttgaccgttttgaagttgaggtacgaggatcgctacattgctggtcgaagactagtcgtaatcgtacctcgaccattagaagtcgtggtatgaggatcgctacgttgctggtagaaaactagtcgtagtcgtatctcgaccacttgaagggaatctagtgtaatagatggacgacattctcgtgacctacgagaacagcctcctgatgacgatgaagacaatgaggaattatcgtagtcggagttttagctcctggatctactacctcgtcctcgggccctctacaagtctagggatctcgagttttgtcgacatcgtgtgatgtcgtgatgtcgttaaccttgtttgttgtcgtcctgatgtcattaatcctggatgttgtcatcctggtgacaacggcgatctagtcggtcttggttgtcactatcacgacaacgctgatttagatgtcgagagattgctactatccattggtcgaggaccaggagtaggcgtatctcgagcacctgaagatgaatttttaggtggtgagagatcgctactatctactggtcgaggaccaggtataggcgtatctcgatcacccgaagatgaatttttaggtggtgagagatcactacgatctactagtcgaggaccaggtgtaggcgtatctcgatcacccgaagatgaagttttaggtggtgagagatcgctactatctaatggtcgaggaccaagtgtaggcgtatctcgatcacccgaagatgaatttttaagtggtgagagatcgctattatctactggtcgaggaccaggtgtaggcgtatctcaatcacctggaggggtgctaaagttggctattgcatgtgcatctcatgtggccagcatgattcacatacccaacttgcagcatatccgcggatgtttgttcgcaatcatgtcgggtgatcaagccgacgtcgttcgcgagggattatccgttaacgacatattctccaataatccggacgtggccgacgctatagatgagataagtcgtcggtcttcattggtaggttgggtacgacaactcagcgtttttcgagaacgttctcgataatggggtgtactcgaccacctcctactcaagtgctcaattgttcctgataaatattttatagaagacaagatatatagcagagaaaatcgagtatgtactaaaaaaaactacgtaaatcttctagtattatcaggatataatgagcagattaaatatcaagcattatgtaaaccgtaaacaagcatgatttatactgaagaaaatagggcgagcccccagtattaaaccgtagttggcttaatattggaaacactcgcacaagaaatattgtataaaaaacacgtacgctctagataaacataataaattattgatctgacaatattgtatatagttgaaaaataggtacggtaaattgtatacaaaatattgcgtactttgtagatacatgccggatgtctctatggaatcagtagattaatttaaaaaatcaatatactaaataccgctgttgatttgtttgaatattgtgcaggcgtactgtgcggacatgtattgatgtgcatacaccaaacatgtaggcccgtggataaatgtcccctgagtcctgattggctggcacggttgtcatgcatgcatatgttccgtttacccaactccagtcctaaccggacacaaggaacgaagcagtgcagatcgatctgtgcccaagtcgagcttgccaatccttggatgggagtcgtttgggacagcagctgcacggctgggtggaggtcggtgttttcttctccgcgacgatgattccgatctcatcgggaggcgtactccggttgggttaggtctccctatacctgaagtcgttgagtggtatgtcgtcggagaatccatctcttaaacccatctcgtcgaaaccttgaagcaccaaaatccccatacttgacgtgccactgtcgacgtttgatagtcacgactatggtatttggatagtatggggatcgttggtaccagggtatatgcgagattgaggtaaaagagatagagacaagaatttttatacaggttcgagccccttatctgacaggtaatagccatacgtcctttttatatgggattgatatagaaaccacataatataataattgggataacctatctaaccatcgtcgacttggcggctagataaccaactcgtagtcgacgacagggtagtcttcctcctcaagtatgaactcgtcgagatcagagatgacgctagatccctcttgacggcccccgtagacaccgatggggtttgcctaggcttatctctgatgtcgatatttggcgacatgtgttggcttgtgcccctgtggtgtctattggtttgtcccctctcctcctaggggggcttgtatttatacccatagatgcccccttgtccaagtaaaactagggagtcaagtatggatacgattcaagtactcctcgtcgtttccatatagaactcttttcgtccttccttatccggaactccttctatataagatttggtatatggagggccccatcgagcttagtcgattactattgggtatccataaccctgataggttaatcactaagtttgtgagttgtacgtcagttttgggtccagttttgcatctcgtcggttgttaccggtaccttgaaaaatcgaatctactcatcacatggtttccgtttttatagttttcacaagttttcgttggtcggttgtgaagttacatgattgcatgaaggggtagggtttcctgtaccgtgcacgaggaaatagattggtttctgttaggagattagtatcgtttttctccatcagagttgggctccctcctctagtccgccgtggctgaatccaccgtggtgggttcaggccgaacacccatccattcgactcctctccttctagatcattctgtttggtatgctggttaaggaaaaatcttcagtggatttgtgatatttttataaaaactgaacctacgtaacgtgatgtaacatcctgaaaatgtgtcattttctaatcttgcatcatgccgattcttatgttcttaataaccttctaaacctaggaaaatataattagcaggaccttctaaaactaacttgcataaaaaacttctatggtatttaatctcttttgtgcttttcaattaaaaacatatttggtatttcttgttggaattctatttttgaatattagaccttctttcgactaaaacacttttattcaaatttagtttgaaaaccatttttactattatgaattatggtccaagaaatcctccaattttgccttgaacctaaaccaaagtaatttcaatctcattggaattaattgttagcccatcctttgatcttaaacctatcctttgattctcgatccaaatatctaaattcctccttttgatctagccaccaatttaatctttgtggcttgatttactcttcggcacaagaatagtattattgcaaatattgtgaataattgctcttgtgctaagaaaattccaatttatattcttcactcaactttcccttttagccacaaatatacatcacaccaattttagagttcaaatcctatttattgccttcaactaattcccttcaatattcccaaaaatatttcgaggaatattattaatttcccttcctatttgagtgcttccaaataaattccctcaaactccacctctaaatattgcactcaaataaattaagaaatctcctttgtgaattctttccgaattcaaattctttgcaaaacctagttatccaaatcaagtattcaaattagacttctttctttttgtcatcgggccaaaatttcctttccttcttcccttggcccatctctcccctcagcccaattcggcccacagccgaatcgccccccctcctcccagtgtgcgtgtcgtacacgcgcacggcgcacgccgccgcaaactcctcttccgtcgcggctaagaaacgaagccggcgccgtctctttctcctccactccaccggcgtcgtgaccctcttgccctcctcctccaaaccgacgttcgccgcctataaatagccggccatccctcctcttttccccaaatcaaaccgagctctctctctcctccccatgtcagccactggtcgatctcctccaccggtgccccgccggccaagccattgcgccatcgtgttttcctcgacgaggtgaacccatttttcccctttcccttctcttttagccaccacaacaagccaccaccgccactccttttgttgccacggtcgagctcttgtcgtcgccgttccggccttctccttcactctctccgccagccaccgccctccccggaagcgtggtgttcgggaacaccacccgccgccggcgtcgccatcttccagctgccggaaaaccggcgcccctccttcccttctcctctgttgctcggctggaaagagaagaaaaagaaagaagacgggaggaacaaggagaaaaagaaaaagaaaagatactgacaagtgggcccctgcacagtactatttctcattttctagatttaattcaaatcccaatctttagaagcccatatctcctaaaccgtaggtccgattccagtgaaatttggacctaaattcatataaattcaaactcttcattttgatatcaaatttgctattttaagattttatttgaatttccttaatttattcaaataccatttgaataactatttgatttaatcttatatttgaatttccaacttaaacttatatttgcttttcaaatattttcttttctttccaaaataccctttagccactaaaaagccgccggttggaactttacgccttccatggggatgttcgcgtggtctacgggcctcaacgccgaaccgttggttgtaaagcccggcataaaccaaacccaaggtcgaagtgctgctcctggcaccccacgccttgatgcgtatagtggtcggagcttcactatcccctcgacctccattgcacgccgcacagttagctatcgggctctgtgtgatcctagccgctccgccgtcactcacggttgtcggagtaacacttccaccccactaaacctgcacccacctcctattcttctagccgaaatgctatctatcgacaccggctagaaattattccaaatctagtcattatactgtccaactctagcgacgagtagcaaacacctaaaactctagccgatatttatcctacctcgatgtcggcctaaacaactaaaccctagccactattctacaaaagcccaaccttgacccatattagccacatacctatttaaccatatcaactatccagtatatttcctatcatccaaaccacgagagctttcacataaaatataagcaacattagttgcttgattccctttttaccatagcctccaaccctctagaacctccacataaaatattagcccagtaatccctataccctataaaagagataggttataccttaaaccctagccctcttagttgtttatcgttttcttattattttatggcttttattgaaattggttcttcctctttctcagtagagtctattgtcttttggatggcaacctatggtatttcgagaatcggataaccaggttgcctatcttggatttatttgcgttggagcaaggcaagttattattcctcccctttgagcataattatcctatattctacattctattctatgcattagccattcatgattttgaatgcataatctgaacatatagcaaaccagttatatgctagcttttgcttagccctgcctagttagactgcataaaatataatgaacttagattgggacagtacgtaagatttggttgatttctaggtggctagtactgtctccgtcgatataagtttaccaagtacttatgtcaaacgaacgagtacgaccgcagcttctagaatggggacagacctagatattatgttaatttacaatgtggtacctctgtacagtggttcttatgtaagtcctcgcgaaggaggcaaatatatgccgcgaagggcaaatgtgatatttaccgaggcgtaggtaaatatcttgattatcgcgcgatgtgtgtgtgattttatggaaacctggttgagatgacgtggggtctcatccagttctctctaaaaacctcgggaacgccagaactcctcttgctgctgataacgttacgttcagagcgcatggggactagagttcgtggaacaggtaccacaattgttaataacctaatactgggccatgactaagctaatgattattggcaagttatggactgcgggtaaagcgtacatctactgcagtatgaatatccttgaatctattcgaatagccgtgctcacggatttgagtatcgggactcatatggtaatttggttagaaatataattcaagattttcttaaatatcgttgcatatcaaacatttcaggatttctacctctttattctcagctttctgcaagtaaatctagctctacacatatattacatctcatacattcattgttgaataatataatagcttgctgagtacattgtactcatccttacttcaacccctctttttcacaatctattcagagtttttgccgaagctggaagttcaatcatataagttagttccattctaacttaattcataaatatagattagatagatggtttaagtctataaccaaacattagagttggttcattctatagcttctgttgtattagttagccacaatcttgtaaataccctatcattttatgtaaagatatctcccttggagttttgaccaaatgtatgcgatgaagatccagattgttgaacctgtatcaatctactgatccagggtttgatacagttaaacatgtcggtttctgaatcgttagttttgggagccgacacgtgagtattccagttttgaggggatctaattttagttttgcactttgcatctaagtccctgtaatatttatatttacatttgagtccctattcgaggtcagcggttagttcttgttaaaaaaatagtaaaaaaaataaataaagaaagaaaaggcagaaaggtgcaaaggaaaaaaaaaaagaaaaagccgtacctacaaaaaaaagaaaaacaaaaggtagaaaggtgcttaaaaaaagccgcaccaagaaagaaaaaaaattattcatcctttgagtatgtttttagagtgcagagttgtgcattgaatcatatctagtccttagtgttgtcgggtgcttgcttgagttagggttgagtctaggctaggccagcacattgactagtactttgaactattattcaactttgcattttctgataagcacaattgcattcctttgctactacatattgtgcctcccaagctccacatatatacttctggtcagcaccactttgatccttgcaatcgccacatcacgtccttcaaggtatcacgaaccagccaccggttgtaccgtgcttagcattgctggtaagacacttgtaagagcttgataaggtgctccatttggctgagttgttgagaggcaccactacaccgcgtagcagattattagggataaccttcactgtttgctgctgtttttgtgtttgcaatgacaggtatgattggcgctcaaaatcagcgagaccaacaaggtaacaataatcgcgtgcccgatgatccttatgctaaggttaagtttaaaataccatctttttcgggttattacgatgctgagaaatactttgattgggagatgacagtagagcaaaagtttagtgcccaccgtgtgcctaaccaacatagagtttgacaagccagtagtgagttcaaagattttgctatcatgttgtgggctgggttagctgatgatggagttttacctactacttgggaaagaactttaggtagctaagcgtgatagatttgttcctccatcttatcttagaggtttaagcaagaaactgatgcgttaagaacaaggggataaatctgtacaggattactatggtgagctataaaagggattgatgcgatgttgcatagtggagggaactgaggatttcacttgtcgcttttacatgggattttggcgtgaaattcaggacatagttgattatatgtaatttaacactgtcaaccagttgtttcagtgtgctatgtttgtagagaaggaattgcagggtcgtgatcaataggtcaagaacaaggtgagcacgtacacgccacgggcgaagccatctttggggcttccaaaacccatctctttctgggcgcccccaccaacgagcaagcgaccagttgcgtccagagtttctgcaacgcgaaaaccaccttccccacgacctgcagatttaggtaaagcttcttcgcaggtatctaccaagagtgcctcatctatcacttcgacggtacgcacacccaggattcagtgccaccgcttccatggatttagccatgtgcagaaggtttgccctagtcaacgggcatatgttgtttcagtgtgctatgtttgcagagaaggaattgcagggtcgtgatcaataggtcaagaacaaggtgagcacgtacatgccacgggcgaagccatctttggggcttccaaagcccatctctttctgggcgcccccaccaacgagcaagcgaccagttgcgtccagagtttctgcagcgcgaaaaccaccttccccacgacctgcagatttaggtaaaacttcttcgcaggtatctactaagagtgcctcatctatcgcttcgacggtacgcacacccaggattcagtgccaccgcttccatggatttagccatgtgcagaaggtttgccatagtcaacgggcatatgttgctacggaatatggctacatcagcacctccgatgttgaagacgatgaggaggaagagaagaaagacgaagaggaaaaagacctaaccatatagctccatgcatgcttgaggaatgtttaattgaccaagcgcctataatttctgaagatgagaaaaaaggtaatgataatggtgctacaactactcaaggtgtgcatagttatgatgtgccaactatgtccactacttatgctacgttagagcaacccatagtggaaacaattgttgaaatacctttgtcacaaaacaaattgcttgatgtctcttgtgataaagaagagttgtgcgatgcttcacttatatccatgccacaactagtgaatgaacatgttagttctatagtagagccaccatgtgttgagtttaaacatgttattcacattgctagcgagaataaagagcttaaattgctatcttctttaaatacttggggttatattcaatttgatgatctttgtccactcaactgtttagagtagaaattattttctagatttgaattgccatgcccttctgatgtgatttttcatattactggcaattatgatagtaaaggagaatataatgtgcatcaagtatatatttgttcgaatttgactataccacattttcatgatgaaatgtgttgtctagaggactgcatgcttataagtaattctctatctagttcctctagttgtttaaataagttataggttggtttgcaagaagggaagtgtggtggtttttcgactaccaagatttcaggatccaaccatatggccatcaagaaattttcctcaacggatgttgaggtaaataaagataagttcaatacactttatgacaaggtgaaaccgaggacgaattccaatctagaaggggaggatgatgaggacacaactagctcggatataaccatgactaccttatgtattaatcaaccaaatgtgcatatgttctacattagatttacttgttatatatttaaacaaccgttgctacacaataagtttcgtgtgtttttgtttgcagagatatttgcttgggcgaaagaaaagagaccgagcgtaagcaatgtatagatgattgaagaagttgactggggaccaaaccaagaccttctccaagtcttctttcatctcaccacatcacttttggtccatagaagacaagagataacgttctacacgttttggattctgattcgggcctcctgacagcatcaacatcaaacagacctagccgctgatctagaaggaatttcggggcccatgagtacttgttggaaagcttatggagtctactttcagatggttttggtcccacatcaaaattcctaccaagctaccggaaaactgcaaaacaagccacgtatctcatccagtccgaatatcatttgggttttgggccttgtaattgtgtcgtgggcttagcccaagggggtgtgcaccctagagcaaccctaggatgtccctaatcatttttactcagtagcagtcatcgtttagagtcagattttgcttagattattctgtcgagaacggtttcgccgctagatcggtttgtaagaccccaactcgtgagcttaatcattcatttgcagttttggttgtattctatctcgttcttgtttgtgttattcgattggcaaacagggattagccttctcggcgaggtcattcgtgtttcgacacgggtgacaaccagaggagacgtggtgctgccattgcggggctcaagagcgtgcgcgttcaagaagccggatcgatttgggtcgcgactctgcccaaatcgttgtttatcagaacctttcagaagatcgggaaccctagtgcacatcacttagtccttgtgcatttcctgtaatttggttcataagaaagatggttcttggacttctacgagatccacgcgctgcacctcacccccaacgcacctggccatcttcatgcacctgtgcgagatgttcatcgaggtgaggccgtccatgcggctattccagtacttcttcgtcccgcagctgcagcagtctgtggtggtgggaggatgctactttcagccccgcgcgggggtgatggggcagtacatcgagacccacctccgcaagaagtgggacgactggaagagggactggttctacaccgcactgcccgaccacctccgcctccgacttcccaccggcccacctgagcgatccgccggctggctggcggtctcggagctgggggaggagtatacgacgcggtgttagactgcctcaggggcctacggagggaggcctgacggcggcgatggtgttcgacgactacttcagccgccgcatcgtgccccttcaagaacagccccgcggcgcgtgggcctacactgggtacaacgaccagatgcgcacctatgtggggattggtgcgagaaagacgcgcgggctatggttcgtcgggtgctgagactagacaccatcgagccgacactgatcccagacgggatccttcccctctacagcgaccgcgaccgggagagtatcctagccgtgatgatggcggtcggcgaggctagaggtcggtcccacgggggcgccgctgggggcggcggtggcaacggcgctgggagcagctgttcggcagcaggtggcagtcgggccggcggttccggcggtggcggcagcttcagggcgcctggcccgagccatggggtgggaaaaggcccggccaccgacgcgaaagggaagcggaaggtttctgggtccgagccgccttcccctccacacggcggcgtcgccgagcacacagtcgaccggccaccgaccagccacaagcgtcccgccgcggcggagccgaagcggaagaagaagaggcttttgaagatagggcaaacggagccgtgccagcggagcttcatcgagcccccggagtagaccttcaaacgcccccccccccaccccacaggtacgactgccgccttcagattccgttatctctcttcgctctagctttgcctttctctttttttaaaaaaa

SEQ ID NO: 71729 - DNA, 5729 bp, Oryza sativa
  unsure (1)..(5729): unsure at all n locations
tttttaagaataattcaaaacttggacacatgatctcatagttcatagcaaagccctcctaaccaactgaccctacaacactatgtgttttgagatcatatattggtttttttatctatatatttgatcaaattttgtgaacccaaacccgtatatgtactgtaggaatcatatcttgttactacaattcggtagtaacattatcgaacaagtgcagtaacacgacacgttactgcgaaatttacaggtcggtgctatgaaatttatcggtcgttactgtactttttgcagtaacatcatgatgaaactgtagtaacagagaacatatgttagtaacggtagtactatagtaccactgcttatgcattgctaaatttttaaatctcaatcttatgtaacatacaagttgttaatatctatatgaatgttggtaatgctagaaagtcttataacctgaaacggatgtagtaatttatagaaacacccagacatgtgtctattaacgtataaaatctatatgctttataggttgattacatgttttcttgtttccatcgtattatcgttatggatgctttgcttagattaattccctgcttttgatctatatgctatggagaaaaccgtgtgagagaaatcactaaaattgatgggaaatcctggattggagacatgcctaattcggttgagccgaatcggccgactcttccgcctccctcgcatctctctgtttctctctttctctaatgacgccacgccgggaacacggtgacatagtctcagactgtttggctggacttggagacatatcgatcgtcgttcgtcgtcgctgttgggtatgccgtcgaccttgtgtcgatgccatcgtgggaaaccaccgtctcggagaaagccctaaacccatgtcgccgttgctgctggagttaatgtcgaagcgaggtgccgccaccattgacctccgtggtgggaggatatgggtcatcggttgcctgctactagattaacctccgccgagacaatatggccggatgcaatttggttgttgtcgttgagttcgcctcgccgccgtcatgaggatgcgcgggttgacgcagagctccgtcgtatgccaccgagccaccgccgtcccaaattgccacacgggagtgatatcgtaacaatcatatcaaatactcccttagtaaaaaaagacgcaatcctaagtttgaacctggacacacatatatatacaggtttaaactcagtattggtttacatttttagggagggagtaccataccgtacataccatgccagtttaactcaaagcaaaccatgcatcttacgggatatgtgacccaaatattctactacggagtacactagaataccagaccacagcttcaaaattcgttgctactcgcaatctgccactttgagatgcttgtcaggaattaaacaccgggtgcagcatctgcgttgagacccgccggttgattagcagattccggttattacccaaatatattttatctgaaaaatcaaagatcgatatgattgaaataccgcgagcgataattagtaaaccaaaataatgcaacgtaactatatatatatcagtggtgtaactagaatttaaaataaatgtggtccatctatatataatagatcaattaaatgggtgatccactatataatttttattatattaactagcacatatactatagttttaacctcgattaaatttttaggtggtctatggaccacagtaccacctagttagttacaccactgatctatatttgtatctatactaatataaaaataaagagttacacccctccattcctactggccaaatcacccgcaccgcatctaagagcagggctaataagccggtgattagccggtggatctgacgtggaagggaaaaattcttctacaatcgcctgctcagctcaagcgcctaggcagactgacaacctaaacccacgttcagagaggggagtaattaagagtgcacaccaggttcacaacaaatataaaagatttatttattgatatgtatagcgcttaatccatcggcgattaatccatccatcgcctgcgcaatccccgccaccccatgccccggctcatgctccgccctatttaggcggctgtgttcttatcttcaagttcctaactcctctccctcattttatatgtacacgctttttaaacgactaaacgatgtgtttttttactaaaaaaattctatacgaaagttgctaaaaaaatcaaattaatctatttttttaaaaaaactaatacttaattaatcatgcaataatgcatgctccgttttgcgtgtcactaagctctatactccctccgtctcaaaaaaaaagacaaaccctaagtttctgtgtccaacgtttgaccgtccgtcttatttaaaaaaaattataaaaaaattaaacagaaaagtcacgtataaagtattactatcatattttatcatctaacaacaatgaaaatactaattataaaaaaaatttcatataagacggacagttaaacgttggactttttttgacagaggaagtatatcattattgctgtgcggcgcacgttacggcacgtacccatccccaccggcagagcgtgcagctcctggagtaccacgggatctcgcgtgagattcagatatatccggctcgagcaacagccaacagctaaccagccacgccaattaaagctgctgccattaacagtgtgaggttttcaagctgctagttgatgtagtatataccttttgaagagctaattaattccttgttaccggcagcattttgacagctcatcgagccagtaatctacattgattgttaatttgttccatgtagtaatgatttgaatgatggtcctgagtaatgtaaggttgtgctgtgtttaattcacattaaaattgcaagtttggtcgaaactgaaacgatatgtcggaaaagttgaaaatttgtgtgtgcagaaaagttttaatgtgataaaaaagttagaagtttaaaaaattattttggaagtaagcacggcgatagaatgagaacatacattacatatggcattcatttcatataataatgctactggatctcaaacttgtatatttctgatggtgtgtttctcattttactttttgcagctcaatatttttttctccatgcactcttattctcagattgtttgtcataaaattagtaaaacatcactcatcctgtccaaacatttggaaatgaagcgaacagatattaacggtagctgaggtatgtcgattactttcgctctgaattaacttgacagattctataaggaattataaatgcagctgttaatttgatttacctttgtacatgattcaagattcaagtgcaggagctggaaggtttttacccctgatcaagaagaatatgaaccttatggccagtgttcactgtggttttacatcatgattcacttgatttatgccaaagtgtaaatataagcccatcaaatgtgtcgtgtattttcctacgtcgctcactgggataggttctgaacttctgatcatgtctctttaactacaattatttttggcatttataatttttgatagccacactttaatcatgtagataacaaaatttcttggtgatattgctaatttcagttgaattaagtatagtaaagtatgctagagagaattatatctccctcactgctgacaaagggaagaattggttcaaaaagaacatgtagcagaagaaggaagcatatctagagcaataaatttgtctatctctacttctatttgaggtgagctgaaaacaatctataatcccatttgaatacaattagcatataaatacatgtcataaactcatagtgttgtggtataagcttttgtatttgaattcataatcaacaagatgatctgacatgcacatcctactacagggagcataggacaagcttgcaatgaacaagctttcgaagaaatgcgtccattcaataagatgatttttttttctctacagctaattcaggccgacaacaatgttgaaatgatttttgtaagcaggaaatcaatgtcagcaagctgaattgacagcccgctcctcccgtttacagaactcaccaacaagtaagagtattcataattctttcttctatgtttaaattggagtttcgctctctctcttatatatgtaacacatgaaaatttgaaactattcctatgctgaatgaaaaagatatcaatgttatacatgatgccattgtatccttatatttactttttctatgtgctcggaaaaatgatctgtcaattttatattgttgcgcattgttgaggcacgaagcctaaaacaattttaaagtcattgttgttggcaggcttgccaggtaaaaaagatagaaaccacacgtcatgacttcaatttagtttgtataggcagtaataagtcccataaaagacaatactaagaatttttttgggtaaaaatgcatgttttttccacataaagttccctgtaatagtaatatgatcgaatttgatatggattttcacttgcaacttttcttctttttgcagcaaacttatttgcaaagcactcaattcactactttgcaattgcttcacaagttaaattcgtgctttgaaatttatacaactcattcataaatagcccaccatccagctgcaatagtttcgatgttgaaatgcttcaatataacattggaacactggggaaactttgattggaggttggaaagtgtgaggaaaaaatttttatggcatcaacatttaatcctacatgtgctaatgacggattaattaggcttaaaaattcgtctcgcggtttccatgcaagctataaaattagttttttcattcatgtccgaaaacatcttccgacatccggtcaaatatccgatgtgacatccataaattttcttttcacgaactaaacatgcccctaatcaggaaaaggttagcgcaaaaggtatgcgtgttgtgaaacaaatatgtaggagataagtcacggacgaacgacatcacagatccgcatggtgacctcggcctgatgagacgatcgacgacgacttttgatgatggtggcgcaacaacggcgtgcgggcaccgggcagcggcgctccgactggcaatctcctctagcggcttgacgatgagcgtgataaaagtagcanagccgacaggggcgagcggtagggcgtcgccgacgagatgatctcccagttgatagtggcttctctccatcgggacggcgccatcttgcttcgtgttgagatatcgaccgacgcgggcgccgggcagaaaggggagaatatgcatggcaggcatcacggacggatggtctgcatacgcaggcgcgatcccaggccgtccggctcatatgcacgtacatctgttgatctcttgttaattggtttagcaccggtctacttctgctggtcttgctagctagtgaagcatgcatatatatatgcgtacgcatacatggccgaattcacatcacacatctaccctcccaaatgtcaggccacctctgtacgcacatgcatgcctgaatcatttaattagcttgctaattaacctgtttcctgctgcaatcaaccattaacacacaatatacaagtgattatattttataaatatgtacaaaataccatcaaacatatgcattgtgatattaaattgtagtgctgta

SEQ ID NO: 71730 - DNA, 4798 bp, Oryza sativa
ttcaaacgcccccccccccaccccacaggtacgactgccgccttcagattccgttatctctcttcgctctagctttgcctttctctttttttaaaaaaaaagctactgggattttattgcagtgaaatcccttcccgagggggctcgacagctgagccccccccccccccccccggatctaagcccgagaggtcggggcggccggaggccggccgaacagcggtcgcggataccacacaaccctccagcggggcttgggggcctcacactgggtccggctctgagtctaccacggcttagaccatccccgtaaaggaggagaggaccactggtggagttccgccccaacctcaccgagaagtatgacgacatcgtatatgactatcgtgctgctctcggcttcccgagggcctcgacgatgtctgggctgtcgatcgccgtgacatcatggccgatcgacgggccctcctccttgctgatgaggagagggcagtggtggtacgcgaggtaccagtagctgcgggccggctgccggcggccagttgccgctgcgcggcggtgaccaggttggccacgtcgtccaaccaccgctgaaccggggtttccggctccgggttggcagcgggggtgccacaaaagggcctccaccacctgaagcgcgccctgaggcggcgatgcaccccggcgcggcgtgctctccccccgtcgagcaacggggagagggccgagccccccgactggtcggggttctcccgccgtcgagggcttcagtgagggggagtcggagagtcccgacgatggtgatggggatcgtggctcccgctatcatcctttgtgagttcggctaggggatagggcgcgatgatcaagagcgtatcttcgcggtggattacgctagtaaggtggatggcgatcaagtgagagatcagggattatacaggttcgggccgctaggaagcgtaataccatactcctatgtgtggaattatgcttgtgctgttacaagagatcgtgagctcctaggaaaaccccactgtgtttcccctagagttcaagctaccaagagccattcttttgctcggcgggtaaggacctccttttatagttcaaagggataccacatgcaccgcccctattcatctcatctttcctggaggggggtccctcttcctctggttccgctcccgcctatgccttagaccggaagcaatgtggctgcttgctccgaggtgggtccaagcgccgtctcccgtctgacacgggagacatcccctgtcattccctcattaagctttgaagacttttgtgggctcatgcttccggggacgcaccggccatgcgtactgagccctaatggccgacgggacggggcatacttgcccccacgctgcccgacacaggacggggcacgggcacgctaccccccatcccatccatcggccaccggtcacagaccggtcgtagaccggcccaagtgattgacgcacgtcaatcacttgggcggcgtcgcacggccaaccacgccgcatttaatgcgatgggggtggttgggacgccgatcatgaatgtgccagcggcgtcccctcctccgcccactcagccgccacgcggcagctgagcgagggcctctgggtgacacagtccctcgggcccgaggggtgcgacgaggccccccgaggctcctaggtaggtatggggcgcccctcggctacctacacgtggctagggggaagggctccttcactctttccccctaacgtgggtaccccgggcccatatcaccgatagaacccgatgcagcccaactcgaaagcaagaactcgtcgaaaacaatgaaaatagaaaaggtggcgatgcgccgaaaatattattgaactgtcgttattttgtttacaaggccttgagtcatatttatacccaaaatacataatatatccttgccggacacaactccaaatatgttacaactctaagatacgaacaagtcttttaggtagactcttggcaacaaatatttctaaagaaactattcaaaatactctaattaatagatacaattgcccttttttcggacttatcccaatcgtggcagcacttgctcagtacgtcaatcgattccgaagatgattctagaaccaccctaccaagatcggctacatcggatgttctttgtccgatccaatgtcagccgatgcagacgttagccgatgtccccccatagccgatacatagtctgtttctaagaaacgacctcccgccaaatccgcttcgactttagcttcgaatttgatgcatgatttaccaaatttggtcgtcaaaaggtagcacctgacaaattccctgagtatcagttacaggatggagtattacgtttccaagggcgtatttggttgggtaataaggttgccgttcagtctaagattttggctgctttgcattgttctgctcttggtgggcattccggaatttaggtcacttatagtcatatacgccgtttgtttgcctggccaggtctgaaaaagtctgtgcgttcttttgtctctaattgttctgtttgcaagcaagcaaaggctgagcgtgtgtgttacccgggatttttacagccattaccagttcctgagtatgcttggcagactgttactcttgactttattgagggtctaccgtgatcatctgggtttgattgtattcctgtagtggtggacaagttcggtaaatatgctcattttatggctttgtcccatcctttcacggtgtttgatgtggctatggcttatctgagttatatctacaaacttcttggcataccacaacacattatttctgatcgagaccgtatattcacgagtgccttgtggactgagttgttccgtttggctgatactcaacttaagatgtgttcttcataccatcctcagaccgatggacagacggaccgagttgccccaagaaatggtttcgatggcttgcttggacagagttttggtacaatactgcttaccatttggcgctggataagtcaccttttgaagtattgtatgggaatcagcctcggcattttggtgtcagtaatatttctgaaagtgtcgtttctgatttggatgaatggttgaaggagcgggcaataatatctagtctgttgcggcagcatttgttgagagctcagcagcgtatgaagttttaggctgataagaagaggtctgaccgtgtatttgaggttggcgattaggttttcctcaaggctcagccctacgttcagagttcgctggctgttcgttccaaccacaagttgactttcaggtattttggaccttttccggtgcttgagaaagttggagcggtggcttatcgtctgcaacttccggatgattgtgctattcatccggtggttcatgtttcctaatttcgtcaagcatccgcgcccagtcttgattttccggtacgtcttccactggtggttaatcctgacaccattgaacctgttcaagttttggctcgtcgggttttgaagaaaggagctggtacttctgagcaggtccttgttcgttggactggacaaatgtcggaggatgcaacttgggaagatgcggggatgcttcgtcagcaattccctactgcaccggcttggggacaagccgattttgatggagggaggaatgttgcagactctacagtatctggtacggttcctgatctggcaatctatgcgaatccagtgaaaaagataccagtgcgagcaaggcgggccaacgtaggaatgggcctgagttgtgttgtaaagatgcggctatataagcatctgtggtgtggagaaggggtatcgaatatgaaatggatgtgactacacagtggtaccacttcctctataagagatactatccacctatatttcaaatacaattttctcttaaactacttatccgatctacgatccgattacatcgttatgttcgtaacaattaaatctttataataagatctcacatgattatattttgatgaaaaataataaattacttttataatatatctaaattacttttaaatttcactaaattacttcttagacatataaaagtaaattaaataaagcctaaaagtaatttacatatattatagaagttacttagaacaaaacgaaggaaactttaattaatgtgttttttcattgaacaaattatcatatatttaaagttacttttagatttgattaaaatacttcctatacattcgtaatgctataaggtaattacttttattattgtttttagttaattccataatttgtgctgattaatttaatttctagatagagccatatttttatctctataacgtatttacttcaaatgacatgccaaagttaccttcgttttatgctaagttacttctataatatatgcaaattacttttacttttagactttactgaatttacttttatatgcttaagaagtaaattagtgaaatctaaaagtaacttagaacaaaacgaaggtaactttaattaatgcgtattttcattgaacaaattatcatatatatatatatatatatatatatatatatatacacgttacttttagatttgattaaaatacttcctatacattcataatgctctaatatgattacttttcttattgtttttagttaattccataatttgtgctgattaatttagtttatagatagagccatgtttttatctctacaacggatttactttaaatgatatgccaaagttaccttagttttgttctaagttactataatatatgtaagagtgaaatacatg

SEQ ID NO: 71731 - DNA, 1713 bp, Oryza sativa
aaggctggacagatggagaacgctaacatggcctgcgcagagatgaaggccatgggattaatgcctgactgctgcaccttcaacattctttcggctggagcatacaagtttgggaaggctgcgttgtttgtacttgatcagcagcagttgcatgaaatgtttggttcacagttgtcaacagatgggatagatatgttgatctgtagactttgttgggatgggcgattggatgatgcctgggagctcctgtgtagcgctattgagaagggtgttcaagtgagcgtttcaggatttaatgcgctgattgctgcatatagcaaggagggatttgatgaagaagcttttgagctatataaaactatgaacaaattaggtcttgcaccatcatcatcaactttgaattacttgataatgggactgtgtaatcgtgggagacttgatcaggcacggctgttcttagaatatatggttagaatgggatattgtgtgattgcatcttttaccatctacttggactcatccttcagagctggtgatgtattaggtgccttgaagtgttgggatgatatgaaaatagttggtttacagcctgattttgttgccttctcggcatatgtcaatggtctttgcagactagattttctagatgaggcttacaatggttttatcgagatgataagaagagggcttgttccaaataattttacttacaactccctcatatctgcattttgtagggctgggaatgtgtctgaagcattgaaattagagcagaagatgaggcagagtggccttgttcctgatatttttacgaggaacattttaattgatggcttttgcagagaagggggattgaacacagctaataaccttttctttggcatgtacagtattggtttaactccagatgttgtgacatataatacaatgctcaatgcatattgccgctctaaggatattaatggtgccatgattttcatgaataagatgcttgcagatggctgtgaacctgtatattttcacatataatatttggatgcacagcttgtgtagcaaccatctgctgaatcgagcaatgatgttactggatgaattagctgcaacggattgtgctcctaattctgttacatacaacacattgatggatgggatctgcagcgatgttctagatcgggccatgattctgactggcagactgattaagttggcttttcaacccaacactgtcacaattaacattttgttttctcatttctgcaagaatggttttggaaagcgggctcttgtgtgggctgagaagctgagagatgattccttcaattttgatgatgctacaaggaatatacttgactgggcatacagggatatggaggatgatcctcatgctagcagtgcagacattgataagtgcctatttctcgagttcttaatgctcatgacatgcacaactattcgcaacagcagatccttcaagtttacacatgtacctataaatacagtttttggtcattctggcagaaaaagtttggatactggatgatcattgaaatgttgaattcatatccgcgtgagctactggataattttcaggtcatggacagctctgctgcaggagtaacatattcactgttatgctttttcatgactgacagtgcgataagatgcaatggctactgttcacattgttactgtcaaatggaaagtcaaaggatt

SEQ ID NO: 71732 - DNA, 37440 bp, Oryza sativa
  unsure (1)..(37440): unsure at all n locations
ttctctatacatgcaaggagaagaatgagagggaagaacgatttgagaattttttttgggattctggtgtcactatatagctataaggagatatacgcgacgtgttgtgatgtggagggggctgtgagcaaaagtgttgcttacttggcatgccactttagcggtcaaacgcagtcaaaggacgattggaccggggtggtacattaaactaagtttatgggcctaaacgtgcaattttcaagttcacggacctaagtgacaccaccacacaagtttagggaccggccatgtattttactctatatgtaaattacttttagactttactaaatttacttttatatgtttaagaagtaacttagtgaaatctaaaagtaatttagacatatcataaaagtaatttatgattttttattaaaatataatcatatgagatcttattgtaaagatttaattgttacgaatacaacggtataattggattgtaaatcggatgagtaatttaagacaaaattttatttaaaatatagatgataggaatattttccctacttacttaatggattagtactatagtaaagtaatattcttcgaattaatacatatcttaataatgctgatggggtgtgctttcgatttagattttgcgatatgaaataccagaacactctctaactcaattccagattgccttccccgaactttgttcttctctgaacccaaattctgagtctcttccaaaccctagcgagttcataacacgaggggcggagcggttgagcaggagagaagggacacggcgaaagcaaaaccaccatatatccatcgaatcggattgagtccacggcaaccgcaggctccaaatcggaatctgcttctgaagccgatcgaatttggatccggcgaggaggggaggtcccggcctgatcctttttttatttatactagcaaatgcccgtgcgttgcaccggtaatttcgtggtagataaagtttaaccggacgatttttttaatcacaaatgttttcttttgtttggtcaattattccacgtgtacgtgcaagatatgaagtatgttcatgacgcattaatgtaacgattgtgtcatgggaggaacaaatggtgaatgccttaggttaatttcacgcaagaatagatggactaaaatttatatatttttggagtgatcatgtaattgatcataattttctagtaattttaaatggttcaaaataataccaaagaaaattatgtaaatgattaaatgaattaaatcagccgaattgcaaatgcccctaaataaaatcttatttcgaccatactttcgtaaccggcaaaaatcggcccggcctgtttagcgtgtgcgcgcgagctgatcgcacggcgagcagcacgtggcccatccactggcgacggcccgacgcggggcgaactgagcagcctagttgtcttccacggcccaatgaccgcatggcccaacagcggtggcggcccaacgcgaggtcaatctgagttgtctgatctgatggacagctcggatcggtcccacaccgatgaaaatcaccggccaaaggggagggtccgaaaaccctaatctccgatgaattgctgatacgttctttctccttctgtctccctcctccacccgagttgttgctgaccaaatcgaccaccggctgcttcatccagaggcttctcaaaatcaagagtctccaacaaagccagataagatttattgtctttaatctacagccattcacaaaaattcaataaatgtacttctcgttgtacttctcgttataaaataaaaagacatgttatagtatgggtttctcatcgtaacaaaattttcagccttggggatttccacttaaaattcagcaaagcgcgtaaacatctggaaacaacatccagtacttaatgatcggtagctagaaagttttcatctgtaaaaactgttctgcgaaaccaaccaactcaactcatccattattatctcggctcctcctaccacgtgtcaaaagaaaaactcctcccaaccagtctcccttctcctcctcctactctattctctctccaccttatctgctgagtaccatccacgctccacagccattcttatctccctcttcctcttctctctcaccctcctcttctcactctcttcatatcctttcctctctcgattccttcatacagtcggctcgcagtggtgagcgcgtggcaatgccggatccagccgccgctccggaccccacgcgcacgaatccggccacgccggggtggatccggcttggctacgagcggtgcctgtctccccctacgcggatccggccgctactccatcccccgcacgcagatccaccgcgacagcgcggcaatggtggatccaaccgccactccggcccccacgcacgtgaatctggtgcgagtgacagcacgagtgattgtggtgacctcgacctccgatggttggcgctggccaaggagaaaggggaggggcggcggggctagggtttgggttttttattttttttttcaaccttatggaaaaataggatttggccgcatggaagtatggctttttagtattgtcttaataaaacttaaatttttgtgaaataatctagaacgacaactatttaatgacagaagtagtaaagtggaagaaccggtgattttgatatcaataactaaaagtaataaaaaaataaatcatcacttgcatgtgaacggtgttgtgtgtctctatacattagtagttaatctcaatgaatagtagttttttttttgttttttcttaaccaccagtaagactattaagatcctactatcaatcctgtagattaccacaattcaaaacagtcaacagtcaatggcacttgacggcacttgaccgcaaataaaaaaatatcttgagcggtgggagagatatgtttagttcatttttgcccatgctaaccaccccatgctgtgggacccacgggcccaccatccagtgcactgcacccccactccaccgacacagcacagccacaaaccttatcccaatccattcccaatccatggagtagacgaggagaggcaccagacttgctctctacatggaaaaaaatccccaatccccaacttgctgtctacagaaaaaagatccccaatccattcgtcggtgatttagagcagcgatggagggagcaaacggcgaagatgtgccgaggaggacatgtcggagggcatcggggatcggcgtcgtcgagcatcgcccatgattgggcgtcggatggagcggccggcgtcgaggtcagcccacagtggagcagcggaaggtgaggacgccctgctctgccactgcagctcgggactcaggcaggcggggaaaggagaggaggacctgtcgcggcgatgcaaatagctgcgcatgcaggcggccaaaggcgacgattgagcaagcgagcgatggcgtcctcggccttggggagcagcaacagcagcgacggcgtcggcgagcagcaggtgcagtgtcctcgtcctccacgagcaacaggcagccggagcggcggcggcgtcatgtcctttgcaatcagcggacagtggcgtcggcaagcagcgtagcaggtgcggcggcctcgaccttgacgagcagttggagcagctctgtgcgggaggtggagatgaagatggtgggtggatcggaggggggagccgctcctgtcggccaccagctccaccccgtcctcctctcctcattgcggcggcgacggcctcctcctccatcccctcttccggtgttgggcgcaggagtaggcgccagttggagcgggcgctgcggcgatggacgcgacggcgacgagcacggtcgcgggtggcggtgaggactgcgctcctccatccccgatttcctctttgtgatgaatgttttaagagatttttttttcttttgcaattttttccttttgttggccccggtgatttgtgatgattttgctcaattgttgttgtatttgtgattttgtgattcatgtttctctcttttccgtgcatagttcttggcttagatgaatcggattcttgattttgatttcgattcgattttgattttgttctctgttcgggcggagggcatcacccgtggatgaacgcgtaaaaagatacggatgaaaacagattgacgaacgaaaataaaataggtgacgattggaaaaataccaatcttttaattagttaagataagatatagaatagattcacggacggacgacggacgcccccatcgaccatcgtctcctcgccgcaggtacctcgccctgctttcttccccaatccccaatccttcattcattagctagttttggtatgctcgattgggtttcaagtcggcgacctagttcgatctgccaaaaacttttaattattatcattttttttcatcttccaactcgtacctgtcctgcacaaccagatttttgtgcctccttcccttcctgtgtatgattcctacattaccaaccactgggtcaagactaggttggtgcctggtgggggtgtgggagtgggcagggcaggcgcgtggtggtcttccaaacaatcccctccctcctcctcgtctcttcattatagaatatatacagtattatgatactatgatgactgacaaggaacaagaggttgaggaaaatggttttatatattcttcttgtttgggcacaaggcaatagcttttcacttagacaatcaaatccaatcttctattagtagttgggatcagtctagctagaaaactagctattcatcccttttctattcattttcctgtgattagaatgaaatacttcttttttactctctctctctctctctctcatattgggttctggtttggttacaatcaacaaacatacaagtgtttttttcgcacatttcttcttgtttgatacccgtgtgttgctctagtgcaccattccaattattttaatgcctcttcaactgtgtctttacataagaactacactgaaaacgttgctcaaccattgcttcctgcttgtaggcttcacaggtacaaccatttcagccagaagagcacacatggatgggatctgtctagtaaacaaaaaaaggagactgacgctcaggccatgtgttgaagtagatcacagcagcaagcgggtaagatcgcgatgtgctaagtttgagtctctcccagaggtatgtaaaattttagaatgaactgttctctactgaatgcgataagggactggatgctgatgcttttgttcaaactcactaccaggacatagtgtcaaggattatttcacaactaacattgaaggaagctgttgtaatgagctcgacatcgaccaagttgagaagagcttggatttaccatcctaatctttacttggacacttcaatagtgtttggcagttctgatcgccagaagcgagtgccgagcactgagacgtttattgacacagtcaattttatcttgaggacgcacagtggtttaggagtgaacaaacttgctgttatgtttgagttgaggaaggagcatgcacatgacattgatggatgggtttcctttgctgttacatccaaggcaagggttgtcaccctcaacttttctccatatcatggatcgcatgatcgcagttacaacttcccatgtcatcttttcaacggcaaaagtggatctcaccttcaagttcttcaacttgataccgttactttgggtccaagtcctcctggcttttgtggctttgctaaccttacaatgcttactttggagaatgtgcttgtattgggcgatttgcagttcttactgaaatgccctgcccttgaatggttgactatccgaatgtgctcccagttacataatttgtatgctcctgaaccattgccgcggttgacatttttgtgtgtacaagattgtgcaattgacaagattgatgttcatgcccctaatctcaccacatttaagtatagaggtcgttttaaagttattattgcccttcgggaatgcttgaagcttaagactgcaagcattgtatcccccattgaggacaacctttactatattttcactgagcttccaaatgggttacctcatgttgagagactacacgtgaatgtttttgtcaagactcaggtttgttaatcccaatgcatgccctcaaaatcttcaatagagtgtatcttctatttttgtttcagaaatttgttttctaactttccttgtcgtctttcagatacctggatttactcaggccccttacaaatttatcaatttaaggcatctgaccatgaggataacctatgaaattgctaaacgctttggtagaaatgcagttctgcaactagcatatttttcggaagctgctccgtttttggtggaccttcatttggatgtgagttgttatgccatctgcactttcatcctgtttgtagttataaatactatgtaatctctttttttttgccctttactcctgtaatgtttccagacttgctttatattgtctacttacttttaagtattgccttgagtcaaaattttgaaaaggggggcagtccagcctgttatattaaatgatcacttaaatctggccatgagtggaatgcagccacatagttctagctattctgcaactattggcaaaatactattttggtttctccattgaaggtttctgtaacatattgacttggtcaagaacagttcatagtcttacctagcttgttgagtatcttgattgtgaaaagacttgggagcaatcttgctaggtaacctacaaaggtggattgagaaagcgattttattatttataannnnnnnnnnnnnnnnnnnnnnnnnnttatgaggctattgcatatattttcctgattaagtgcacataggttgtcatgctattgatttttctgtaatgacagaaggtgacaaacaattttgtgtgcagatgctgtgtttagatttttacgagtcccgtcctgcaagagacgtgattatgaatcgccctcactacagtctcaagagagcttgcataaccggattcaatggcaatggagggcaagttgcactagtaaaatttatcctcaagaatgcagtaaaattggaggaaatggttatagatccaaaaggtagaataacgaaccaaatgatgggagagcacaaaggccgtagaatgattaaggaaaaacttgttccaaaatacaagaatggcctacttgtaattctataacttctcaagttatgcattctgtttttctcaatgaatttaagttatgtctgggcagtgatatatttacttgccctttaaccctttttttttttctgaagcaacgataataaatattttatgcgatggagcatttgctaagttagagtactagtagagtagtgcaaatgtactagtattgtgattgtgtttttctttttgcaatactgaagggaagggtcatcttggtctgaaatgaatttgcattttacaagctcctacgagaaaggtaaaaatgagggagggcagcagttgcaagcacactgttggatgttactcccttcgtatcgttttgacttctttatcagtcaatatatttgactaattttatagaaaaatataataacactttcatcacaaagtaaacatattattaaaatatattaaatgctagtctaatgaaactaatttggtgttgtaaatgttgctaaaattttctataaacttggtcaaacctaaagtttgactaagaaaaaaatcgaaaacaatttataatataaaatagagggagtaatttgaaagtttattatatgcatttagcactaattgtgaacagttaatttttatatgtatggctggaacattgtgcagctccaaacctgtgttttcgtggaacaaaatgtgtgcgcgtgttttatattcagaacctactaatatgctaaccattctggtttctgattggctatattgagaaccttggtcaccatacatacacaagccactccagtagtagtgctagtgtgatgccaaattgttcgagggtagttgtgaacctatgaaatctgataattagccatatataaaatatgtatgcacaattgtggacacattcattcagttgtgataacggacatttatatttactaaaaaggaaaaatctgagcatccatgtttagttttgtgaaacagtctacacattcagttgacaaacacaagcagtgagaagcgaaggtaaggaccaaaaggccctctttatttagacccataagtcagcttaaatgagtttaagtataagcctaaataaataaataagtagcttttatataagccactcttacacattattaagccaaaaaacctttttttttcttatgtgagattaaggtatgactctattcttaaacttagaactttaaattcaccgatatataaatcatataagccaaaaaactgacttaaaaggctgaaccaataaacctaaacttaggctgtgtttagatttaggggtgaaaatttttgccgtgtcacaacggatacatgtacacatatttaaagtattaaacgtagtctaataacaaaacaaattatagattccgcctgaaaactgcgagacggattttttatttgacccaagcaagacggatttattaagactgattaatccagcattagcaaatatttactgtagtaccacattgtcaaatcatgaagcaattaggcataaaaaatttgtctcgcaattttcacgcaatctatgtatggtgcgacaaacgataggccagtagaaacttaggatacacctacggctttgcaactctactaccggctatgggcagcgaacaaaccaccacgaagatgacgcgagatagcggcggcgttgcacggtttgggacagctggatcggctctgtctggagctggaagacaacactgtagcggcaggtaggagaattagacttatggctgggtttcctttattcggaccgattgaaggagggagcaaaactggactctgggaagggataaagccagtcgaaaggaagggagaatgggccgaggactgaaactgaacttttcctatttcggcacgaaaaggaaaaggggattttaattacttttccaattaaattaatcactgaaataatctttgaattgttaaaaatacttccaatgctcaaataatttcaagacaaatcctgaaaatacttggacactataagtatttaacaaaattatatgcagatcatttaatgattaatttaatatatgaataattactgaaatgttctttgtatgattaaaattagtaattgagctctaaaaaatccaaaaaaattccagagagtataattaatcatggagaatttaataaaaattaaatccaaccatgctttatattgaggaaattttatttcccacatttaacttcacttgtaaattaatgaacatttaatataaattctaaaaataatttataaattctaaaacgaaaatcaggatgtgacatccttgacccgctgcgtcacgacatccgcgcggagagctgcaacacaaggaaaaggcgaagaagaatcagacatagagcttaaaaatgttgtcatcagcaataagagggatggcgacgcgagaacgagtaccccgcgatgatatccgcggcgcgtcagaagctccctcataatcaaacgcgggatgggcacgggcttgcagcggctggatgtgtcgggcaatgaagtcttgaacgacttcatacccggttagcccctgttctcacaaatctccaatagtgttcgcgaagacttctagagaaggattgaagggaggtttggaagtccagcagtcttgtcggacaagctagtccttggggacgacaagaaccggatcgagttcttctagctctagataaaaccacctggaccgccacttggaccgggatgtatggcactggagagatatgtatctcgtcttcatgccatcacgcaggcgaaacccgcaacatcccgatactttgccggcttccatccaccggagtttaaagaaaaaacagaaaagatccgagaagggcactaccccaatgtaggcctcgcacggatgggtaaagatgcttaagaaagcgatggagttggggttgaggtgcaagagagaaaggccatagaagttcaagaccagcaaaaggaattccgatggcggcggtagaaaaccatcgcgaacgaaatcttctactactaccatatgacctagggcaagggaaggagcagtacctccttcttcttgggccatgtcttgctctggaagaagggctccatcggtggagagcttcgccagcgttgctagatcggaggtggaaatagcaaggcccgccattggaggaagatcgctggagcaagacgtaaaaatctaaggaatttgggagatgaaaggtccgagactgttggaaggttagagaacttttcggcaaatggacttgaaatggatcccaaaatccctttaaatgagtgcactacctgacggtttgagtttcgaggaaagagagagattgccgccgaaaaatcctgaggcccattaagggcagttgttcagacttcaattcaaattcatgattagacagtcggacttctgttagtgttgtcaataactccacatcttctcggtcccataccgagaatgatcaagtgagtacgacaagccgctgatgagaagtcacgaacgacaacatgaattcatttgagttgaagtcgggggctactgtcagggttacagataaggcatacctcctatcttgtgacttatagaatataccgataagatataccttcatgtatacggattgttcccatgaatgttgcgtggtaaccgattcaggttatggaaaatatctctacgagtcaagtgatttccaaagtcctactcggaagggatagaatttatgttataccgtaccaggtccgatatcctcaaaccttttcttggggatcaagatgatccacggtataaaagggaccccctgggaggggttcaaggcatccaattcaattgccagcacacccaccaaagtttacaaagccagagtacgcggtgtcaactcgctgggagatctcgtcgaattccttgactacgatctcgttggtaccacctgtttcgactactctctttgtaatatgttctcattgtcatcaatctcatataaactggactagggctattacttgataaggggcctgaaccagtataatccctgtcttttgtctgcttgatgtcgtactatgtagaccctcgttccaacgtaccccaatactctactcatccggtccgcgagtatcactcgtcgacaacaatactattttactttcgcttgtcatacaatccgaaccgtcatttagttcggctatattttcaataatgctattgtgtaagctagcaacacaatccgaaccaacacttggttcggctatacatgatgtttcattatcatctaaactagcatttaagatattgtcatccacccggctttcctgagccagagcttcatgcaacacatgatcaatatcaaaaatatctagccattcaatctctttttaatagaatcaagcaacccattatatgcaatgtcggccaaatccttttcaattgtatttaaactaaaacatcggcttttagcatctctaaacctctcaatataatcaatgacatattcatcgtgtttgttcctaaccgatgttaaattagacaacctaagctcagtttcactagtgtaaaaataatcatggaatttttgttctaattgagcccaagtataaatagaatttgctggcaaagaagtaaaccaagtaaaagcagtatcagacaaagataaagaaaacaaatgcactttgagaacatctttaatactagcttcgccacattgtgcaaggaactagcctatatgttcccaagtagtcctattatcctcaccactaaagttagtgaattcgggaactctataaccacgaggatatgggacattatcataataatcaggatacgacttttgctaaaccctagcacgattccttacctcaattccgaaattttccctgataatattcctaatccgatcctccatagtttcaggccttggttgtggatttgatggcctaggaataggtgtttgtggcggccaaggaatcgaagaaccgtcggttgtccgagagaatatgattatactggccataatgcgtgttttgtaccaatccatatacttgatgattttggactggctcataacaattgttggcataaatagcatgggtatgtggaatagcatgactaacagtattaccaggtgatgaataataattaaagttagtattgctagtcgtggtatgaaaacatggagaaatttctaaggaaccgttttgaccgcccacctggtcgcccggtcagtccagtggtcagtggtgcggtcagaccggccacagaaagcccgatctggccaagatagggcatggtctgaccggctatggtgggcacggtctgaccggcatagtacatagtctgaccggccatggtgggcacagtctgaccagcatagggtgtggtttgacctgtgtcacgaccggtcataccgtcagctaggttttgcatatagccgattcctgtgcaatcggctgtataaacacccattgatccatccatagcattataagcatattgtatagcagcaaaactagaagtagcaatgcatctacacaacgatcattaactttttgaatagcaagggatgggttggatgaatcggaggttacatttggtgaaactatgacttgaggtagcaggacgtttcttttcacgacgccttgatcagtcctaatgtattgtgcaagatatatattccttcttccacaccgccatttgttcttcaaattactgcagctgctcctcgtccaaatcctaatgtattgtgcaagatatatgacttgatcagtcataatgtattgtgcaagatatatattccttcttccacaccgccatttgttcttcaaattactgcagctgctccttgtccaaatcctgcttagtaagcttattgatctcattcccgctcgctatagttgatgaagaaattacttgattaatttcggccatatagctcatcgccgaaacttttaaccgaataaattgttatacggtcttgatttcttgatatgttactttacttagccaattttgtcaaacaaactagctttgttgattgctacaggatatttggtactgtagcaaatataaaaaaatcaaccgatcttaaattagatcggctgctatgtttttttttttcctttttttgggtatgtgggcagtaacagatcggctttgatagcgtgatctctgttttttttcctttttactaggtgaccgtgtgcgttgatgctgctgcttctggcttctggcgtgcacgcgtatgcagttgtagatcgatacggcttccgccggcttgatggatggccagaagacgccgaatagcacgatcgggcgacggcagcagtgtatagattgatttcggccacacggccgaaacagtcgtctcgatgagacaatgcgcaaattgcaaattcggctactctaaagccgaatagatctctttccagtggagtcgtcaaaaatcgtgttggcaactttttgtgacaagtcgacaagcacgatcacagcacctaaatgccttgcggtggtacggagtccccaaccacctcgatttagctaaaaacccatatcaagatgggttatgtagaaaacagctaaaccggctagcggagccaatttagagattaaaatcagcctctagaccgatttagatcgatacgaggataactacctgtctcgtgagcaaacggaaggttttcaggacaaacctacaaagaaatatcgcactctcacaacggcggcggacgattacctcgcaaatcgataaagatggactaaaactaagataaagtaaaaaaccaaggctaaaaagtaaagataaatgaaaagcgattaaagtagattgtgtgttgtgttgtttccaattgaaccggtgttgtcccttatataggggttggtcttgctctctacatgccctcctccacgtccaactcgggttagacaccaaagtaaacccaaaacatagcctctcgagtaaggaaacccgagacccgacgaaaacagactcgggctcggactctgacggtctgaccggccacatacccatggtcagaccggccctactagccggtcagaccagccacacatctacggtctgaccggccctatgaaggaaacccgacacttttcaaactttagtaattttcccctattttgtccataggtgtcaaatttgggtgtaaacatttttacacatgactagttcagatacacagaagattaattaggctcaatcatttacaatggtcgatgagattattcggtcatggaagaatctaggcatcatgggccgtgtttggaaataaaattggattcggctcttttatatctgtgtggaaacttgataggagttaaatgcttttctcgaggggcagtaattggtaatagaactggaaagcaaagcatatgtgttggataaaagatgtaggtgcgacgaacgtgaaattatcaattattttctaaagtagcttaggttggaattttatttactattactactctctccgtcccataataagcagttgtgggtttcagtgatcaactttgaccatccgttttatttgaaatatttttataattagtatttttattgttactagatgataaaatatgaatagtactttatgcgtgaattaacttctaatttttttatataaatttttcaaataatacggacggtcaaacattgtgcacgaaaacttatggctgctcttatagtgggacggaggagtagtttatagttgttgtcgaatagacaactgcgtcacgtcgaaagacgtggttctctcaagagtggatgggaaataaaagaacaattgtattactttgttcagaattttttttgatccccctattacatggccctagggggctatttatagccccattataggttactactgttagggtttagattatacagaggaatttacatgattacccttatgatagggacattatcgagggcacactgtgtcctttacacatacggcccctacagggcttaaatggctcggcccatctatctggcgaaatcccctgaggacgtagcggcccgctaggcctcccgacaacgaggttcggtactctggcgaaacccgtgcccgtgtgcctaggctttcgccgcatcatcttcgcccgtgcggccttctgtcaaggactccacccggtgaagctggtgtaacccaagccacggctttcgcccatatgactttattctcaaccttcgccgcctgcctctggagtgagcctgttgcctgagtcttttggtttcggcaggttcggccgaaggccgtccgtggtaagcctccaacaagcccctcacgggcaagggtgagtagggagcttcggccgagaccgtgcaaatcgaatggtataccaagaggcgccccctttcggccgatgttccagccgaaatccatgacgtagtcctgcgaaataaatgacttgttttcatgtttacaaaaaattcttgagaaaattcatttcccccgtttgttacaaaatgtcgaaagggttagcttatctttttcgttactaagaatagtaatgggccccgtgggcctctcctttcttgcaatcggcttttcactgttcggctctggcccaatgggaatttaccgtttcgtctgctcctagacacgtgtcaggatttaattggttggcaggctacggtctcgcgacggggttatataaccccgggtcagcttgctactttctccccccccactcttcactttttaccgcttaacccgctccacgctctcttcatttgcttgcctcttagctccttcgccaccgctgtgctctttgcctttcagctaattttctctttccttggccgcgagcctgatggctcctcgttagcccaccaaagccgggccaactagcgaagaccctagcggccttggcgaagggtgattgtgtttccttggcaaatcgctcgtcaaggaggccgacttagccgagttggtttccttcggtgctcttgtggagggccaaggatcgtgtgggggtgaagccgttgtcccttcgcccagtgatgggcgaacggttgtctttgcagcctacttcgccgccgggcttcgtctgccatgtgacgatttcttgtcgtctgtgcttgcgacgtacaatgttaggcttccccagcttagtccattggcattcccgaagctggcggttttcgcctggatgtgtcgaacctgtgggttcgctcccgccgccgagctgttcgccgttctatttacggcatgcgccaagaccaaggatgtggagacgccggctggaccaaaaaaaactgttttcgactgcgtgaacttcatgctgcggccggaacgctcagacgcttggccggtgcctgcgtcgatgaacaagtgggagaaactggatgcagaagtagttttacatcgccaacccttaccccgccgaagatgccaaggcgaactggctccatttctagcgttccgccgtctccatcatcgcgaagccaaatgtggagatcgatgggaccctcgagtcccggctcatactcctccgcaaggtcgcacagtggctaagcacccgggacctttgtgaggagttttgcctccttcggatctcccccctcgcctgtgtctgggacgtttctgtgaacgagggcgaagaagttttcgggcttccctgccttgctctccccgccggggttgaaagtgagtttttgctttcgctcttagccgtatacttcctttatggaaatgtgcttcaggctaaatagtcgttttcgttttgctttttcgcagcccggacctgggaagacgccgaaatggaggcgtcgaagatgataggggccctaacgacggccgaattcgctcgcttgcttcagcgccaaaccgacggccgggtgaaccgggttcatgctggcgaattgccaggtcggtcgaacccctccagggccggggatgacgaagtcggtacctcgaagaaacgcaagcgtgcggtcgcgaagggtggccagattcgaactcgtctcggcgcgaaaggtacggttgacggtgacggggaggaggaggaagaggaagaaggggaggctggatctgaggatgatgggtcccacggctactccactagtccgactcctgcgaaatctagagcaggttctcacgtttcgcctacgtgtccgcaagacatttgtcacgcccagaaattcacgaaccagaatttctaagctgaatgtgcattaaacccctgtccaggatcagccagggtacacaaacgacaattgttgacatacagatccacatcttacaaaaatttaaaagattacaaatgcagcggaaaagataaaagcgagctaagcctgaagacttgactcctgcagcaaggcgactccattccataggcatccttgacggcagcgacgaagccaacttcttcgagacatcttcaactgagaaggacttcaactctggtgtgggggaaaagagagcaagactgagtactacccactgtactcagcaagtcataccggaagagaaggtatgatgcaggatatatccaagggaggctaaaggctcatttgcataaagctagcatttaacagcagtagttgaaagcaataaaacagttgtagtaattaatcagtattaaccaatcactgtccaacgctacaccacgttgcaacaggcccaaccaaccacctgaactacaccagttcattagctaactagcggtgagactaatcacggtgaatctggtcgaccgcccataaccgcgggcacggcgattcgaatagttttactctgattagaggtgtacaactgtacccacaagacacagccccacgacacgtttccgtgcgccgacatgccaccacgacataccggaaagaggccgtgataggacccttcgcataaccccctctaaccaatcgcaccacaccttagggttcgcccccgtccctatcaggcaacgggcagcccccctttcgtgcagcggtgaatccggaagccgatcaaccggacaccccggccgacccaactccatcacgcccaccctcacctgggtacgtcggctagaggaaagctacactacaagcccagccgttgcccacgctgacttgtggtaagtacgataagttcttccagggcatcccgcgaaccggtcctttatcgccatgggcactactagcaaaaccatgcacccacagcctaccatgtagtgtattttaattaactaacaccattgcggcgacactaatccaaagctatgccaataatcaaagtccatgcattaatgtgattccccttttgtgtactagtagaactaagcatggctaagcatctcctataccaacatctagtcattttagtacccaagttatcaatggcgtaagggaaacaacatatagctgagtaataggacccatcccacatgatattgtaaaacaatgcaatttttaatagaaatccgcgagaaccttgagaggatctcgagagacgaggaagccgctgctgccaacaccagacgagaccctgggctgtcggaatcggccgccgggcacgagggcgaagacgacagaggccaagaccaccctgaggtgtgaggcccttcgccctcgtgtgctatctttttttttattctattgtagccctttcgggctttttggtagtctagctttgtatataagctctttgcatgttcggccttgggccgctttcaccttgtaatcactatgaactctattctactgatgaaacattatcctttcgctgatctacttgtttcgttggaaagtggtattgatctcgtctatatttcccctttttttgcactttttcttttgtgctttactagcaggcttgtggccgaaaggtatgcgttcgacctctagctaaaaatcggcgaaacaagaacgagaaattcatggcggtgaaaggcctactgaagattaagtgtccctttcggcttgtttaccgtaagatgttgattaatggtaacagttataaggttgtaaatgttgttgaatggatgcgtgtacatccagccgaaccctagaggactatgatcactatcgtgtgtcatgtcgtgaagatagctcgagcttctggcgaaactttaagagatcggttcatcaagaggcaatcgctcgtcgccattatagtttagtttgtgtttggcctccgtcccatttgatggttgtatacgatatcagtagtgacgacgaatctagttcgccggtttgtaacgtaaacgaggatgaaggtacaaacgatgaagcaatctatttgtcatgtttgttaattataaatacaacacattggttgtaattcgacattcttgtgattttttggacatacctttatgccatggttcacatagtcacggtcgtgctttcgttaggtcgaaacatgtcggcccctttgcgtgctatggtgaaaagctatgtttattttgcagctttgctcttccattttcggcttgtggcaggcgtgctatcgagcatcgtggcctatgcgtgagtcgaatataacgttgttttgacttttgtattcaaaattcaagctctcgcggtttcgacgttcggtgagccatgcttcgatcgattcgtttcgcccctctggcattttcgctgttcaggcgtttgccttggggttttttgatcaggcgtttgccttggggtttttccacgaaaatttcactcacagagaaagaatgaaaatgaaaaagacacaaggattttatactggttcgggcctccaagttggataataaccctacatccagtttgcctctccctctttttttttcttttttattttcgtcttttttttgctttttgtgccgaatggcttacatcatatgtacatttttacaagttggtgaatggggtgccaccccttctagacataaaaacgctttagggaagaagcgttccaggagtggtcaaactcttcaccttgtagtgtcgccaagcgaaaggagcccgtcctggtcctgtgcttgatgagatatggctcttcccattttgactcaaatttcccgactgccactgggttcgcattcttccttaggacgagatggctgggcagtagctctgtcggtcgaacctttttgttgtaagttgccgaagtgcttgtggcatatttgcgcatatgttctagagcttcgactctcaccccctcgaggagtttgagtgacacctcgcgcccttcttcgcctccagagaacatcacccttggcgaattagcccctatctctgttagggtcattgcttcatcgccatagataagcatgaacgggttgaacttggttggccttgtgggggtcgtacgaagggcccagagaacagatagcatttcgtccggcaatttaccattcgctgccccctcaagccttttctttagcgcctctaggatcttaccatttgcgcgttcggccaccccatttgactgtgggtgcgcaaccgaagcgaacctgatttccaggtttagccctttgcacatctcattgaacttgtcagagtcgaattgcttgccgttgtcggtgatgaattcttttggtattccgaaatggcaaacaatgtttttcctcacaaacttctgtacagctgccgaagtgatcacgccgagtggttcggcctcgatccatcgggagaagtattcgattgctacaatcgtgaacttgtaaccgtttcgcgccatagggaacaggccaatgatgtctagcccccatctggcgaaaggccagattggtgcgataggctgctgctcatattggggggtagtttggctttgactatgccgcagacagctttcgcacttcttggcttgctcaacacagactttcagcacggtgggccaatacacaccctatcaaaatactttggaggccactgttcttgcggcctggtgtgcgccgcagagcccctggtatatttccttcgccatttcttcaccttcggcaaaggagatgcagcgaagcaagggttgaagcaccccggagcgatatagctggcccgagactaacttatattttacggctctgagctgtaggcgctccgcttttgcttcatcctccgaaagccaaccattcttgaggtatttaattttacgaacggggttcgccagtcctctgggtcttcccctagctctacctggtcgattgccatgatgtctaggatctccacaggcacacttggtgcgtataggacctcaaaaatggtgcctggcgaatacgggcctccacaagcagcagatttcgccagggcgtctgcttcctcattctggcctctaggtaagtgtttgaccgttatgctggcgaagcacttttccatagatcgaatagcctctagatacctcttcatcccctcttcttttgcctcaaaggatttgtcaacatgacttgccaccaatttggagtcagttcggacgagcaagcgtcgaacccccatagctttcgccttttttaggcccaacagcatagcttcgtactctgccgcattattggttgtgtcgaactgtagccttgcggcgtaccgaatcggcacgccgcctggcgaagtgagtaccgccgcagcgcccgccctcttgtgcgaccacgagccattggagtacatcacccaaggttgttcaacgggctcaggttcaggggcgaatggcggtgtccattcagccacgatgtcggctaggatttgggacttgatggcagtgcgggcgacaaaatgcaagtcgaagggagataactccgccgcccactttctgagccagccagtaatttccttgccccgaagcacttcgcccaaaggatactgcgatggcaccgtgactttgtgggcctaaaagtagtgtttaagcttgcgcgaagccatcagtagggcgtaagcaagcttctccatttcgatgtatcgtatcttcgccccttgcaaagcttcggaaacaaaatacactggtttctagcctgactctgtttcttgaacgagggctgcactgactgccaccggtgaagctgctaggtagagtagcagttcgcttcccggtgctgggctgaccaaagcaggtgggctctacagatattgcttcagctcgtcgaacgctgcttggcattcgggtgtccaggtgaactttcccgtgccccggagggtcttgaagaaaggcaagcctctttcggccgctttcgagaggaatcgactgagtgccgcaattcggcccgcgagcttttgtacttcgcgtacgctcgataggggcttcatttgctgaatagcatcgattttctcggggttcacctcgatacccctttcagaaacatgaaaacccaacaacttgcccgcgcgaataccaaaaatacacttctcaggatttaatttcatacccgccgcgcgtaagttgtcgaaagtctcctgcaagtcggacgcatggtcgaaagccttgtggctttttacgacgatatcgtcgacataagcctccacattttgccccagttgcttgtaaaagaccttgtacactagcttggcgaaggttgccccggcgttcctcaggccgaaaggcatcctgaggtggcaaaaggtgccgaacggtgtgatgaaggctgtcttggggatgtcggccggattcatgtggatctggtggtagccggagtatgcatccaaaaaattcatgagttcgcagccagctgtcgagtccacgagctggtcgatctacggtaagaggaaatcgtccatcgggcacgccttgttgaggtctgtgaagtcgacatacatgcgccattttctgtttgatttctacaccagtaccggattcgccagtcactcgggtggtcgatctcctggatcaccccagccttgagcagcttttgcacttcggctttcgttgcttcttggcgatctgcggacatcttgcgcagcttctgtttccttggcttagcatccggtttgaccgccagatgatgcatgatgaggtctgtcgaaacacctcccacctcgtcggggccccaggcgaagatatcaatgtttttcttgatcacctcaaggatgctgtcagcttctctttcgcccatgtcagccccagcgatacaagtcttttgggatcggcatcgtcgacctgcaccttgattaccctgccgtgaggggcgggcttcggcgcatgcttcgaccggtcatatagttcgacctcaacattgtgcactgctctgttgattgcggccaagtcgccatttgacgtggccgaaggttgaaaccccttgaccacgatcactcctgcagggctaggcatcttgagcttgagataattgtggtgggagatggcttcgaatttgttcaaggttgcgcggccgaagatggcgttatagttgtatgggatgtcgacaacgtcgaacagtatttgctcttcacgcctgttttcacctatgccgaaagctaccaccaattgtgcttggccttagacttgaactacttctccgtcaaagccacgaagcgaggacggtgcttgggtgagggctagggtatgcaatcccatcttggcatatgctttggcgaagatgacgtcagccgaacttcctccgtcgaccaggattcgccgaacttcgaagccagctaccttagccgagatcaccaaggggtcttgatgtgggaacaacactctttcgacatcttctggcccgaaagaaatctgctggttcaagtatcgcgaggccccttcacctgccgaagtgatgttgagcaccattcgcagctgcatcttcttttgccattttgacagttgatttggtgggtcagcccttgtaatcacttggattactctgcgttgcacatcatggcgttgttcggccgggggtgcttgttcttggacagcttcgtgaggtgcttcgacggctgctccttgctgcgtcctcggatcttgcacgctgccacgctgccgaatgtttcggcattgctcggtggtgtacgaagagcgtccatggaatgcgcagtaaaggtcttttctgaccttcttgcgaacggactgctgatggctgcttgcttgctgggcgtcgaatttcttgcggagggcctgaacttcttcgacagccatcacggccttgcctgcacgatcggttctgaattttctccaagtcatgggagcttgacttggtcttggcggttgtccttggatcggcggctgagactggcgaacggcgagaggagccggttcggcggcctgcgcttgtacttgggcttgagcagcggcgactgaggccttatcgtactcggcttatattgcttgtcgtcgcttggaatcctcttcaccccttacgtatctgtcaatgatatgaagcaggtgctcgagtgtctgtggctccttgttagcgatttttcttgtgagttcgcccttgagcagtccagccgaagcggtgttgatgacaaatgcttcgattatgtcctgaacttggcattgggcttgcgagaagcgacgcatgtactcccttatggacttccccggcctttggcgaatgccgagtagatgttgttgcgtcttcggctcctcataggtgcctcgaaagttaaggacaaaaacatcgtgcaattgctcccatgagtaaatgctattagctggtaaattgaagaagcaagaacgggcgatgccgcctagagtgagatgtattacctttgccttcgtattttcgtcgccatgagcggcttcgatcgtggattcgtagatggatatgaactcttttgggtctgtttcgcccgggtatcgcggaacaggcgggaacttgaactggggtggtattggacgaatcttgattcccccattcagcggcagccccttttcgccccctgccttgctcacggcaccttactgtagaggcccatttggatatggcgtggcgaagggcgaagtcatggcttgcgcgtgcggttgggctacagtgttcggctgcccggccccgaacggtgacgcttggtgcgccgccatggatggatcgaatgaaggctgggcccatgccatggcgacctggttcggtgtctgattcgttccgaagcctggtgtcggtgcctgtggtcgaatggttggtgcttgagtggcgttgccgaagtcgaattgcggtccttaactccatggcgaagcccctggaccaggcaggttcgatggtagccaactgggtgcaccttgacttgtgttcccctccggttgggctgaaggggttacttctggagtgttgtggggttggttgagctgctgaagaaaagcctgaagctgcgcttgcaaagctgaagctccttcggccattgcttgcgacatttgtccggtgaagtacgctggtgcttgcatgacttgaatcggcgcttgcgggtagacctggggtgggatgtaacctgccgaatactggagaatgggggccgaggcgaccttggcttgccgggtcgcttggtatgcctgctgctgctcttgcatttggcgaagcatgtccaggaatcgcgccatgttctgacgcacggcccccatgtcagcttcggcttgcgctttgaggttggagttgacttgcgcggcggtgagcgcggtcggagcttcagcctaccgcggcgaagcagcttggggcaccatcggttgacttgtcgaaaggatctccaccctggtctggagcgcccttgacattgctgccgcctttgccgcttcgaccgcgttcagcgcctgccccgttgaagcggcaagagccgaacgtggtggttgcggcgcagcagccgaagtcgatggtaccataccagcttcggcgccgagcgccgaaggctctgcttcctcttcggctgccatctccactcctacttcactctccttacgccttgccaccttctcctttgcgaccttcttcggtggcattcgctctcagtggtttcgctcagaggtccccacggtcagcgccagctgttgtcgaatagacaactacgtcatgtcgaaagacgtggttctctcaatagtggatgggaaataaaagaacaattgtattactttgttcagaatttttttggatccccctattacatggccctaggaggctatttatagccccattacaggttcctactgttagggtttagattatacagggaaatttatatggttacccttatgatggggacattattgagggcacactatgtcctttatacatacgggcccctactgggcttaaatggctcggcccatctatctggcaaaatcccctgaggacgtagcggcccgctaggcctctcgacaacgaggttcggtactctggcaaaacctgtgcccgtgtgccgaggctttcgccgcatcttcacccatgcggccttttggcaaggactccacccggcgaagctggtgtaacccaagccacggctttcgcccatatggctttattctcaaccttcgccgcctgcctccggagtgagcttgttgcctgagtcttttggtttcggcaggttcggccgaaggccctccgtggtaagcctccaacaatagtgtttgctttttctcatatattttgagtgctggatattaatatttgttttttttgtgtgttgttggtcggctcgccgcttctccacctctcgtggtggttgcctcttcttcctccgctgccagaatccggggaacttccccgccggccgtcgctcctcgtcctatactctagaatagaatcatcaaaagcatagcattagtgatgcggcaacggatccaccacctccaactatcgatcctgttgtggttttagtaaaattgatttgaggagctatgtccgggttcgagcaccccatcatcggcgccgcccacgccgcctttgggcacctccaacttcaattgccccccgcccccggatccaatattcccaacccctaacactccacatatactccatgcttcctccaccgcacccaacacaagcacaagcctaaacaaccaccgctccacctccttctctgcattgcattcgattccttggtccataacatgcaggaggtcctggacaagcacaaacccaaggcgctatttcaaccacatctggagacattaatcctccatggaaacaaggcccatttcgatgccttcctctccaacctcccttttgcaaaggtaccgccgcctcccctgcctcccgcaggcatcttctccacaccaccgcctgtctctgcccacgaccaagaccaacctgcaattccagctcaaaccgaggacaaggaagagattgacactgttgactccatccgtcccaatatatagcaatttttagcacttaggatttgtcccaaaatataacaacttatccaccaacattcacttcccaaccaatcacaaacctccaccatttatttttcccacctacctccagttatcaaccaatcacaaccccttcctatttaattctacctaatttcttaataaccgtatccaactctaaaactcaatatattatgggacggggggagtatgtctctgtagtagtactactagccgggtactactagtatgcctgtgcattatgatgcacgcacgcaactactttctgttggcaactttttgtagcaagttgacaagcacgatcacagcacctaaagctttgcggtgatagtagagtcgctaaccaccctaacctagcaaacgctaagtcaaaatgggttttgatagattaaaccagctagcggagccgatttagatagaacaatggataactacctgtctcgtggtcaaaatggaaagttttcaggaaaaacctacaaagaggtgttgcactctcacagcggtggcgacgattttcaacgcaaatcgacaaagatggacaaactaagctagaactagttgagattgtatgttgcaattgaaccggccttgccccttatacaggggttggtcttacatgtccaactcaggatagaaaccaaaggaaacccgaaacatgccttcccaagcaaggaaaactcgagaccagacgaaacagactcgggctcggactctgccggtcagaccggccacaggtcggtggtctgaccggagttcaggctgcggtctgaccggcccatacacggcggtcagaccttcgtcccaaaggaaacaccgatagatttccaaactttggcaattttccctatttcgactctaggtgctaaatttgggtgtaaacactttccccaccaagctctcccatcccattctctctctcttctgccctctgttcccatcctctcccacgggtctgccaccatcactgctcgcctatggcagctgagagcctgagacacggcgagtggtgtttgatgcatgtcgaaccgtgtcatacacgagctgaccaggggatgcgtgtcgacacgggaaaaaatgtcgctactcgcctatggcagctgagagcatgaaacacgacgagtggtgtctgatgcgtgtcgaaccgtgtcagacacgagctgacacggtgatgcgtgtcgacacgggcagcagcgcgctcccctccgccggatctagcgggagggtaggcggcatgcggccacgggggcagcagcgcatgtggatgtggtggcgccgtcccctctctccccctcctcccgaccccctcccctctgtgagccgacgacgacgacggcgagcggcgatgcgctcccttccgtcggatctggcgggaagggaggcgcatgcggcggtgccatcccctctcacccccttatcccgggcccctcccctcttcgagccaacgacagcgacggcgggtggcagtgcgctctgatctgctccgccgaatctggcgggaggggaggtggcatgctgcggcagaacaggagtggcggcttcgtcccctctccccctcctcccagacccatcccctctgtgagccgacaacggcgatggcggatggcgctgcgctccccttcgctggatctggcaggagggcaggcggcgcggcggcgggtgcgacggcgcatgaggatgcggcggcgctgtcccctctctcccttctcctcccggtcccctcactactgcgagccgacaatgaagacggcgggcggcggcgcgctcgcctccgccggatcgggcgggaggtgagacagcatgcggcggcaccatgccctctatccctcttctcccgatgcatggcgatggttagattttttttaagttaatttgttgtgaatgaatttgttgatttgagtatgatttatgaattcgtggatgaatttgtgatgcgaacaaacttgcgtggggtggcccgatcttcacggcagtaggttcaagatagagagtgccggcgtaaaccgaaacacaagagggtaactagctgcgagcagcaagaggataactagctttatacctgccaaggtcggatccgactaagtggtgagggtgagaatgatccgaaactccaacccatcacaccaagcaatcatagaatcatgatccggaataactagctttatacatgccaaggttggatgcgaccaaatggtgagggtgagaacgatccgaagcctcctggactctgacccgtcaaaccgagcaatcatagaatcacaatctaggactaatccacacaatacggtgcagccaaactagaagccgtagagcacgaactagggggcaccagaggagccttctcacaagtccaaaagaactcacaagaacaaaggggtaagacacttatgcagtctttagcaatctctcatacatgaggttttcaattgaacaaaagttctctaatggatggagtagaggggtatttatactaggaacatccctcctagctgaggtgtgaacataagaagccacgttctagtggtcaaggctaacataaatgagaatgcaaagagttttctcgggttcgcgcacagcccttcagctcctccacagccttcagtaaaaataccataactttttattggaaaatgatattgaggtggggtttgatgcattggaaactagacttgtccctctttccaacaatatatgccatgcacccagtctctttactggctgggtcgcacaagccttagaagtttagcctttgcagcataaaccatcttcttgttggcgtaaacagctgttggttgggcatgtgctgattcctcctcgatgtaacccttgtcgttctcaacataacccatcttccttggcgtagtgatgatgtcctcgggcgtaaaccttagcaatacaaaggtagagcatttaggtagtataaaattctcactaaaatttgggttaagtttagcaaagagcgagttcacctcttgttgtatattcctagcacgactacgcgtaattggaccatgataagcttgatcgttcttgctgagatgtaatccatcaacttggtttacgtcaccttcattttattcatgtgatgtatgacgtaaactatcacccttgtttacgtcaagtgtagctgggatgtcctcatcaatttgctaagagtagtatgtgggatgatttgtcgcaggaatgcaagccagcaaaaaacaatgaaaaaaaagaaaatcgggactaagatgccacgtggagctattatctttagttccggttggtaacaccaactgggacttaaaaacacacatatttagtcctggtttcggggtctcggtttgcaacccgggactaaaagggttgcaaaccgagggtgaaaaggctttcgccagtagtggttcttggaataaagcgaccacaaggcttttgaaagttgaacgaaatgtcccagccccaatttttttttctttggaacaatctaccgtaaaatcataaagaactttctttctcataaaaaaagaactttcactgatatggaacgaatcagatagacactggtggatgcagcagggggcaagaggaccccgggtaaccccttcggctgcatgaacccacaataatcaaaaatgctaatgagcggttagttgcgtgttgggtttctcaaaccgtcatggccggagttaccgagccccggtggtgagcacggttaccgcacggtaactgtacaaaaccatgtaaaatttatcaaaattttaaattattttttaaatctaggttttccttttaccgtaccccgcggtaagcgcagttactggcggttttgcaaaccctacgcgtggcccgattcaagcgatagtagattactagtactatactactcatgagtactactactagtacctatgtctctggagtagtactactagccgggtactactagtatgcctgtgcattgtgacgcacgcacatagctacttttcccaccgagttctcccatccctttctttgggcctgtttggtagagttccaactcataaatttagctctaggagttaggtctggagtggagttgtggagctgcctaaacccagctccacctgtctagtttattttgtgagagagctccacccagcttcactcctatttttagtagagctgaaattgtaaattgtttggctgagctccagctccaagagaggtggagctggagctagagctgtgccaaacagggctctctcttctgctttattttcccatcctctcccatagatctgccaccatcactgcttgccaatggcagctgagagcctaaggccctgtttagattccaacatttttcttcaaacttctaactttttcgtcacatcgaactttcctacacacacaaacttctaactttttcgtccaatttcttcaaacttctaattttgacgtagaactaaacacagcctaagacacggcgagtggtgtttgatgcatgtcgaaccgtgtcagacacgagttgacacgggatgcgtgtcgacacgcgaaaaaatgtcactgctcgcctatgacagctgagagcctaagatacgacgagtggtgtctgatgtgtgtcgaaccgtgttagacaagagctaacacggggatgcgtgtcgacatggaaaatttttttagactcgcgtgtcccggtaaaactagtggacgacagtgatggtgggcagcggcgcgctcccctccgccggatctagcgggagggaaggcgacatgcggcggcgggggcggcggcgcatgaggatgcggtagcgccgtcccctctctctcctcctcgcggccccctcccctctgtgaccagatgacggcgacggcgggtgcagtgcactcccctccgctagagctggcgggaagggaggcggtgataggggtggcaggctccccatggggaggtggtggtagaggtgcggcgccctcccctccctgtcactgaggaagtagaaggtggagcatagaagcctggtggccagtggctgacgtcaggtggcctagtgcccagcatctccccggcctctattgtggatttttttgtggatttatggatgatgttgttcttcagtacatttattcggtgatgtcaatcaatcttggtgacggtctaattttgattttggggatttggtgattttaatttagatttggagcacaatgggagcaactcgatgcgtggcatggcggcatggtgtagtagtgagttcaacccgattcgagccggctctctctttttctttttggcgcgtgcgaatctataggtgcctgttctattttcctcataagtgccggttttctctattggtgccagatgaaaatccggcacctatgaacccttgcaaaccggtacctatggcatattttgttgcagtgctataaaatgttgctgatgggattgagaggaattaggaatcagaagggctcggcatctctatatatactgcatacgaagcaatcatgaatcgatcaccttctacaactcacctagaaattcacgaataaaaaaaaagagatgaacatactgcctatagagtgttgttgatgggaatgcgaggaatttggaatgggaagggttccgcgtctctgttatttgcaacgtgatgccgaagccgatggcacctcacgcaggatgattctgtcagctggcgactgggtaatctgcatcagtactgaacacatgcatagttgtaagtggaaccacaatattgaatagtccatactgctgataatgtggatgcagcttttcaatgttcttgtgcagtacccgtgagtccgtgatctgcagtacccatgctatccacagatcgcagagcataaatggagtccgataacatagaaacaatccattcgcacatgccactcacacatcgagaattttggactcacgcaaaccgtaactctgctaaactccaggaaacaaaaaaataaaaaaagtgtaccatacaacgagcctaaggtatataaaaagcatcgtcaacatttttcttcgacagatcccaatcataaaatttttggattttagctgaaacttgtgctttttggatgtccaatatctgttttcttgctatgtgcaacttaagagccactcccaatccaccgatagctcggacaggacgacggatggctgatcatgcttggaagggggaacaatcgcacaatggggagttagaggtagccgcacttatgatttttcttacacagaggtgaacttgtaccattggtaagctcttagcggaaaccttcttgacaaagttcaacaagtctaagctctctcccctgcgtcgccctcccccggacagctcgggaggcgacgtgcccgccgccgtcttcctctccccgtctcctcctctgcctcgccgccgcctgagcgggcgccggcaaagccgcgcggccgcaaggacggtggcggcggggcttcatctcacccacgctgcgctcggaggccgggggagctgtccatggcggtggcggtggtggccagatccgcgccgtgttcgcagtatctggcaggtggatggccggcggcaggggctgacggtggtggcggcggtgctggtggcggttgtggtggcggcggcgctggtggcggatatggtggcgaaggagatggcgacgacgacggcgggccgcggcgctggcccggcttgtcaaggacctcgccgccacgagacctccggcgcagcggcctcattgatgctccctccacaacgtcgacgacccggacagcgcgctgcacctccagatccgagccaccgaggccggatctagccggctggcagctggcaacggtggcggatggtgacggtggcggctgtggcgatggcgggtggcgacggtggcgcctgtggcggtgatggttggcaggccatcacgaaggggctgacggtgcgtcgtcgtaggtggcatcttgtggaggtggggaaggagtctggcagtggggaaggagaccgggtgtgggcgcgacgttgacgacgggaagatctgtggcagtggcctaggccagatcgctgaagggacaatgtagtcgaccggcgacgatccttcttgtgctgattggttgtgtgggtttggataggcaatcactgccgaaagcctcgccgagccgtttggccggctgactgtggcatcgccttttggcgtcgttcccctccctggaggcatcgttttcgcatacccctctcctttccttaccattctccgtgtgaaaaccttgcttcggcttccgatcaagcagtggcggccatccacgtcgcgtcctccttgggggcaccactttggagaaacttcttcgtgcaaggatgtcgttgatggtctatccatttgcttcgaagcttttcagccataggttttgacgaggccttcgctttctcgctccaccttttgttttgcggtggacgacatcactgtttgtttgattttgctaggtggagtcggagctgcttcgtcggggtgacgaagctgcgcaacaatggcatgctgcattttccttctaggggttttgttgttagccgtgaatagattgtggcgcttaggcggctttggcttatgttcatcgtggaaagtcgaagccacttgatcatttgcagcatctaggtttagatggtgcatccggtttgaagtcggagctattgtgtcgcttggcggcaagctcagcaacaatgacacggttggaaagtcagaaccccctatgatgtttcggtcaaccttggtaacgacatcctacattgggctccgttagtggtttcagctgtttgtgagttctggcgtgtactgtgtaactattcagccagccggtggttggtttttcttttcttgtaacctatctaggatagtagtagattgaactgtttttggagggttaaacagtggaatcagtcaggccgcctatagacaaagttgtagagttttctccaagctttccatattggtaaaatacaatttgatcggatgagtagaactcttgatatagttgtttctgtatgtaccctctaaaattctggacggattctgaagcctgctttcaagcgcaaattagaccacttaaatggcagaataaaaatatactttctacataaaagttgtaggtattgttctgtagattctcaaaatgtatatattttcagtcatagccttttatatttcaagatataaaggtttgaagcaacagtcttgtgtatagtccaagcggcgttccttgttattgcgttttgacgggatggggcagtaggttcacctttttcattgttttatatgcatgtttgaatgtgttcgctgaggttttgtttgtgattaggtggtggtcctttagatcgtgtatgataccaacccttcattggtggaaagtgcatgacgaactaattatgtgattcatggattgtttgctctatctatttattttcgatatatttctacgtgacatgtgaccgcttatattcacattgttgttcaagccatttaggttttcatgtttatcctatgtttacgatgttattctggtttcaatattccagattctggttctaaataattcaagttccatgcttgccatggatgtgcaatatggttttaatttggttctttgattctagttttcaattattcaaggaccatgcgtagtcatgggagtgcaatttggatctttattcatgtttctgtgggtaagagttgatcacgcttactcggctttgtcagcaaatgctaggatatattcactattatccgggatggaaactactatttcaattcatgcctgcccgggatgggaactactattttctttgacttagtgtttgaaattgtatttcttatcaaagaaagaaagctttctgttcgtgctctattgctaatgatgtgtatatgtgctttctagttccatattgtacttgttgagtatttccgtactcactcttgtgtttatttggtttttagatacacattgagatcggcatgcatgggcgggaagtagcacccttatatacacatttatctacacactaccaaactatattgcctaggtctataatgatacttaaactatatcatggttcggtcttgtaataatcttttagatatcttttagtttctttctatgggctatatggatggatcatattgtgggaatgatattattattagttcaatttataactgtttgtcgtggatgttgttttgagtgtattttagtgtggcactctaggtacgtggctacctggggcgttacaattacttcaatacatctctaatatttaaaagtaatggatccacaggtttaaatataaatcaatggtagatgctctgttttctcataatttggtttaatatttcttgaatttattagagtgtcaggtgtgttgccttaggagcgtttgtagagattaggagggtgtgattagtttaacagatccaatctaattgttaaaaataaaatgttaactataaatcaatcgtcagatgttttctttttttgttagaacttttttggtttttctctaatttattacagcacgatgtggtggcttaaaattatttgtagcagtgccatgtggcagcttaggagtgccatgtggcagcttaggagaatttatatgttgttcaatggacttttagtatataataatattcttgcctcaatgattggtggatagcagtacctatgtagaactgatacatgcgtttgagtgtgacatagaattgacacataagttaagacttgtaagagtcaagtacaccggatcttaagtttaaacttcagaaactgaagaggtaaagatcaacatatatgcctcctttcaatcatggctagacacattgatgctttaatcatgtagcatattttcttttattttgtttctttgtaaataactttcctttatttaatattattaccacagtaggagccactactgcggtttctcgtcaaaaaaaaaacatatatgcctcctattattctaattaagacatatcgatcctgatcatttaatcgtttattttttataatcctttaagtagggaaaatatgtagtaaaaaccacatatgtagtgaaaactt

SEQ ID NO: 71733 - DNA, 4275 bp, Oryza sativa
cgtcgaatcctacaaaatcgtatcagctcgggtggcggtaatcctttgtggggtaagtcgtaagctaagagagattaattttatagtccttttattaaaaaaaatacatgaaggtatcaaatttttatactaaaagttttaacttgagatatctagctagttcatggatgtactaagctttacattaaaaaaatggtatctctaggtctcggtacctttaattttcaagaataataaaaataccccagttataatatgatccagaacttattgtttgtgtagtaaatggatctatatatattctgatatgtgcagtttattcaagtgttaatgtgttatcaccaggaactagactactagagaagctacgctaattaattaaactgatgagcatatatactctcctatcattttctctcacgtccacgatttaatctgacttggagttatatatatgtttcagacccgagacacgaccctccttgttgctaggatttgagcagagccaagtacaaagtttgcaccttaattttacggagaagtattgtaggtgtggtgatggagttatgggggcaaacaactccattgaccaaggttttaatccttgtgtaggcataatttgacataggtatttccttactgtcttgcaaacaaactagcaggatgatcggcatttgcgcgataagatctactaaagtttatagcttcaattcatatatatattacactcactttcttcatcgtttaattgtacaatgttatccttattctaatgtaactttatagaatgtttattttttttatttcgtcgagattgtaatactattgtaatgctaatcaagcacatctatcagtgtcgaggtctgctaatgaaaaattcctctcatttcaattaagtgaaactatttctatttcttcgtgaaaaattctatatatagtgctctttttcgatcgctttgctctcgtccttgtcaccgataattcactttgtttaaccaacctgagtacctgaccttcatgaggaatcatcctcgctaaattagatgaaaagcaaatgcgggaagggcatagaatgattcattgcggggaaaaatagcgtgttatgtgtactgtgtttctaaaacaaatagcgtgttatgtactccgtattagttctatataatagaaaaactaggtgggcacggtcacacggagaaagaggatagagtggtgctgacggggctcggggataccggatcttgtgctattaatgacgcacaagggaaatgaatgagaaacgatgcgctgatactgcccacctcactttggcttgagagaggagaggagagagatgtgaaacgagatataaacttacagccagcttaagtttaggaactaagaaaatctgtgagaaagacggatggaccatatacttataatgaaaagctaattactatatgagtgagctgagagataggctataaatatctatacaattaacagctggctgtattgttagccttgctctgatgctagctcctgtttcgccctgctccgacatagggggaagtctaattcacatatttttataatagatattttatctgtttcaaaatactataacctagaattagattatacacaatctagtactacaaatctgaatctaaagtggtcctagtgctatgaatctaagagcctgcttgggggagcttaagattctgagaagcaactgattggtagccagcttctgagaatctggagaagctagatttcctaacttctggcttctagttcattttttggattctacaactacagcttctcagaatctggaccaaaagctagactgtttggggagcttctgattctgggagaagctgcagctgctagaaggtccccagaaggccctaaataggactgtccaaattcatagtattaggtgatatctaattcgattttaaattattatattttacaatggagggcatcttccctacactcatcatggaaacatttccttcacatgcgtcattttgtaccatgaacattttgcatatctgcccccagtaaactagttttgatattttccatcaatcatgcatgctcgtcctttgaaacaagcgtgcacaataaacaaccgaagaaatcatttttaggacatgttattccagctttactcacatatgctgtgaagaaaaagttggctcacatttgacatgatgaacaattattaaacatgtttcaaaataccactaaactcataaagtgagcatagctaaactgattagatcttgtatggtggaacaaacccatgtgagtttaagttctaaacttcgcatgagtgttcacatatgcagataattattcttttagggttggcgacaaaagacaacaagacgtactagaaaacccttaatagggactggctcataggtgtcgatctaattaaaaccggcagttataatatagtataggtacccggcatttcaaaatcagtacctatactcggcacccatggtcaccctgagcaccgacgaggagcggtatgggcagcggcagcagccggatgtggtcgtaggtagaacagccaccctgagcacctcctcgttcgcaacatgattccgacgacggagatggcgatggcgcggtggaaagcgtcggccaccaggtgagatggggagtgcgctccatgccgccgctcctcatcacctatgttcctcgtccctgctctgtattgtgagtagaaggcattggcggagaccgctcctcgtcctagcttcgctccgccgccactccgtctcaaggccgagccaccgctcctagtgtcgggctccctctcttcactagctgtggaatggagggaactcgccaaccaccttgcagtgttgggctagagagagaaggaaaagagaatagaaatcaagcacatgaaaaagtgactaacatatcagaccgcatactgacttagctggttagacttggtcaacgtgccacgtcagcgaaaattgctttcaaaaccgttgaggaggttaaattacactgtttcaatagttggagggtcaagacagggttgagagatacaaattagattggagatatatttgagggagttaaagtggatttatttcggaggagaaaatgcctccaagaacaagagtgcccaattcttgtgctgtttagccacattgggccatgtaatgggttgtactcattcttcttctaactaggcgaaaccccgcgcgttattatggaaatttagtatggtaacaataaatagaaataatgtgtaagatagctggatgatataagcttacatatgttgacgtggtttacaataatttaaatagtatatataatgattatttaaatgtgaaagtataatgtgatgtggctttatgagagaaaaaaagaggaagataatttaaactatagattaatcatccaagggcaataaacaattgaagtggtatggcttaatgagagaagagagaaataatattaactaagtgatggcgaactatataagcatatataagatattaaaaaaatgatggagagatatattaaaatattatgtgaattatgtgggatgatgatttaacatgcttgcatttcaaagcactaaaatttaacaaattatagaattatagataatatagtatacttacatgatgtttaagatgtaataattgttagtggatgatgatgtgcatttttgcatgttaagctttataatttagtgggttataactttatagtaagatgggatagtggaaaaaatggctgagtggctgtagtaggtgagggggagagagagaaaaaaaggggttaaatactcgcttgataaattggaggcgtcttggtggctgcggcactggacctagttggatcgagttgctgaattactctattggtgtgtttggttgggtggaattgttaaggggaaaatgtgagtttgaagggtggcaacttttaaatctattgtttggttgaatcgacatggggggttttaggaggaatttggaaggggagtataagagcgaaccctcatcttttcaatacgtggatagagacaggtaattggaaggaaattcccatctaagtacgacgagatataccagagccatatatcatcacttagaatttaattcacatccatactccccatgattcttatctctactagtaccaaataagaaactagaagtaaaaataagactcccatgaatttccaatccccttcccatctcttaccaaagccgtgtgtccagagagagagagagggaggcgcta

SEQ ID NO: 71734 - DNA, 3355 bp, Oryza sativa
tcggaaatgatatacatattaaatgtgaagattacctaccttactactgagggtaattataagtcatcaatatataagtgtccaacccttaatttgcactttgcgactggtgtcactgccgcattcgatcacgtcgggccctgacgctgccgccgtattcaaaacttgaggaaatatgtttctagattttttttttgcgtcctatacatgcgtctaaaatcaggagaaatatgttgtttgactgaatgaatggtgatggaagcatcgaacgacgtctattaattgacatagaattggtcttgcgtcatatatttatgtcaattaattaatatatgtcattcgatgttttcatttccattcatttagtgaaacaatatattttccttgattttagaccactgcgggagaaagggtttttaatgccagttcgtaaccccttagtcccggttatacaaccggaactatgattctgggactaaagatgtccatgtttagtcccggttgaaataactaggactaaagatgaatctttagtctcggttggtgttatcaactaggaccatagatggtaacgccatgtggctggtgtttccatctttagtcgcggttgttgttatgggactaaagcttttttctttttttctttttttttttttgctatcttgcatatcttacgccatccccaaatcattccaatatcaaaatattatctcccgacatccaaaatcatctaaaaaacataatcccaaatcattcacaacaacaatatcatctcctgacatcacaaatcatccataacaacataatcccaaatcatttacaacaacaaaatcatcctcaaatcatcacaaaacaacaacataatccgccgcggcctacagctctccgtgcggcatggccacgcctgcgctgctgcttgcggccctctgcattggccgccgcagccaggccccgccctccgcgctggccgccgcagccaagccccgccctccgcgcgcgacggctgcgcctgccgccgcctcctgcggccctcaggcgccaccctttgcgagtagaaggggaggaggagaaggagggagaggggaaggggacaccctctgcgaggagaaggggaggaggataaggagggagaggggaagggaaggatgagaaggagagagaggagtggaggaggaggagaggggataaagaggaattaagtacgtgatgtataaagataaaggtagagagtgaatgtgagagatgctaagacttgggagattgatatttactcccggttggtaaataccaaccgggattaacgatacgatttttagtcccggtttgtttgccgtctaacatagcctgacagtaattgaaccgggactaaaaatgatgtataaagatcaaaaagtacccatgagcttttttaccaggactaaagatcatttttagtcccggttcctattcgaaccagggctaatataatttttgcccaacccagtaaagatggtttctccagtagtggacacacgactatagaaatagctagaatacgttaatgtattgcatagacggttggccccatatatggaccgtctgcaatccgagagcatctccaaaaatcattttccaaagtagtagagggcaagttatatattttcacaagcatatatatcctctagttctactcctagttattaatgatttactagctagtactaaagtttcatgacgtttctaatgccattgaaacgcggatcggatataagctaatttgactatgaatttgcttttgaaccagaggggtgcaatgtgatgcatatgcatgcgtgcgtggctgagctagctatgaacttagtaaagtaacgcaagacagtacgtcgatccatgcatagttcgatagtaagtacttaatcatgcttgaattgtacgtcgaaccagtaggccgggtagaaattagctaaagagaggaaacttaattaatccattgctgctatccgggcaatcgaagctaatttttctataccaaaattttggtagtgtcagaacattggtaagttttggttactactaaattttgtagcattgaatttgaactattgtagataaattttggtatcaaaccaaacatgcatgtgtcattattaaagttataaaaattttgatagggtaaaaattagcatcaaaccaaacaagctcggcaagtcatttctatagctaggatgccatatattatatcatacatcgatcaataacaatgagaacaatgttatacatgttcaagttgtctcataagataagctcacaaagtgtccattctaaaagttaattaccttcgagctttcttaatacattacttatagctttcatcaggattgagctaattattgtattcagaatgctttgaggtaattaactttcacacaatcctgatgaagctaattactgtattcagaaagttcttaggtaattaactttcgcaatggctaattggctatacacatcagtataaggcactaacttttttttcagctagctagtttactgatctgcatgcacggtcaatttcttagaacaccatggtcaattttatctaatagcaatatatatatagctgtaattaagtctcaggtaactgaaattcaattaatacgagtgtatgcatggaaagtttcattccgtagtacagtacgaactgccattgtttcaaaaagaaaaaaaaaacgatctcgatcgattttgatgcataattatactccagatggataaggttgctatgtcacagccagcaggtgctagcttgtttagcaacatatataattaggtagcaagtatatatagtggaattaacacaaacaaaaggcatacattacatttgatgcatggctcaacgacggccatagcttttttcagcttcttcttcttgtacctaccgatcgaccttgcacgtaccgacgctgccatatgcatgcagagactagcttcagcattcgtacaacttttcttttactcttttttaattttcagtgcagtatgactcaaaaaggtcataaaaatttggaccatatatatctggtgtacgagctgatcaacagatattacattccggataagcatgcgtccattaaagagagagtatagtagattaagactagatagctacgtgcctaaatatagggctagatctagagctataacgaaatggcgagagtttgcattactctactttgatctaaatttagattgatgcggttgcttaaatttaatttaaaccaactaaaatgtttttttactaggttcctgggcaaattaattaatgtagctctacccctgcctaaatagtcttaatataatatttaatctagtatataaa

SEQ ID NO: 71735 - DNA, 14315 bp, Oryza sativa
gtccatttctcgatccaacggtagtttccaagttttcaccacatatgtggtttgcactacatattttcccctttacgtattaaagatatacttcctccgtttcacaatgtaagtcattctagcatttctcacgatgttaatgaatctatataacatcaatgtgaatgtgggaaatgctagaataacttatattgtgaaacggagggagtaattatattaaaatatttattaggacatatctagattaatattattgtcaaattgacattttaaaatggaggtagtatttttagtgcgaatgataattagaatattttagtttaggatattgtagattgctttaaatattaaagttatgatgatgccaaaatatttttcatgaaatatttaagtaacaatatttttttatgaaaattaatattattttaacaaatcaatattttagaacggtggtattatcttttgaggtgctaatcacaactagttagagtattttattctgtgatattatagagctaatctaattattctgtatgattgtgatgtgatatatgatgatatgatctacattatctattttcttcacaactttttttgttgggattgtgatgtgatatatgatgatatgatctacattatctattttcttcacaacttttttttgttgggatggcatgcaaaaatgtcaggacaatttaaaataatagagggaatacatgttttttggattgttatttacaatttaatggtttttatttttttcatatctatcgtatttaatttattagtgtatgttttgtaaagtgatatatagtcatataatatacattgtcatttttgtctatttttatttaacagattcaattgcatgctaagattaggatgtgataaagattaaatatttgttatgagttaaagaatgtagtaacttggaatggttaattaagtaccatgaatacattaataaagaatgataaaaagattgtgtaatttaaaggatacgattatttttctatattatttgtaattggaacatcttaaaagaaagaaagaaacagacgagaagactagatgaggggagggggcaagcaacgtatacgtacgtagggggagcaaccaaattaagtacgtacagtaccgggggggggggaggggggcacaggtggattgtgggtttgtaaaaataaatctaatagataaaagtagccatgtggcaacttagttgcgtttgtaggagtcacatgtgacagtgtgagagcgtttgtaggaagtttaatgaacttttagtatataactataaaggaagcccacgcaaatgcgcgggcaatttatttattgtttataaaaagaatactaaaaaaattcatgtctcactctatccattataagaaccctagattaacatataatcgtaaaataaaaaatatttatatggttaaatagaccatagaatttatatactaaataaaaatgactatcatattcaaacagaaattactttgtctcaattttatgtaaactcgcttatcaccatcctccgcaaacataatatggtctttgatttttttttttattatacatctaattcacctatgcatgtttatgggtaatatacgaaggaatatttatattgttaaaattatttgtgctaattgttaatgctatttacatgagaacgacataattaaaaataatattatatggttccatatgacatttttaattgtacgtatgtatatatattttttctagtgaatagtaatctctcatacgcacttacttttttccttttttgaacaaatatttttctctcatatgggtagagtatgcgtatatgtattcatggagtgggtatgtacacgtttatatgagcgcctataattacctttacaatattttaaaaaatactttcaagaaaattggtgggatggcgtgaagtggcgccatagcggcattgcttctttgacaacatcgccaggagtggtttactatatacatgtataatttgaagaaaaccttagggatacaaagagagaaacagaaaactactgagatgggacagatcgtatgcactcttctatttttcttcttttcaatatctcttgtgtgcatacgtacagagggatagattagctgatttttagaagcaagggattagaatatatctaatctaatggttgaaaatggattgatcggtataagtgtaaattgatgaccagatgttttgcctttttcttatatttagcgtcacatagcatcttaggctatgttcagcagtggctgttcccatcctcttctcctcgttttccacgcgtacgttttttaaactactaaacggtgcattttttgcaaaaagtttctatacgaaagttgcttaaaaatcatattaatctatttttagaaaaaattagctaatacttaattaatcacgcactaaatgctgctccgttttgcgtgcaccctcactcccgaacgcagccttaggagtatttgtaggagtgtagaaatgctattactcatactcacaatctatttgtagttaactattatttgatgtggcttggtggcactctctatttaactatcattttgttcatacatgcccttaggctgatcatattgatccatttttcaagttttttttggctaatacttaattaatcatacgctaataaactgctccgttttctgtgccagcgggaaacgttcccaactctaacgaacgaaaagcagcactagtatcatcctttatcctctgtgcttgatgacaaacgtgttcattggatgtcagctaattattagacgcactgtgcatagataccatgttagcaatatgacttagcaattggtggatagtggtttgtaaatagaacttatatacatagggataaattagtggggacattattgaaaaattatatattgtatgctacatattagttttagtacatacataatatatttatagttatgttctaaaatgcttatctgattggctactcacttagttatcgtgactacgtttaccgaattgctaactggtgtgtatttgcaaaatattttctatacaatttttttttcaaaatcaaataaattcacttaattaatattgtgctaatgacctacatcgattcgtgtgccctggacaaaggctaagtaggagataaagaacatcaatatggtgttaaaagaatatatttgttctttaattttccaataatatatgaatagagaaaacacaaaatacatgaaaagtacatttatgataaatttagaagtgtcattttgatatatgtgtattttttattgttggagttatttttttcgaaaatataagtcatatctaatttaactattatataatctacatatttcaatttatttatgtttttcatggattttttgatgacatgtgtctaattagaatacaactcgaaataacatattccctctatcccaaaatataataatttttcgctatgaatcgggactaatgcttgttcagaattatagttaaaagttagaatgtagtacatgaaatagcatagtacatgtgtattattattcattatggttttagtatatttttattgttttgttgctatttggttatcacgcaaatggcaaaagtacgtatatgtttaaagttagaagagtgttttcttatatgtggatttaatggtttcaccggttaaatgttatagatctacttccattaatgggtaattgttttctttataatattttttaaaaaattaaaatattagatagaatataggaaggtgagagagaggattattggacgatggaggaagtgtgcgtgcccatgtgcgtgcacggggtgttcggagggattagtctgcttttgatctaatctaaataagaaaaaaaaagatgtgcaacgggagtacataagtacgtacatatgtttgtttttccttttttggcaggaatactatgtacatacttaattggtagtttttgatagatattttctggaatacttacgtgtattttttagtagatgtcgatgtatatagatctaattttattggtataaaataacgggtccaccaatttaaatgcaaatcgacggcaagtatagatctaatctaacagtataaaataatgggtctaccaatttaaataaaaatcgacgataagaatagactgcgtcacgtggtggcctaatagcgtttaaagatagaacgtttgaagagcattgattggatactttatttttatattaatttccgtaaatttatagagtaatatgttttatttttaaattgtagaaaatcctattttatgtaccatcgatttttttttcaatgcactacgtacctatatttacttttttttttactatacgcagctttttttccaatcgtacgtacttacggaatactttttgatgggatacatatacggagtttttgtttggtttcccggcccacagtaaacatgaaaaaagtattagtttttttaagaaaataatgcatctaatctaatggtctaaaatatcgggtccaccaatttaagcgaaaatcaacggtaagattaaacaatgctatgtggcagtctaggaggagtgtttgtaggagcgccacgtggtggcttaggagcgtttgtaggaagtttaatgaacttttaatatataatagatagatagataatagatagatagatagatagatagataatagataatagataatagatagatagatagatagattggtagctctcctgctagtttagttttaaaaaaagttcaacacaagtcagtatatgtgtaagcatatgcatatctcaccagatgatttcatcgacactcaagtgtcggaattctatttgttactttagcctataaacaatcacgtttctaattgagaaaatcaatctactgattgctgcgtttgaagccattactcttgattcggttttcttcttttcttcttctttcttctcttgcgattgctggtaaccacgacgcccttcgggtctccactggcactgcgccgagataggttcacggagcccttccagtgcggagccgaacggtggcgtttaagggtttggtttttgctcaaaaggttcaagcgtactctctaatttgcttctctcttcttataatgtactagggggtcccgggagcttatcttcaaccaaagttagttttaaccagtcacaaaacaaacttatctcttatcttcttagttcagattgtgggctcatcaaaaaaatcaaacaacatgaacatgtgaacacactggacgacgatttctagcatagatattagtgttgtagaaattctcggaaatacacagttgggcacaaaaaaaaaattttctaccaacatttgctcgcagatagtgagctatttttatgttgtagccccatttcaaaatataaggtatattatgtgtaagaaaaatataagttaatattgcccacctatatttaaatatattggaaatagggcactggttttagagtatgcactaaacaggggcaaccaaacaaggaaaagaagtaataaatggaaagcatatgcaacattatttggtatgcagcagtcactcactacatgaatcattcgtagtcgccattcctagacaaagctattgttagtgatattatcaagagacaattatagagatgattgtatcatatattatgtttacatatttatccgactttgttccttgaaatagataactcattattgattaatgaatatgtgattctttcatgagactctttatgttgtgtgttgctatttctaaagaatccctgatcaaatatcatatctggaacaaatatgtttagatgatcagcacatatattaattgatgatcatgtcccatggattatggtatagagataccaaattaataatgtggacacatgttagtgaacatgttgttggaaagacccaacatgagacactgcaagagccatatgtgttgtgtcatcagtgatctcatttagtattggtgttgaatccttagacctgagattatcatggttcccaacatgtgtagtagcttacttagggactgctaaatgctactctataattgggtagttataaaagtagttttcgggtatgctatgaaacttgtagtgagatatgaataatcaagatgggatttgcccctcctatggagagatatctctggcccctcgatgttgtagattatgtaagtgcatggccatgccaaaggtgattgaggagtcaatcacaagttatataatctatcaataggttcgagtgaatgattgagctattagatgatagcatatatctagccttgagattaatcgatatcgtgaggcaaaggggttcatacaagtatacactagaggttcagccgatatgatctttatgtatgcccggtgggtctatacgttctgctcggggccgctgttttcgggttacagccgagtgcacataaacctacagggtcgcacgcttaatgggccggaataagtggattggatggagatctaatatgagcttaatttggatagggatccgaatatgagtcctacggcccttggaggcccgagtgatgtatcctatatattcgtgaggggtgtgaccggcggaggtattgcatcacgtgagaaaccctagccgtcactcccctccccgagcaaaaccctagccgcgcgcgggtgctagcacatttgtgcgtggcgttctgtccctgtacgtgtggataccgatagaggtgccgctagtttgcggtgctaatcggcgtgggaatacggcgaggagaacgcacgaagaggagaaggtcgagctggtgcgatcgactacttcctctacatcgacgcgcgctacttcgtgagaattcattcgacttcttagcgccttattccgctgcgcagcgcgtcgagtggtaacgatatatgatctaatacttgcatagttcctggtttacgcgatagaaaattttaaattatgctatcgtagcctacgcgtatcccagcagctacgtgggtgtcgattcattgataggaatggaagggatccggaacagaggaggcatctaccaacaccttacagaactctatcaacagtaatggatcagaacctgacgaatctctggttatctatccggagcaaactgcagtactctacgggcttggttgtagtagcgcgtggttggaggtagttttaatcgagatggccgcggtatgagtgctgctatccgtacttacgagttgcgacccacggttgtataacttatgtagactaaaaacattcaaccatgcatggatcaatcaaataaaacgatatgtttgtttacactacagttatttgtaccggttgattcaattcagtcgcacatgagtcgaacgattaattgggccagatgcacagcaattttcatggcagtttttgggggtgtgggtgaatgtggctgtacgtgtttagttccattctccttctggcttgagtacaatcacggaactcagtttttctcgagtgaagtgacaggaaataatcatgtgatagacaaataagctagcactctgtcccaaaatagctgttgatctcctaacattagaaaataaattaataaacatatcaacttttactcaataatcaaagtttagcgatgaatttgaacaaattgtcactaaaattaaatatctttggctggaggaacaaatcaggaccaacaggtaaatccaaaaattttcaaccaaatgctcaaaacctgccagtaaacattcaaccaatataaaaaaaattacattactccatccgtttcatagtataagtcatttgacgagtttgaccaaatttataaaaaaaaatttagaaacatctcaatattaaattagtttaattgaattcaacattgaatatattttgataatatgtttgttttgtgttgaaaataaaattgatcaaacttaatatgaaaccgagggagtaaaaagcaacccacgagccagttatagtaatttgcagaagcaatcctcctctctgcgcttgctcgcagcagcaacgcaaagttgactaccatgttctgtttctcactccagtcgaactactttcaatttactgacatacgtccttatgcaagattcacatccttttatttaagcaaatctgataaatcaagctgatagcaggctgataattatgcattgaacgtttgcctccagtcggaacatacgagcacaaatactccctagagagagcatagtccactactgaaaaactaatctttactcggataccaaaaattacatttgtcgtcccggttcgaatgaaaaagggactaaaaatcgttttcccacaatagctgtcacgcctccaaccggttagttttggttaccaaccgggactaaagattaacgatctttagtccaagttgatatcaccaatccggactaaaaattgatttttagacaccaaccgggactaaagatgcctcctaggttagtttaaaaggaaagcatctctatccaagtcacatgtgtgtagtaggtgggatgataatgcacgtgggatgataatgcacgtgaagactgaggtgatcgagagatcttaagtatgcatctttagtcccggttatttcaacctgagctaaaaatctttagtcccggattgtccatcccgattacacaatcgagactaaaaagggctgcgaacccaattaatctcggactggtgcccagggtgccgtttattaaggggtctagacggaccactttctacttagtcttgatttccacatcgtatacaaataatactatcactgcttatttttattttgaactaaccaatttccaacatcatcatataaaaaggaatggagggactaagtttttcacataggaacatgcatggtaccacctgtgtcttaaaatacggcttctagtatttgaaattaaatttgtcctgagaaatgaaacatccaaccttttttctcacctcaaccaatcaatattacatctcacttaattattccaccaatttcaacatttaattttaaccctctcctcgatccatgtaaaaaaaatccataaattcttatatttcagtacagtacagatgtaataattgatggacagacaccacactggtggagaaagcgtttgtagttccggttcgtaacccccctttagtcccggtttccaaaccgggactaccaatctgggactaaagatcgctatctttactcccgggtgaaataaccgggactaaagatcgatatttagtcccggttggtaataccaaccgggactaaagatggctcagccacgtggccggctgagccatctttcgtgggactaaaaatcgagctgacctttttttttcatgacccggttgctgcatggtttatatatatatataaccatgcatatatatatttcaatacatatttatatatgcatatatatatatatatatatattatattatatttatatatgtttcaatatatatgtacatgcataatatatttgtatttatacatatatatgttatgcaaatgcatatgtatatatatatttgaccaaaatatatatttacattatagaaaatgtgtacacatgcatatagaaacatagtcatgtattaattacactacattatatgtcctagctagctacgattttgacgtagtagtagtcgctatctcagaagctaaggacatatgaattgtatttccgtcgtagtagaattcacccttgggatcaaggatttgttcgttgatgaatctcatgagttgttcttgaaccgccgcgataaattccttgtgtgtgatcaggttatccctcatgcgaataaagtatatgaatgtatgaaattgattagtaattaaacaacaaatcgatacgtaatgaaattttgaatttatttgtacgtacatcgagctctcttgtggtgatgatttgatctgcaaggcagtggcaatactcgcacatgtagtagccgcacaagttagttccctgcttttgctttgcacactataaataaatgacaaacgacgagagatctaattaatgtacacttgtatgtatttgaatcggagaaatataaatgtagagcatgtgtactcacaggaaatttgaacttctgcctaagtctttctctccatttgccgcggaccaaatgacggaaccgataccaagccctacatggagtttaaagctatgattcgtagtagcaattaactataacaagattcttaattaacatagaaacttatgacagtacctgtctataagttcgaaaaccttgtcaaacgtagactcttttttatccattgagtcatatacgttgaaggtgcaggcctccaggtcgaagagtaaaagcacccagtggaatctgcaatgtgcgtgggatgcactacatataaaacacttagcatgttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagaatcaaaaaccccccgccgttgggccctttgaatctccattctacaacgataaaagggagtatatattatatatagtctacttatatacaaggacttaattaattaaaggagacgtagtaagaaatctaactgaacgatatacttacaaaatccagcgactcataatagagacgtcgagggcgtccagctggtatagttcgtagattcccttgaaattgatcaagagaatgtcatctccttgcaagaagtccgtgtccctgatcctcgctccgatcatctctctaccggtggcgctcatctccatgtacagctgatggaacttgtacatttgtgtgggtagggacggcaacagctcaggcttgagaagcggtttaccgagttcgcacatgtatttcacttccgccttttcgattggtgcatctcgtagcaattgatctgtagttagcccgatgtcattaataaagtcttgtattccaaaaacttcaccggtcaccaacggctcgatctcctggtttggttgctctccaagctgagggactagtttggactttccagaagatgctttcttgagtgttcgctcatagtccgatagctttatggcctccttggcaggtgcagacatacccctgaagaagttcctgacactcgggtctataggaatcttcttttctagactacgaggcttgaattgtctcctgacttctgatgccacgtaagcgtcaagctcctcttgcgtgcaatcgtaccccgggtccttattcttggcggcatcaactttcgccttcttcgttgcccttgtaggggtaggcggaggagccttgggggcccttgacttggaaggtgccggaagaggagcctgaggaggagtcggtgtaggagcctgaggaggagtcagtgcaggagcctgagaaggagtcggtgcaggagcatgaggaggagactatgcaggagactgaggaggagatggtgcacgagacgccgcttgtcgccaagggaggatgatgtaccacttgcgccatagaataatggcgtggcttgtgtcatgtagatgcgtctcaccgtctcctctagggtaatccagctcgaggtcctcatacgcgccttcgaccaactcaacttcgaccttggagtatcctgctggaatcggcctgcagtggtaagtacctaaagggtccgttgggatggccatgcccgacgccaccttcatgtggtgagaggttatttattagtaatcaacatatataagtagcaactagcggaatggccaaatctaaaatatataaactacgagcttacctttattgataagttcttgaagggaatatacagctcacatggtgtccgctgagtgatgtcatcaacagggtaggtggtttcgtcctgggtttgcatggcgtccatgctctgtgatcctacctgccccgttgaggcgcagctgctacgatttcctgacgggctcaccattgcaggaggaatggtcggctagggatcatgggaccgatgtacggccatgtgttcatcaaccttccttgccacctcctcttgcaagctgagctcgtagctcgataccctgaactcaagatctgcaatctttgcctcggtatctctcttaatcctcatccgactcctgtacgtgtggttgtcctccttgaacccaatcttccaaggaatcacccctttccctcgtgtttgtcctagatgctctggagtctgcagggcgagtgacagctcgtccttctctctgtccggtcggaacgtgccctgagaagaggctttcaatgcgtctgttagtcgacgcgcagcctcgcgtatctgatcgccgaagactagggagccatcagctgggttgagcgttcactgtgagcatagtaccagaacttcgatcggtccggccaattagcgggggccggttcgatacccctttcaagcaagctagccttcatctgctcccacttcgacatcgcgacgctatagccgcctgaccccaagtggtgatggtactacttcttggcggcattttctttgttcctttccatcatcgcctgctcttgttcacctgtcttatatgcaacgaactcgtcccagtgatccattagctttgggaatgtgtcgaagttcggtgtctgccccttcatgatatatttctgatacagatctcccttgaagctctgaaactgttctgccattttcttcagagtccacgttttcactttgtcctctgtacccgcgggaagggtgaatgtctcgagcattgtggtccacagcatctctttctccgaatctgggacaaatctctcatgatctccgcgtgcccttgttctgcaccagtacactgtactgacaggcacgttatcccgcacaacctaaccgctgtgacgtacatagttcttggcggcttctaccgaggcactaggtcggccgtcttcgtccacttccgttatgatgtgccgaccctcaagcttcttcgcggcatctcgttgcccgcgtgccctcttctgtccagcggagggttgacttccactagcctcctcctcttggttcccctccacatccctctccacgtgcccctcctagttcccctccgcatccctctccacgttcccttcctcgtttaaatactggtttgtgtcctcgttcccctcttctttgttccagtattggctacttccctccgcgattgtatcgtacaatatctgttcctcatcgcgatcagccatctgttcatacaggaaacagctgctaagtcatgagacatttatgttttaacaatcttatatgctaacaatcatatatgctaagtcatatatactacgtctaactgtcgtatatgcgaagtcatatatgcttggtctaactgtcgtatatgctaagtctaactgtcgtatatgcgaagtcatatatgcttagtctaattgtcgtatatgctaagtctaactgtcgtatatgctaagtctaattacaaatctaataatcgtatattaaaacaataataatcttatacaaaaactcaaataatcttatactaaaactcaaatagtgatatatgctaagtctaggtgacgtatattataggaccctagctagtcaataattatatactaagtctaattacaaatctaataatcttatattaaaactcaaataatcttatactaaaactcaaatagtcatatatgcgtagtctaactgtcgtatattagaaccctacacaatcatatatgctaagtctagttacaaatctaataatcttatattaaaactataataatcttatattaaaactaagtctaattaagtgtcgtatattaaatctaatagtcttaattgcattacaaatataacaatcatatatataattacgtcacttgcctgcgcgaattccttcgagggctagctaccactccggcttgagggacgacttcgacaacgtcttttctgcaacatacaaaaagatgtattaggataaacgcgaagtaacatatattgcatttgacattcacgtttcgttcacgatcattcacgttcgcgttctcgttaaggtcacgtttcattcacctacgttcgttcgttcacgttcattcacctgcatatattgcattccacgttcacgttcgttcgctcgttctcgttcacgttcgctcgttctcgttcaagttctcgttctcggtcacattcgctcgctcgcccccgttcacgttcacgttaattcgttcgacgccgtggc

SEQ ID NO: 71736 - DNA, 2056 bp, Oryza sativa
cggtacacaattaccagtagtactagtataccatggcaaagagcgaccgaggaggctaggcccatcccacccatacggaccggactggacccgtcacgtccatctcctctctcgtcgtgggcccccaccgcatttgcgcctcgatgtccgcgccctcaacaatcacatcgcatgtgcccccctctcctcgacacccccatcgcttctgtacattcctactccactccggtagcattacgattagcatcaacattagttacttcagctaagtgatttagtcgtactattagcacgattttactgttaattggttaagtaaataattagtatgctgtagtagtgctaattaagtatagtagtagtagattagtagtataaaaataatgtaatagtgcgtgccgtgcccggctgcccgtgtgccgggtcgccctccctcgagcgacgaatctgccggcccttaaacaagaaacaaaaccacacgactaatggcatgtacaatgatttttattaacggtctctctttattatcatacaagcatattggttgatgtggactagagagaaaaaaaaaagagaaaaatgtttgctacgtataaaagatgattgctccgtatgagtatgagaacgatacagagtcgactcttagtatttattagaaatttttttattgcattgagtgtaataaaggaaagatgactactaagaaagtattttgttatattaatggttagataccgtattatcttaactattgtaacatgatggcctctaattaacatagaggccttactgagtctctcccttggtacttgccctaatctcatcgtgaaaagcctcaaaacctgcaattaactaacatcctaattaatcaagtaattaatcaacaatctacagcgtacaaccgatacagtctaccactaccccctacagtacaacaacaaagctcatcaaaaatacccccactcacactagtcaacacatcgtctcatgactaaaatgtttttgttactactacaatggcgccgacatggccgccgggcatcaccggagcacgagcagccgcagggcgtggaccaagaacagcgccagcgccgcggcgggcgacggccgggacagggacgccgccgccgtcagctcgccggtggccatgttggcgatccacgtctcgctgccgctcagcaccacgccctcttcgccgccgccgccggcgtcgccgcccatcggcatcggcatgctggtgtccgggacggcgtccgtgaacgtcgtccccggcatcgtcgtcgccgtcgccgtcccgggcatcgtcgccccaggcatcgccgtcgccgtcgttggcgtcgtcggcgtccccgtccccggcatcatcgccgccggcgtcggcgtcgccgtcgtcgacttctggctgccgctgcgcaccacgtgacatggaaagagaaagaacaagcgcacatggtcagctcacgagcaatgtgtgtatatgcatctggaatcaaatccatggctgcaagcaaaatcaacagtaaactaatcgcgcgaaacaaaacaaaagctcgggtttgcacttttcttttcaccctatctgcaactaattaactaaagataatgccaagatctcctccacctaattactactacactacaatccttgcactttctttccatttctagctcacaacatgaacagctcactaagcatccagatttgcagctcagatcactctctgacagtgacagtgagtgagtgacagtagctagcagacagcagtggaaagagcagatgaatggcgggagagaggtgaaccttggggaggaggcggggcagaaggtgagggtgtagtcggggccgccggagcaggtgaaggtggaggtggggtcgtcgaaggcgtagctgtaggagcgggggcacgccgacttgaacacctgcgagtacgccgtcggccggcacgtcgacgggttcgcgaacgcgccgctgcagcagaactccggccgcccgaacgcgtcgcacgcgctccggcacgccgcgccgccgcccgcccggagctccgcggggcacatc

SEQ ID NO: 71737 - DNA, 2112 bp, Oryza sativa
tgttgttggggtgatgaagaagtcgttgagggtagtccaaaccgaaaaaatgttaaaattacccgattcaaaatggaaagattagtttaagaaaggtccaaagtaaaattttgccaataaaagatggcctacactgtaattctctctaaaataaaatccaatgttcctgtcaaagaaaaatacctcaatcccttgcaaattcgagttaattttatttgtataagcagatagtacatatttctttgatagcttcaagggaggaggggatgaaggagagaggatgaacacgagagagaaggggatgaaacaagatccccaacaaacaatcagtcagcaaagaccacattcaaagacaaactatcggttggcaaaatttttgctgaccaacttcaatggttggaacaagtctagtcggcaaagaaatttcccaaccaacatatttttgctggtcgaccatctgaccccaatagcatatatttgccgaccgatatcattttttccgaccgacatgtttttcccgacccaccacaattaccgagctggtatcggaaactttttgccgaccgaccataagccaccaaagtttattattaccgacagattgaccgtcagtaaaaatttacataattaccgaccaacaatcggtccataaaatttgggttgccaatcatccgttggggttggttaaaaagttataccgaccaactgcctattggtatagatggatattccccgtcggaagtcgatgggaatgtatggacatggtgcagtgataggcaccgtttggacttgactggtgcacggtctatttttctccgttaataaccttatatatattttaagctgagtattattattatcatatcattataccgtagcattcgttacaactaaatctttattaacaagatcttgcatggttatatccagataaaagaaatattgatgggagcttctgcaatatgtttggctctatggttgtgtaggaatgatatggttgtgtaggaatgatatggtttttgacaaatcatcatctattacatatatgcaagcaattttcagggcaacctattggctccggttttggacacaactacaaaggtgtaatgaagatggtgagcttttaaaagttgcatgtcgtaagcttgagataacggttatgcagctttttgtcaattatggatggagattcacaaatagacttcaataatgtgttctcctgatcttgttttggttaaatttacctttgtgtggtcatttcttatgtcatttctgaactacacttgttttagagtgctagattgtaataatgagctgtagctctctttgagcaaaggccgggatgactattccattatctaaaaaagataaaagaaatatatattgtaaattaattttatcatatatataaattacttttggatttgattaaatcacttcttagatatttatgaaagtaaatttaataaagacaaaaagtattttacacaaattataaaaaataattaacacaaaaaaaagtaatttagcacagaactaaaagtaaaccagttgtggaggtaagaacatgagtctatctaaaaattaaattgaattggcgcaaactaccgaactaactaaaaacaacaataaaataacatattcataacattatgaatgcctaagaagtaatttaatcaaatcaaaaggtgatttatatatatgttaaaaagtaattttcacatataataaagcaatttataacacatgtatttcttttatcataacgtaattatataagattttgttagaaagatttaaatgcagtgaacacaatagtataatcggattatagattggataagtaatttaagagaaaattttatttgaattttatgaatattttcttttttacatgctttcatactcccacgtggagaaatcatacatattgaaatgatagctggttataactaattagtgtacagtgcatatttgtgtccttttgagttcttgtacctacatcttaacaatgccacaagcagatctccataatctaacaattccagcactcgccaccaaactttgacactactccctccgttccaatatataagaaactaggaccattcg

SEQ ID NO: 71738 - DNA, 3738 bp, Oryza sativa
aaaattggtgggagagacaaaaatagtgtacatttcacactttatatgccctagtctgtactaagtcgttcaacgaataaatagcatattttgggagacaaatccagtggaattatatatttttatgatcaagtacatctttacacatctcattggaaaaacttaaaaacacctatattgtagataatataatggtatatggatcttgtagctgcaacatccccctttcaatctctcatcaatttccggtctatggggtggcaggagagacaggactgtagtgttccccattaggatcaaagcctgctaatcataagaatattacaaggcattttctatattttaattgttaaacacgcatgcatggaaaaaaattatgtacttctccattatataactacaaacacagactttcagtactaccgctagaaaataaattttgacatgttgttactcatgttctaaaatgtatttcaagttaataaaactaataaaatttaccacgactacgatatatttcattaagtaggcacatataatttataactggcggagaagtaacctggatttcggtagaacagaattcgacgatgcctattagttgccaagcctagaaataaccgacgtactggatgcttcttctcccagttgattactatcccgtgagatttgtctacattcactgcaaccaaaaacaaaataaagatgagcacaataagccattcgtgttttccaaaaaaagaataaaagtgaaattgtatgatttgccttaacaaacagtcgattatatgatttatcattgacgagtacgagttttataatataccatcacataagccattttttttaccgttttgtcattgtcatgagttgaccatttgttgacctctattagccccaacgaaaagtccattctgcctttaaaaaaatgtaacatacactaagcaagcacatattttcttcactgatattgaaataatagtagattttattgtattatttgcaactggcagcaaaatggcattagatattgcaagggtattttaggtattatgaaaaatacaaagagataatggaggttgactggcggtgatggaaaaaaaaagggggaaaaacagagggtatattgtagaacttgacaatataatgaaaattgtagaatttttcaaaacgtaatgtctgtttcatactatttaacaactgatcatgcatgcatttatttcattacagtagtaaatgggaaaatagctactggaagattttccatcaatttttagccatcaaaagcgataacactatatataatttccggccccttcgaagtgtaactttgttcatctccaagtcccattaatccattcaaaatcaagacaaccaaattacacctgattaataaaatgtaaaaaaagacaaaacaaaaggacatggcaattaattaaagaaacaaatttgcaagagagctcacctccggcgtgctcacgacggccggcgagacatccgggcagcagcaagagggacaccagtagtactgccacctgcaacgagacacggagcctccggcgagcagccgccattgcgatcgctcggcctctcaattcagatttcagagctaattaagagatgtgtgttctcgcaattcagatttcagagctaagagatgtgtgttcccgcaacgcatgcagggagctatttcaatggccggccggccgagaaggagacgacgaccagcagcggcgacgtcgatggaacgacggcgacgtggagctttgctacttgctactccctccgtttccaaatatttgacaccgttgactttttagcacatgtttgactgtttgtcttactaaaaaaaatttatgaaatatgtaaaactatatgtatacatataaatatatttaaccatgaatcaaatgataggaaaataattaataattacttaatttttttaataagacgaacggtcaaatatattttaaaagagtcaactgtgttaaatatttagaaacggagagaggatatctgcttaggctgattcgtgtggactcgttcagtatgaaactgatctgttttgggtggaattcctgcatgattcctacgttaattacagacaattattatacctacttggtctcggcatgtattggcttgaatatttggcatctgaatgcttcagttgtacttcaaaggtagagaaaactagtgaagtcaggtcaaggtaatattattaacttactatacattgttcacgtcagtagctgaaattgactggaatcgtgaatcgtccggtaaatatgagcattattgtcagttgatggtttcgtcagcccatagagcgaccagtttgtggtcaaactagtttagtatacgaaaataaattatggtaaggtaatcatccaaggagtcatgaacatcatcacttcatctactcgtcctgtagccttaaaagtgtcattgacattcttctaatcatggtttgaataattgaacacatttgtttgaacaatacgactgatgtatattatgtgtatcaaagtccaacaggagttacaagaccatgtcgagtacgctcctctgctttgtaatattctaatctgacgtaatagttctgaattacatacacaaggtaactagcaagtggaacaacactgtcagtaaaaattatatggtgaccatgcaaatgaaaagtcacccacatcaagtgctacctgggaaaattcaacaacggttgtctgtctgggtaaaacagaagatgcatgagattgctcgaatactattaccttgtcaatccgttctttgccttacaagaatcatgtttttttttttgtgtgggtctactgttcatctcatcttcatcaacgctcatgaacaggcaatgtctgaagtatcgtcgaatgcacagattccctcgcttgccacccgaggccaatatgaaccaggtcctgaaaagaaaagcgacaggcagattacatatagaagtacgtgttgtatggataggttcatatgcgaaccgtactgatgttttattcgaccattgcctataattttacctactggttggataagcaaggctcgttgcaaaagcgtgccttgcagatatgtatactgttaaagtgatagcaacaaaccaaactgtggcatataaaactagatcagtaagctgtttgtaaactactctctccgttctgaaatataactctttctggttatgtatctggataagggtatatccattatgtatctagacaagggtattcctagatacataactagaaattgttatattttagcatggaggtagtaaatgataagttgttaagcggtgccttgtactatttaccacataggtcactggaaattgatgtgttccatccaatgaggaaggatatggaagactgattagaaggatagttttctatgtgcatagaagtgttccatctaaaatcacttgagtagcatgtgactaaaatgtcttattagtacaggtgttcagaaaaatgattcataaaagaaactgcaggtatagcaatttgaaattacaggtcacatggataaattcacaaattacatggactcaacatgaaatacactttgtgcataatacattgcatgccaaaagtcagtttcgtttgcaagatagtaagacaggtcagaaagaaccaatatggaatggagaggattcttgtcaacacaggaagctactattatttagtgttgtgcatctatccatccaactgttta

SEQ ID NO: 71739 - DNA, 2012 bp, Oryza sativa
ccgcccgcgccacgcccggggggagctcgaaccccgtggtggccagccgcgcgctcccggcgttcgacagcacgcccggccacaccgtgtccgtgcaccggttgacgaacgtgaacgtcgccgcctccaccccccaatctgcgcacacacacacacacaaaacaaaccatgccgccattaccaaccatccacaacaacaacaacaagaacaagatcaaacatcacagatttacctacctctccataagaccaagaagagcacaagaacggcggtggcagatctcggcaaccaccccatcgccattttcttgatgcaatgcaaatgcaatgcaagaagcgtgcagttgtcagagattcaggcacagagcagagcagtggagttactccacttcacttcacttctgcagtgcactaatgcagagagagagagagaggtaggggacagccaccacaagagcacttgggagtcttggagatggagaggagagagtcacaaggatggaggagaggggaatctttgggatgggtacaaggttatacagggagagtgggggcaaatggctttcttttttttttttttaccttgcttttggggcaggagtgtacatatgcatgtatgatcatgtttcctgggtaaaagtgagcttgggaatgggccttggttgttgattgttcctggggcataggctttcttcttttttttttactttttattatcctccccatctgtgtatattttgttatgggattgacaagggttagggtagagtgagtggattttgaggtccccctcccccctagattgaatggggggaaatatataggattttgatactaagtagcaaatatataggattttgatactaagtagaagtataaaacagaagttgcaaaacacattagcttaagagtttaagaaggaaaagaagactagttggaattttctaatcccaccattttatattatggggttgttcagattatagtcaaaataaacctcactaaattttggcaatacaaaaaatttagtaagttgacaatattaccaaaattttggcattatttcttacgcatttatgaaagtttggcaaaaagattttggcattatttcttacgcatttatgaaagtttggcaaaaagttaaatgtatgtacattttggaaactttaccaaaaatgtatggtttaaaatgacatcatatgaactgcccctgtaagttgtttttgatttttttttctaatcaaatttctttaggttttaggtttgactaagtttatagaaaaaattgtaacatctacaacatcaaattagtttcattaaatataacatcaaatatgttttttatgttagaaatgttgttgtatttttttataaatttaatcaaacttgaaatagtttgactaataaaaaaaagttaatgtgacttatgtatttaaaacagagggagtaatactattaggttgaacctcaatactaatttttatccaaaatctcattgtcttgagccatttcaattgaattcgtaggagcggcgatcctttgctccaagtgaaaatggaataaggattattttttgtaagaaatgttatgtactgatcgatcgtgcatatagtgacagctctagttatcatccatgcgtgttctatttattagaacatgcggcttttattagttggtctaatgctgattataagccatataacttgttaaaaaaatatgatttgtggataaacttatgtatgttgtatgtatatttccttggcgattttaaaaaccaatgctaaaaaataaactttgataaaaaaatcaaaatcaagtttttaaattcaaaaattaacagctgaagggcaaatgacgaggtgatgagtttctcgaatgcaatgtaagtaagaaatgaagggttccatttgaaatatgcagaacttttttccatgactctacataaattgtactaacttatataaaagttcttcaaaatctccatttgaaaccatgaatttgataggacttct

SEQ ID NO: 71740 - DNA, 1343 bp, Oryza sativa
tgggtttgaatgcgggagttctctaagcgggaaaaaaaagcttttgggaaaaggttacaaggaggggaacatggtctgaagttgtatgagttaggctttgaagtgctgagtttggtaggatagagttccatggagtgttgaagaagacgattgatcgatccgggttagggtagggtttaatgtataggctgtaaatcaggggaatttcgaaaatagctagcgagtgaagagtatcattgaatttgtttgcctatgagtgatcaaagggccggggttgtttttcttgaagtgatgttaatgaggtcgaagtccccaagtacattaaactatgtaactatgccgacataattgtttggtgaatggaatatggttcattttttttgttgtgtcgttgtttaacctctgtaactatgccaaattgtgtggtgattggaatataggtatatatttttctggtgtcaccgattaccctctgttactatgccaataattgtttcatgattggtgatgtgggatgcccaatgtgctgtcttttgacaatgtctttttatatcgtggttctaggatgcccagatacggctgatgggtgacgtatccgtatcggatacgccatcctgattactgtgattttaaagaaaagaaagtagttcggatacttctcatatacgtgcgtatcccgtcctgatacggccaaaccaacgcagcaatgctgctccgcatcacacggacggaagcgtcgacccaatccacccgcggcgccgggaatgcgctgcctcaccgcctgctatctcactcatccccgaagcagtccgaggcaggcgcagccgcgcagggcctccactagccggctgttgggttccgccgcgtctcgccatctgagctacaggatgtccaccggcatctaggcgtcgttgttgccgctccccggcggagggcctctgctggtcggcggtctctgcatcacaaccattgggcgaagcgtctccgccggcctccaagcccgtcaccaccgctaagtctcgatctgatttgagttttgttactgtatgtgttttcccttctcaatttcttagtgcaagactgcaagtgctatctcttttcttagatcccgtgaaatttggaattggaagctcaactacttctctcctacatacaacacattatccatgggatctacctgatgggcaagatttcctgtgatagcgctaaaagatttttggtgcattagacctgctagatgatatagcactgtcaatgatgctaacaccaattaaacttattcagccattgagtcgaatttgataccctgactagttcatgccatgtaatgctatatctttttt

SEQ ID NO: 71741 - DNA, 3128 bp, Oryza sativa
tcatgaggaaatatgtcggcagattttcagcaatactagaaatttactcactgacttatatcactttctactaatgataatactggcaatgaaactaactaacaaattgtagtagttatgagtgcatgctatacataggtatagcgttgaaaatagtaaagccctctttgaaatatagaataggaaaaatataggaattaaaattgtatgttttttcaatcttataagaaatgagaacatagaaaataggaagaggtcgttttgattgcaccacatgaaaaatttaaccaaacgaaagtttcacaaaaagtctacatcttacttatttcctatggaattgatcataggaatgcctatggcaattttcctatactcttccatgaatcaaagggctctatataaaaaattcaaagaaaaatgaatcctccaaaattcctctgtcaattctccatttcaatgggatcctaattaagtagctagaataaaaatgtgattcatagtatcggtattgttaccaaaaacagtcaagtagagtaaaaatgtgattcggatccttaagcagtttgttcagcgttacaattaacgtgattaatcgtattggttgtctatttccagccagcgagagtacaaatatagccgaagcacatcagatcagttaaaattttgcaaaggaaaaaaaagagaaaagaatcctcacatcttcaatagaacaaaacaaaaacgagtccctatctaagattaatccttcatccatttcatgttttggcgccaaatcttcttgcagagtcagggagtgacgggaggatcgtgcctaggatctgaaaatatcaatcacattcaaagatgagccctgtgtgcaagtcgtaattcatcaaattactgaaattaaatgatgaattgatcagccaaaaaacagatttaatgaaattaattaattcctcgttgcaacaactaaccgtagtttgccgaaagagatcttgatgctgatcttccaagaactaaccgacggcctcctcgcttctccaagctaatgatcactgccccatccggcttgctatcaatcactgacacacatatataacggcaacattttatttaagataacgaaaaatatattcaatctggtctttactcaaaagaagctatagccaattattacatataccggcaacattaccatcaagctaaacagagcttatttaattataagttgtgtagattacatagattcagttcagggtcgacgctaattaaatacctgaattagctgagacagatccgaagagaaacattggcagcaacaagatggagaggatcagaattgcctgaagatgatgagcacctctcattgctgtaagtaagctggttttctgctgcaatttgcaatcatggagaagactgcacagagagtgcggctcaatcgcgatgttgatttagcatctcctatatatatagagatacacacacacacacacatgtctgtgcgccaatcttgatacgattttgactttgggagatgatgttctacatgagattattcagccaattgaaaggaatggaacgagtcatattattcagtcataaccagaaaagcaatagagaagtgcaagtcagcggagagagccagagaccagctgcacagaaacattgtgaacatttccattctttgtttcccctcatacaagttgtattttaagcttaaagttttattaagacatagttgacagcatcatcaaagttacaaaatatttttgaattttttcatgactatttgcttaaagtttaaaatctcgatgtttaaatcagtcatagtgctttcaacccatgtaaacagtgataaaaaaatctaaaaattatgaagaggtaatttataatgcatctatgatcttatcaaattttagtgtaaaatagaaactaaaagagaaatacagttatggagtaaggtgagtcgttttcaatagttaagagagtaaaatgagccgagaaatcacttaggggataagtgctccgaggaaatatttcaaaggagtaaaatggatttttttccattaatccccaaacaataaatgcattacaatagattgtgataatgtttaaggacggatatgtttcaattaatcctttcccctaacaaatgcattactggctatatgcatatattattactccctgcatgggaacttcaattaatattgccctccctctgatttagatatgcagttattcacagcatcagaacgcctacataaacaagaaggccacaccctccaatttccctttatctgaccgtccaaaaattcccctccaaactgaacacacaataacaaatctccatcatcaatggagccttcaggcaagctctcctcttccgccgtcgtcctcgtcctcctcctcgtcgtcgccaccggtatatttacgatcagaaagataaacaaatccggtctttttttaagtattttttagttgggcatgtagcctactggttatattgacctgagtagcaccctaaagtcttgagttcaaatctccataggagcgaatttcggattgggttgtttgatgagctaagttcctaatttaaaaaggttgcatacatcgggttggatgtataggccgggtaaaaaatactcttctctaaagaaaataatagtaaaaaaaatctcttctgtaattttgtgcagagatgacggggatggtggtggtggtgcaggcgaggttgtgcgagaagccgagcagccatttcaaggggttgtgcttgcggtcgcagaactgcgacaacgagtgcatgctggagggctacatggacggcaagtgcaagtacttgactcgacgctgcatctgctccatggagtgcgccaccatgagcaacgttggcctgacgccgacgaagtgatggagacgtacttggaatgaatgagtgagtgagtgagtgagtgagtgaatgatcgatgaaactatagctgacgcggttatattaattcaccgcttgcagtaataaactttatactagaagctggtcattagctgtggtaatacactaatactacctacggaccgtttcaggttataagactttctagcattgtccatattcatatagatgttaatgaatctagacacacatatat

SEQ ID NO: 71742 - DNA, 2310 bp, Oryza sativa
tggataccacaatttgttgaatgacctagctttttaaactgctaataggaccagtaaattgtggcgaatgatctagaagttcatttcttcttttgcttctgcaagtattttttttatacatgttttcttagatggcttcccccatatatgttccatatttggcacagtgtttcatagatttctagttatgattttaacttaatattggagtcaatcatctgctttattgtatgtatctgatggttagtttgtttctttatgctttgaatgcaaagtgcttcaagatcgtaagatgggtatgcactgatcttaggtttagaatttctacttgtggcataacaatatttgattgctgcatcctgatagttcctgtgattggctttgctcaaaccactgatcttatgtttaacattgttgtatgagtgcctttggtactattcatatctgtgctcagtattgatgttctcctcgatgtcacttcttttgcatatgactttcacaaacagtggaaagcctaaggactatgatgtctgtgaaggaaccaacggatggccatgcggtagatccggaaaaatcctctgaatcaagtgtaggagtttgttcaaaggagctatctgacagttccagtatttcctgttgtagagagaaccaacgggacttaaactgcaaagaagtcctacacgaatcatcaatcaatagctcccctaaccccaccgtttctctcatttttttggattatttttgggctccttgtttaatttacacgttgtcttttactgttttgggctcctcatgcagattagcttgacgctttgccttgttgtgtccggtaccatcaaccgggtgttggatgtttatgccgagcatgtatgctctatgcgttttttcaaaaaaagaaaaactctcaggaaacaacgaagtagtcctccttattctaatttttacgaaaaaggacttacctttatatgaaatacaatgtaatcccaaaaagtacgagggcattctcaaaaaaacagatcctaatccaatccctcctcttactctgctgccaacccatccccaacacgcaacatctctctgcccaatccgccatccccatccatcaggctaatccatgcggcctcctcccggccgggggcaaggacggcgccggcgtttacaaagacgacggagcaaggggacgacatgcctcctgtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaaggtgagcaaaagcatgcagggatatactatcaaactggtttgccttctgtgtgtctggctgtgaaatgttctggacaaattggttgacatggagcaatagcaatagtagtgttcaattgtttgccttggttgtgcatactctgcttcaactatatttaggaattgcaagtctatgtatttatttgttttgttcctttcttgcataatggaacaacctttatataatcaaggaa

SEQ ID NO: 71743 - DNA, 1122 bp, Oryza sativa
  unsure (1)..(1122): unsure at all n locations
tgtttttctcgtaagtgaaaaaagcaaaaaaaaaaacatggtaggagaaactgttttaaaaaaaaggcgcctcttcaaaaaatggtttgagaaaatcgcgcaaaaaaaaaaccattgtttataaaaaaacaagccgctcattaaaataaaaacattgtcattcacatgattatgcatgaaaaacgtatattattattagattttttttacccgttgcaacgcgcgggcatttttgctagtatatatatatatatatatatatatatatatatatatatatatatatatatatccttatatggtactagtattaatatatatacttatatggtactagtattaattaatttcttgcactgcaaacatgcatgtgcattcgatcatgcacgtgtacgtagaacaagcggactccacgatgtcggtgttagctgggttactagctcaagatcaggatggtgatgatcaagaggttactagtcatgcagcagctgcctccacgcagggggacgcgaacttcaccggcggcctcgacggcgtcgatgatgcagccagcctttgggtgcagccgaaggcgaagaaccctcttgttgatgaccccgacttgataaaataaaaaccccgggggccctttttttggncctgggaacgacccctccctcaaacttaaccggtacgtacagctacggatgtttctcctcaccgtcattggtgatccgcgcagacagcatcattatatttttttatataatagcatatatgttttcgtagtatattattaaaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagt

SEQ ID NO: 71744 - DNA, 3391 bp, Oryza sativa
ctcaacaaccaggagtaaagatatccttactctcggttgttctcatcaaccgggactaaagatattttcccgttatttccaaattctttttaaacccggttagggttaagaaccgggactactgataagcgcactgaatattaatttccattacatatgtgtttctaaaatagaaaataatgcattaaaattatttaaagtacaaaaattaatgacaattacttcgaaaatttattgttgtctgtaataaattaagtggatgaaacgtaataagcaaacatatgatttaaaattaataaaaattctaataatcatatatacttagcatatgaatgatattaaattgttaaaaactctaattaacatatgtatatacatacggcatgatttaaaattaataaaaattgtaataatcatatataattagcatatacatgatttaaaattgtaaaaacctctaataatcgtgcgtaattaacatatgccatacaacaatttgatttatatggataatcactacatccaaaatagtttacatcgtatacacaataattacggcaatacatcggcggtgacggttgaccgcacatactttctcctcactattgttccctccttgtgatcgctacgtgagtaaggggtgtcttcatttgataggaggatgctagggtcaatcgtcaccatgaaagggggttgcccatccaactgatcgtaatcctcatcagtcttgtcctcaaccccgacgatttttcttttgcctgggagaaccacgtgacgcttaggctcgtcaggccctctgcccttctttcctttgctcgacatgtccttcacgtaaaagacttgcgttacatcattggcaaggacaaaagattcgtccgagtatccaaccttgttaaggtcaaccgttgtcatcccactgtcatcaatcattacgcctccacttgtcaacctaacccattggcaccggaacagagggaccttgagaggaccatagtcaagttcccatatgtcctcgatggcaccgtaatacgtgccagttgttctatcgtgtgccatggcatcgacacgaacagcactgttttggttcgtgctcttcatgtcttgggctctcgtgtagaatgtgtacccattgatctcatatccctggaatgtcgcgatcgacccagacggtcccctcgccaataaggcaagttgttggttgatcgactcgttacccatgagatgttgtcgtacccacgctgggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtgtaccgtcattattgctttccttccgagagttccctttccccgtagtctcccttcatggcgtgattcaggtaccccgattgggcgaaggtcttcaataaattctacgcaaaattcaatgacctcctctgttccataacccttggcgatgcttgcctctggacgagcatggttacgaacatacttcttcagaacgcccatgtacctctcgaaaggaaacatgttgtgtaggtacataggcccgagaatactgatctctttgacaaggtgacaaagcagatgcgtcattatattgaaaaatgaaggtggaaatatcaactcaaaactgacgagacattacaccacatcattctgaagggcttctaatctatccggatcgatgaccttctacaaaattgcgttcatgaatgcacatagctttgtaattgttgcccagacattgtctggatggataccccttattacaactggtagcagttgtgtcatcaacacgtgacagttatgagactttaggtttgtgaacttcttctccttcgtgcttattattcgcttgatattcgtggagtatccagacggtacctttatgctctccaagcattcaaatatactttccttctctgccttgctaagagtgtagctagctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcatgaccatcttcgctctctataggctggcttccaggcccctttccgaacactactttaagatctttaaccatagcaaacactgttttcccgctgcgatgtttaggctttgtacggtggtcagccttatgttcgaagtgcttgcctttcttccacaccgggtggtttgctgcaaggaatcgacgaggactgtcatgtcccaaaacgactctaaaatatatcccttaaatgatgcctagaataattaaaatccgtgtgaaagcctccaacaattaaaatgtgcaaagttaaaagccaaataaggcttagaggatttttgtaaatttcctaaaagtctaaaatgcgtaaataaattttagtggaattttcagagcacaaataataattattaagaaataaacaaagttaaaatgattttataaaaagaaaaaccctagaagtcccccttccctcccttgggccggcccggcccatctctccttccccccctctctctctctcctctccccgcggcccactcggcctctccccgcgcgcgcgccgctgacgggcgggcccgcccgccaccctcgctgacgggtggggcccacccgtcatccccttcctcccgcagctcccgccggcttccccgcgccctagcgccgccgccgccgccgcgaatcccgctgcctcccgccgtccccgcgtgcaataaaatggggggaatcactccacgtaatcccctctccctttccccctatttttccctctctctctctcgcgttcaaacgggcggattcgcaaatctcgccggcgccattgatggcggccggacctcccgcgccggtttccttcccctccggccgctctctcccccttccaaccctatttaaaccctccccgcgcctccctcgcccgtttccgccccttgccgcaccgtctccccgcctgaatcgagctcgcgtcgtcgccctctctctcctccgtcgccgacgacctccggccggccttctccgctcgccgggaccgtcgtccgccccggcgtcgcctcctccggcttagccgcaccgccgtcgaccccgtccaccccctcgccgagtccgccgaccgccggaacgccgtcgaccccgtcgacccgag

SEQ ID NO: 71745 - DNA, 2079 bp, Oryza sativa
ttgctcctttcagactatttaattaccaaagaaaagttgttgagtcaatatgataaattaatagagctgttgaaattagttggttgattggaaattcaggcatttgactacggatacctggtgtgtatgtacgcaagaaccagagaacataagatccattcggagtagaaatttaacgcgacaaagaaggtggacactacgtactaattgcttaatttggaaggtttcaactttcaacaagcgtcgatatcatattaatttcacgccgtggactcatagaattacatttattttgggattaggggtagtactattgttctccataacgcaggaagacgccatatcgaagtaaggtgcaaaatgaaggaaaacagaaaaccaagtcaagcatttactactacgactgctatcagcctcatcgatcgtttgcactaatatagaatcagctattgccaaaatttagattgtaaaattgaatttttgagttggttttatgatattttcaatgtaggtttatatatttttagaattggattttaagtcgctaggaacaaacaactaaaagttttagaattgatttttttcaatggaggttttatgatattttaaggcacgcacgaatccggcagaggaggtggcgcaggcgagggagcacgtggaagaggaggcggcacgggcgagagaggtaggggaggggaggcgaggcgatgcggaagcggaagggcacccgatattttcccctctcatcgggcgcccgagtcaaaggattttcgctttttatctagtggttgactgacaaccagcatgtttcgcagaataaatacgaagaaaacttaagtatggcaactaaacatatcatgatatacacaatacaatgttctttatacagaagtgaactttttttttcttggggagtgggggttggtctcctttattttcatcgagtgaaaaatatatgcgcatgcacatcacgcttatacacatgtgagagtacatgatatttgacacatacttttgaagtagacgtcctactataaatctataaaccttatataaccataaatttataaaccccaataaagtcatttaagtatccatatgcacacaattgtggttcctgagatttaaatctgatgcaaaggctgggatttatatcccattattcttttttaaaaataaaccttaatggatagagtttatgtcctaagactctaccaacccacacctacttccttggccgatagagagactttgttcctagctctgctcaaattcctagcaacaaggagggtagtgtcccccatctggtcctcctaaaacgtaattccaaatcagattaagtcgtgcatgcgaaagaaaatgataggagtatgctcctcagtgaagagtttcactatattcaagtattattacagttgtgtcaaaagataaaagtattctggttttcgacaatatggggttggaactttggatctgattctctcatcaacggcctctccttccattgctaacaggaggatcgtgcccacctccagggtctgaaaaaataaatcccgagtcaaataaaaccatgtatttcgctttaaaaaaaatcatacatgaaatactcgaaattaaaccatatatttttttgctgacaaacaatctggatcctctcaatatatcaggactgaacttactcgcaggaactccaccagacagaaaccgaggagaccttattgccggtggcttcctacgagtctcccggccgccggccactagctcgccggagttgccgcctgagctgccggcggcgaacaccctgggcagaaacggcaacggaagcaagaggaacatcactaggattgcttgcaactcgacgcgaatccgagaagctcctcccatggtcgatcgctttggaaatattctttgagatgttttggctcccaatctgtgtgtctcggatgtccaaattacttgctcttaatttgcagggtatttataaatccacagagagtttggtggaattgggatgtgtacgtacgtgccaaacagaatagaacaagaagaaaaatattatgcagagcctatcgatctttt

SEQ ID NO: 71746 - DNA, 783 bp, Oryza sativa
gcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtgatcctcctccaaggagtttgttttgtttctttgctatctgaaagattccttttttttttttttgctttgttgaagtggaaggagctcattggtgtacctttgttgaaatggctccttttaatcctcattgtttcacatgtctgtttcattttcgtttttaaggggctggccttattaaaggttgtttaaaagcttaaacaagacttctgtttgattgatctttagtccctattttacctaccaggtgaattgtcgcctcgggtaagatattgctaacagggaattaactctatttcattgccttgtaattaacttgttatactaaatcagaagattctccggaggaggggatcaggggagaagaaaccaaagaaatggcagcaaccctcttttttccggaggcgatacattgatactacttcgatagtagtagcggtagtagtcgtcgtctatatggatatagaacgctacagagttcactactgctttagctattgatactacttcaatagtagtagcagtagtaatattttggaactaaacaaggtcatatatatata

SEQ ID NO: 71747 - DNA, 866 bp, Oryza sativa
tgctagaaagtcttataatatgaaacggaggaagtagcgtaagaataaaaattagaaattatacaactctaaatttgtcatcatctcaaatacattactaacatacattatatttcaccttcaatatagcatcagcttaaaagcttaaaagcttttgaccttaggaacattctcgtcttttcaaagaatttctctctccaaccgagttgaaattgcccttcagcaaattaccagttttttatacatttttacgatgtctaccaacaaactacacaaattttgagtgttctgtagcaaattttgccaagtaagacatacggatgcatatataacagaagtttatttttcccctctatccagcttatatataaaaaaaacataaaaaaattaataatctaccactacatatttaaaagagtaaaatccatcaccggtccctaaacttataccgctgtgtcatcccggtccctaaacttgcagatcactcgtttaggtccttcaatttgttcagttgtatcaccctggtccctaaacaggacggtctaaaaactttatatcaaaaaataattcataattttttcatgtgaactctaatgaagacaaattttatatcaaaattgtagccctcgacgcgacctacaactttgtagttgaaaagtttttgaattaaaactgtttagggtcccataatattgttgcatgtttatagattttgaaattttaattttaaaattacattttgggacaaaaaatgacttaaaataaaaacaaattcaactacaaagttgtagatcgcgttgagggctacaagtttgatataaagtttgtcttcattagagaacacatgaaaaagttataaattattt

SEQ ID NO: 71748 - DNA, 29669 bp, Oryza sativa
ctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcagcccgaggccggagagatcactcccgcgccgtcggcctctcgtcactgcgccccgtcccgcacggtagtgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcgtagttccacccaatccgacgctagcgtcgagttcccgaagccgcgtagatgctctcaccgccgggaatcgacctctcgtgacctcgtcgccgtttccctcttctcccgccgccggttgccgccgccgcaatccgccgccgtcgagcaacctccggcgaatccgagccgatggcttgccttcccttgtcacgtgcaaccgcccggtgtgctcgctgttgcccgtatcgccgtggttcgctccgccgctcgccgccaccgcccgccgtccattcgaggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccgtccccgcccacgcgcgtgcgtcgcatgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccggaccgctccatttctcttgggccgcgccctagctgtccaagaaaagtctatatttcctccctcccttcttttctttttcttttccaaaaaggatttaattaaatcctttacctttagatcaaaaattcaataatcttagaaattcaatatcttcccaaccgtaaatccgtttgactccgttcaacttctaaaattccccaaatctcgagatctatcttatggcacgcatagaggtcgttaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgcaaaatattatgcattggtaggatcgcacttaatctgtttgtcccgtctgcaaggcagattggcggacctacctaatttgtcgcatttgatccttcctttgttaattgctataccatgtccccttgtaaccacccagttgcgcctcgatactcgcgcactctgtgcgagtatcgacggtcgccttcaaatttaaaatctgagtaacaacttgggtaaaactggagttttacaaaagacttggaaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaaggacgaccacacgggtggaatgggacacccctggctgagtaactagcttatcaggggagccttgatgccgagagacatgtggattcgccggggtggtgtcggggaggacccctgggcttcctggcacagtatggtctgggacctaatctgttgttggtctgggacccctctcgtcggcatatggtaaacctgtgtcggctttcgaaatgccttgtcatgaaagcttggaggtctcctgacgtggctgatccccacgggctgggtgacccgggttagtaatgtcgtgtgggtaaagtgtacccccccctctgcagaggtcattgaactgttcgaacagccgtgcccacggtcaagggcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggtggccgtttgaaaagctgttggccgggtgccaaccttgttgcaatcctaaagactgatacattgcacatactccgaccggacgagacgcactgtcccatccgtgttgtttgagaagcactcacctagtcgttttagaaaaagagttcaaataaaaccaattgcaaaaacaacagccttcccttgaagcctgcattaaacacttatttcccctggcttgctgagtactcccgtactcacccttgctctatataaatatcccccccagttgctgaagaagatgaagcggatcctgctgatgaggagttcttccaggagcaagccggctacgatgagttttagggtttcggcctagttcccaagtcgcgcctgtgatgaatggtccaagtcctggcttccgttttccttttgtaatgcagttgtgagctcgggatctgtccgcagcccaacatgactgtactcctactctataataaagagacctctgttgctgtgatattctgtctccctgtgataccagcactgtttcctgggactggtatcgattaacaggttaaattggagcgtcacgggctagtcccggtcgggactagttcggggcgtgacaaagtttgaggacctgaacggtcgatttgcgagtttagagaccgggatgacacaacggtacaagtttagggaccggtgatggactttactctatttaaaacataaatgcgcgcgtttatagaatctgcggagggactgcacgcaacatacacagtgtgtgatttgtatgtagccatgtacctagctagcaacattttgaaacggagaaagtagtagaagcttgtttatattaattaacttaattaattaataattaaggcccgcttccactatgatcatgaactagctgagcagtggatcgacgacgcaaacgcatcaatttaaaggagtatatagtctgggggtgcccaggcccgtcgtccaactaactgagatgtgatgtgaattactgtactaacactggtgttaatttgtcagtttatcgatcgattgatcgatcgggccgggccacccgatcgatagatcctataatatttagctattgcatgcaacaagtcatcgatatatgaaacaaattataaatgtccgatatttgttcataaattaagtgccactgccatgccaacacactaacatatatagctagatctatcgaggtagctagagaagctgatcgtgatatcgagagctaattaagctagctgaaccaatcaatggaaggcctcgccggccatggcgacctcccgacagccgccgccggcggcggcatgctggcagttgatctccttggcccagctgcaggtattgtatacactctagctagctataacatgtctgttggtgtcatagtatactaattatatttagatcatggtgttataatatatgaataagtagtttcgctataaattttatcaaaagtcgtcggtacggtgtcgacaccggtcattacactgtagatccgtcttgggcatgactacgtaatactctctccacctaaaaaaaagaaaatcaactttctgagaatgaatttggatagacgacaataatttatccatattcatttttaacagttgatttttttttggagaaagtaaaatcgttcattttagaacggaaggactacgttacttaatgtgtgatctatatatcgcatgcacgcagatgcaggaacagtaacagaggagggctacttcgtcttcgtgcagcagctggtagtgcgcatcaccggcggcggcgccgccgccgccgccggcatttcgttgccaacgtcgtcgtcaatgcaggaagaagcatctgcagtagtagacgttacaattgatggattagcatcagctactacccacggcaatgccattgttgccgacgacgacgcgggcgatgacgggaatgtgcgtcgtccgccatcgtcgtcgtcgagaggaggaggaggaggaggaggaggaacaataaggacatcaagatcaagaagaagaagaaggagatcggtggtatgggagcacatggaggtggatccgtcggggaacgaggcgtcatgcaggtactgcaccaagacgctgtcggctaattccagaggcggcacgtctcatctcaggaggcacgtcaaccgatgtgccctgcgacaattggcacgtgcgttggacatatgatgaagaagaagaacataggtgcatcagtgcatgatgatcgatcgtgttccctttcaatgctgtctatatataattccacccattcacaaattaaacacacagaagtttaaggttaatgtgaagttattactttgatgctatttgtagagtttaaggaattaaagatcacgtctagtgatataactgctattagctagtattaagaacagttagcagactataaaccaattataaccaaatattgaggagataaataaaaagagataagagcagcgagctacagatttgtaaccagctacagcacatactacaagaagcaatgtgtgtatgacagtcaggggcgaaggcaagcctagggcaactagggcttgatccctaggcttgcctccaaaatcatgtataaattatgttaaatcaccaagtaattttagagaaaaatcaacaacttattagttgagcccaaggttagccctactattcagtaatttctagctccgccactgatgacaggtgagaccaagtattacttgtgtattatatatgtttataggtaactattgtataaattagctactaaattaacgatttggagctaatggttcactatactattaaactttctctaataagtaataaatatatatagtgatgatcagctagatagactaaaagtactctaaaaccgattatacttatatataaatttgaagttaaaattgttcgtttatatttacggaccgagagagtagcgataagagtactgcataatttgaaagtgatcgatcgaacaagcgatatatagcatacgtacggagcacgtacgtaatgcatgcttcagttcttttttcatgcacatatatataggttactactaattaattaggtgctcctatatgttggggttttgttcattattgtatgtgtgctagcttgcgtgtttgtgatgcatggtgacgatatatattaattgctgcggatatattgtactccagtactcatgctatatatatattcgatcaaatgaaacaaaagtcagctaaaatttctgttgatgttgaagtcgatacgatgggtcgaattcgatccaagatgagctttttgggtgccgatcgatggtgcaggtcaccagcatatatgtcgtcctgaacctcacgtggcggcgaaactgcaccatccgctgcctttttttttttttccggtgccaaaggcgcagaagtactacttatatagtgtgtgtgtgagatatataggagaaatatatagccctcaacgattccaaaccgtataaaaaaagaccccaaggcattatggacaaatttaaccctggtttcattgacatgcactactggagaagtgatctttgatgggtgatgtaaaaaccacattagtcccggtttggatagggaccgggactaaaaagacacgacgtatttaatgcctcgcacttatcctctagcaaactcctccttagcacaaactcctcatcccttatcctccttgtcattttaacttcttcctcccttttcttatcctgtctctcttatcttctccttttgttgcagcgagcaagccggccgagggctgtgcggcggcctatgccgcggcgggcagcgcggatgtctgtggatttgttgacttatacatgatgtatgtggatctgtaaatttgtgatgtaaatctgtgaatttgtggatgattttctaatgtttttgttaatgtggatgattttgtttttgagtacgttcaatttgaaatcaatatgcaaacagtaaaaaaaacaatgataaaaaaaaacctctaataccggttggtatccttagtcccgattattttacccagaactaaatatacccatcttcaaccctggatttggggttccggtttgaaactcgggactaaaggggttgtaaaccggggctacaaagggtttccccagtagtgatggcatacaacgggccccacatgtcagtgtgccgttgaggcgttattacatggagtcatcatcatctctctcgctgggctggcgacgccgcggcggaggtggattcgccgctgctgttcctcaacggcgcacaacatcatgacaccgtggttcccgttcaagcagtccagcatcaggcccgccttcgacgtggccaccggcgagcacaaggtcgatcgtcaggcccttcaagaaaccgagcggcgaggcgagctacgagctgaggtgtacatgcgaggggggagcagatggttggcacgcgccggccaagtgatgctgcgcgtcgccagcttcctcgtcggcttgccggctagcttgccgccggtgtcccggcctcgacagatttctttaggtcttgttcggttacacccgaatgcaatccggactgggaatgacaaatatagtaagaaacttatgataatacaatgagaggccgggatttattcagggctggtaaccaatttacttatgatagggacaataagagaccggaatcgatccatgtaacatcctgaaaattcctgacaataaaaattgctaaaattttgaactttttaaaacttttgcatcatgctggatgttatggttgttattacttgccaaactgtaaatcgtctcaatagaaaaatcaaattaaaagatgcacatctaagtaataactaaagtttacgacaatatattgttaaccctataagtatttatgcacaagaacacaagccaaataaaacacaagtcaattattaatttctataatgtaaattacaaattgtatgttaaatacttgaaccatgtcgacaagtgtcatgacatctaagtaaccacgaaatagtcgccactacaatgattctatatatataggagtgttgcactggaataactagattaatatttataatgttcatcaagtctctcaggggataaattcactcatgtaaaataatttgtcatgtaaataaattgagttctatgtataaaaagagcttatgggagtattcgattcaatgtttaagaccaatattgcaccaaatctcataatacctttatagaataaaacttaaataaattaaacatatgtatgtaaaatatattgctatacaaataaattcgaccaatatgccattgtattagtagggacaagttggaatatttaattcaatcatattctataagtctccaaaatatataagttcaccttgagtcaaaatccaagttaatcaaaacaattcaattgtgagaaatacataaatattcaaatcaaacatttgaattctcaaagcccaaaatgtatagattatatttcaattcaattccaatcccattcacttttgcagtttagcccctccctcttcctctttttccttttcttccttctctctctttttctgtctgtcactgttcatgggccatcatctattcgatccggtcccatgaccgcgcccgcgtcctacccgcatgccgcacgccgcgcctcccttccctcacgtcgcatccatccgcttccaggccgtgcgccgcttgtgggccatgcgccgcatccctccgcatccgcgctcgcgcccggacgccgcgcacgcgatcgaccgcgccacctccgcatctcgcgtcgcccccgtgcaccgcatcgtgccgcgccctaactccgtgtcgcgccaagtccgtccttccgccgcgaatcccggcatccgtcagcgccacgctaggtgggcccgcgactcgaccccggtcaagccgccatctccttcagccgtcactccaagagatgaggaacgaagccgattggataagcgcgtcgccattgccacgtccgccaaattatccagacgcatgacgtcccgtcgcccctccatgcacccgctggacaaaacgatgcgcaccctctcaagctagcgccgaggttcacaggctaggagctgtagggtgatgattaagccacagagacttaatggagaagaggatggaaaccttagggcacccacaatggttatctataggctctctacaagagatccatgtcagcatattttcctacttggaagagattaaatgaagagagagagtaaagctatctactaacctggagatagtctatagagaaaaacgaggcaatgcattagagagctatagatacccatgtagacataccattaaagtggtttactattaatctagtctattgctgagatgtacatgttttatagatagcaccttactttaccattgcgggtgctcttagccgcgtcaacctccctaacctaggccgtagacagccatcgagtgcgcctgtcatcgacctcatcctccacgccatcctggcttatccccaagccaagcccccataaaaaccccaatcccctctgcctctccctcggatacacatttcgtcgaacacctagcatgcgtgccggcatcgtcttctctactccaccaccgtgatatcaagcatcgccattctgcattctcttggtaattcctcgctcctgagctcctattaatcccctaggaactaacttccccatcaatgtcgccgatcatggccataaccatgccgagtccgagctccaaagctccacccatggaggtcaccgtggacatgctatcccgggggatctcccttctattttactggaaaaacggaaccctcatgcgccatagatgctcacgccctcaccaatatggtcgcaaaccatcccgttcgccgtagctgcttgcagccgagctcggccatggcgttgccgtgccgcaacgctcgcccctgctccgccatgcaccgccgccgccggtggagggctgctagagctcctccgcaaacccccctgtccgccgccgtgccgccccggccccgtgcccgtcgcgcccagccgtgtcctggtgctgcctcccaatggctggaggtagaagacgacgggaggaagaaagaacgacagaagagagagagaaaccgtgtgggacccacatgtgattagcgcacagtaatcctatccctaacggtgattagcccactcaatggcaggtggggtccctatagttaaaatataagaaaacacaattatatattttgttcctatgacaggcgggacccactggtaattaaacaagcaggtttgaccctaagtcaaccagggccggtcccacatgtcaaccacagtgggttttggataatgtttccgattaaagataaatcatttatgaacagtacatttttacaatttctcggattaactcaaatttgaatctttaaactagcataacttattcattttagctccgatttgagtgaaacttgaacctaaattcgtctaaattcataatcttcccaatggtatataactcactatttaataaaatatatttataattattaaataataaatatcaaatgattagataatgattaaactaaaaatgtgctagcaaataaaaattatcattgtacagtgaactaggtagaggaatatttgttgttaacatgttctgtcactatgggaaccatgtgtagctatatgtattagttcagtttaaagcaaagataggagatattagtatcatttactattccatgattatatatagtcaagttcatgattcagtcattgtctaaatagaggattaacttaatgagtttataactgaaaatctaagtacacacataacagtccttagtttgtctatgaggtataatgacagagctgggtgtgatggaatcaatcgaatgatagatttaaccggtgcaatatcctatatatatatatatatatatatatatatatatatatataatttggttgacacctattatttaacagaacaacaaataactcatgttcggtaaataatccaattaacatattattgaacttgcatgtacagtacatccatttaacacatacacagtaagtcaatcacctactgttgcacctattaaactatgaattgtttgataaacatcaaagttagataaaacactaattataaatcttgacctcgttacgagaccacacagacaaataatctgtacctatgacctcaccgatctaacatatagagcgtgtatgattattaacccttttataatttataatgacaagtaaaatatgatcgtaattaaaataatgccccattggtaaaataataatataaatgattccctgtgattgcttgttgatcctaattaaattaatccatccaacaacagaacctttagtataagaccatttatctgaatagatgcatgcgtagtcatataaccctcccataaccctgtaggtagactaaaccacatattagcaaaatgtgtatatcatatattgtgctagttagtaccagtagagccataatgattatataaaatactaagaaaccttagcccataagctttcttgtctcatcagcttcttatctcatcagctacttgcatgctatgtaatttagagcctaagctacctccattttccttacctatataaacagtgcagccatagtagagacttcgtagcaccttacaatccattagcaaacacagtaatgtgagcagccgtaggttcaaccccaacatttatattttgtttgtgcatatgtgactgttgtttgaacattgatttttctcgcgtattatagtattggtgtatcgattagtcgtgaggcaacgtatgcagcttccaggaggtgaaggttgatcaagattatatcaagaataagaactatcctgagcaggcaagtcatcaccccattccttgagcatgttgatcccaattatgaaattgttttgtttataaataaaattgcatgtagtgataaatgtcctacttgttattatgccatgcctttgattattggttatctaattattcccttgtacccataattacgtatgagtccctagtcacttatgacaaatgcttagtactgctaatttagatctatgcattctcatatttatcaaatgctttatgtttgggtaactaccttggggaaggtagttgagatacggcatgtggagatatgagcgccacattgccatgacattgatgagatgatttgtgaaagaaagttaaaactaaagaaatgttttcgactggggcggctggaggacttgggtggtgtccggtaaaggctagtgccgtccctggtcaattaaggaccgagccatgaagctaagcatgaaacgactccagtacaaccgtacttctcgtatgggtatagacctagcggagtaaatagccgagcggaggcagtatctctgcatagtggttttcttgatgtgtgtgaggcagggcctacggtggggcagccattggtaggaccgcgaggggcgggtgcctacagtggtgtcgccatcggtaggactgccatgtgtaaacctaaacttaactataacttaatgcatgtgtgagtcttcccttcccgggagcgccagaactcctctcactgctagaaaccgtgtacgcctagagtgcatgaggactcaagttcatggagcgggtactgccaaagtgaggttattgaaaggctttgccatggcaagtctcatccgttgggacgtaggctcatgtgttgggcaagtcgcggagtaagggtaaagtgtacatccactgcagtgtgagtaaaccaaatctattcgaatagccgtgctcgcggttattgagcaccgggacatgtattacacttggctagactctaaattcttaaaatgatgggtgggatgttgcatgatgattttgtactggtggatcaacttctcgagaggcgagaaggggtagaccctagaaaaccatgacgaccagtggcgggaagctatccttgggaacacaatggatggtggacagaaccgtcgctgtttaatgaacaatggaattaaaacttgaccagtttatgctaggtcttaggtttgtgaaatgatatttgaaaactcagctttacgcaaagtaaccatagccactccttgtattatcctgtacattactgcattttgtgtggtggcttgctgagtacttttgtactcattgttgctctatatatattttttagcagagtgttgaagagaagccattgttagtacgcttgcgtacttaacaagatgatcggagtgcgattccattctagatctcgttccccagtcgactgcttgtggcatgtcaaccgggcccttgtattattttgtcttccgctgttgttctctgatagttgttggcctgcctggccctaatgtaagcatttaactctcttagcctgaattcattcgtgatatgttgtgattcggctatgtatgtgtgtaccaactactgatccagggattggtactgataaacacagaagatttccgatttccaaaatcgggggtcgacaatccactagtcaagaggtgtggaaccaatccgaatgttttgttgtccttatcatgagtaaattggtttccggtctggaataaatcctggtctcttattatatatattataaatttcttactgtgcttgtcattctcggtccggattaaatccggacgtaaccgaacaaggccttactggttgcgcagctcgctcagctacacggaggtggtggggagcccatcctgtcgttcaacgtcatgccagcacaagtgttacaaataatcttgtgtcgatctgctttgtgtttcgtttttctggtagtttttgaccagctacgcatctggctttgctcaaaattaattatgtctttccatcatatggttcaccggttgtatatcgatctccatattgcagtccactacaatacaatacatggaaggaaacgaatacaaattaatatgattgatgaaatgatatataatactgtgtaatggagtaatagtactgatacataatgtaactcagtaacttctacatatttacatatattaatatagcgcagtgggagcctctcctgctctttaaatatcaaaaaaaattagagtaatactgaatttctttttattaggtacctagagacagtgaggacgacgtacgattatcgagctgattatgatggggatggaccaagtgtaaaccaatcggtgactaggagtagcccacggtgtgtttgcgaggacatggacacatgaatactacatgctgtatgcatgcgggggtgaccgttgacccagagtttttatttctctctttttttttagaacgaccggacattgtcaatgttgggccgccggcagcctcagccggttgatcaaatttagcccagcccatctaacaaaaatggcccgaagccatatctataattactacttactactctatccatctttaaaaatatagtagcacttataaatttaatagttcggccccttctcgctgcttggagtttgtgtttagctgtcgtagttttttaagcttcagcttcttagtttgctttttctcccttctcctggcataaaccggtctgtctgatcgcgttgcgtaactataactcttttcttctaatatattgacgtgcaatccttttgcacattcgcggaaaaaaaacttataaatttaatagtagaaaacaatttctcaaccagtggtgacgtgacaagaggcagctatggcaggacagcactatcatgctagctacacgtgacgtgatagagttatttggccacgccaggcgaactggtgtggccaaaaggtttagatttgaaagtacttttgaaaatggtctattaataaaattaaaacataaaaaagtcaaaaaaaaatctttcatctcttatccctagctcggctcttttagaaccaattccatctttctactgacagctgtgaagtccaaagtagtacatgttgtaaaaccaacgtaagtccaaaggaatttaatttcctttttcgctccaatgggaaatgtttggtctacgaattatactagctgccctgctttcgctactctttgggctaaagagtccgaaggtggataaaatttcttagtttcaacaagtaaaattggaataattaagttgcttttctttcattaaaaaaaactgttcaaaaacatccccttttaccatatggatgaccaataacaaatccacctgtatggtatgcctgggctcatggtcatgaaccgtgtaaagccccaggtccaaaatggttataggtcaactcaatttgcagagaaaatcctttctataccaatgaaattatagctaattctttttatgtttatgaattttgcttactttcttgtatatctaaaaatgattttgatcccttccatgcttctccgttgaccattagtatcagtggttctccccggcgtcgatcgggaatgaagacgtcgatgtaaaattagggtgcgcacggcgtgcagcacaaacagtagggtgggtgtaattttcgtcggattgatatgggaaaaatctaatccatatatatagcaaactagcaacgtctaaaaaaaatcgcatgttttagaggataaaacattcaaatgatgtttggacagtaaaaagagaagaataagactaatataacaacaactgagaagaaaataaaatcagccaaaaaaaatcaaatcatctcgtaaaataaaataaaagaaaagaaaagaaagagagcaaatgatccattaaacaacgacgcaccgtggagtgatgtccaagaggtaatagcctctcctgcgtcgtcgacctccagacggctagctcctccccggccgccgttgagcttggaggtaccgcatgcagctagctttcctgacggccggcgccgctggtcaccggcgcacggcagctgcatgcgcctgcgacaaaggccaacagatatctctcagttcaccacccgctggacgtaattaagggaggcatctctcagtagggcgaggatcagatctctcagtgcattatcgccattagcagtagagaaattaaggggggaagagataccttaacgacgaaggaagaattagctagctgcttcttatatatctccgctggtggagactcaatccacacacggctcccgtgtagttctcacttacaaagcaatcatattaattaagcgagagagagggtttgtacgtaactatccataaggtgtagattggtttaaccaaactactccatggttaaacccgactagctctttgcgtcatttaaatgtgacgtcatgtctgaatttaaaatctctccggtcctctcacttttatcgtagttttatttatacctttcgcgcttgtctagctagatatgattttgtctgccttttcccatagcaacgcactggcactttgctagttagggggtgttctagatcccacccccaaaattttgcacccttttagatcgaacgtttaaacacctacataaagtattaaatataggctaaaaaaataactaattacacaaattacgactaatttgcgagatggatattttaagcctaattgctccatgatttgacaatgctgtgctacagtaaatatttgttaatgacggattaattaggcttaataaattcatatcgcaatttacaggtggattttataatttgttttgttattaggctacgttaaatacttcaaacgtatatccgatgtgacacggcaaaaatttttaccgctagctagctggatctaaacacagcgttaaccatataaaattccacaaaactcctaccccccccccccccccccgcgttctactaatcgcagtcgcatccaaaggtttgaaacccctcgcgccaaatgcgaaaaaggcaccccgcatatccccacgtgcgctttctcctcctctccgcttgagccctagctcctccctgagctccctcccccgcgcgaattgaaaaccctagctccgatctctctcatccacttcgacgcggaggccaacgatcgtaagcagcttggtgagcaggggctagctagctacgacgagcagcctctggatgtacgagagcgcgcgcgtggtctcagatcgtcgactgagggcctcgatcgtgatggctagggcgccgcgcggtagcgaaggcgagggcggcggcgaactgggagcgcctggtgcgtgcggtgctgcggggagagcggttggcaggaggcgcgccgccgggaatgcgccgccgtctctcaacagcaacgtccacatcgacgaggcgcttcccgccgccgacgagaaccagctggacgaggaccctaccgtcgccaggattcgtaagtttcgtcaccatttttcgctccgttaggctattgacctgctgtatggccgggtcgccgcggctcaggattgccctacccatgaagttattagtggtgtttttcctagtattttatgcagttagtatcggctacacgaattgactatgctagttcattaggagtacttttgcttttttttttcttacagccttctgtactactaaatttagtcaacagttacatgatcaggctaataatatctttcgtaacacactcataaataatatttatgataatttatttttagatatgagataaaaataaaatttatttattacttattaaaaattatttatttaccatataaatagatttatcttaaaaatattatttttttgttatatctaaaaataaatttgtcatacataaaattttgttttgccttcgcgggggcggaaataaaatattatttttgttaaataatatatcacaaaataaactacatcagtatacttaataaatttatatttttcttgatatcaaaggacaaaatggattttacgataggaatttaacggtcatctaacgaaagaggtatagaagggatgcaaactgaaatttaggggtatgaaaaggaataaacaaatctcaggaatataaaaaggattgggtgaactttcaaggtacacatggaattttctcaataaaatttgattataccactcactaacaatctggaccactagttaatgaccaaattgccgactgggtggggcccatgaggtaaattaattatgttggggaaaaggggagaagagaggaggaagaaagttttggccttggtccatttttatttcttattctggcccggctaaatcctagtgggtggtatccaggcacataggccttctggcctgccggctacatgttccttttgtttattttcaaattcgtgtgtgtataatttttttttaaagtttacttatgcatccaaggtttatacaccaacagttatgtgtcttatttgtatttggatttgaatttcaaattattatacataatgttgttgctatattaaaagtttctatacaaattaagtgtttgtgtataaacttttatgtactattaatgtttgtttatattttttagtgaaagttttaaacagattttttaattgggctgaattggtgtatgcatgtaggctaaggacccgtgtacactggctgaaacttactagcttcaatagcttcaatcaacttttagctaatgttgatgcgcctgttttagacaagctagtggccataactcgagcttgaatcatccaatcagttatccattttaattacaagtgagtgtgcgtggatcttaatttaaccctaagtttactcccaggatccacctaagaaagagtcagtagctagaatttattattgtgccatggagttacaaaaactaatgtgtaactttaattagtgagtgagaagagaggaaagacgtgagccacatacaaagcgaacacaagtactgaccaaatccaagacggttagacagagcactcgtgaatatcgagtactaataaaccaacaaatagttaagcaaattaattaagtctcatcgccgatgacaaaagatcgtcgatcgatcgggtcgggtgccccgcccctgagcttagctagctagctcgattaattgaagcttgcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttacaaaccgggactaaagatcatctttagtcccggttcgaatgctgtcggggcctgtcaggcccccccaggatctttagccccggttggtaactttagaaaagatacgagaggctgcgcgacgactaacaaatgcagtggaagcctcctctcagggcacgttccgaccagacagagatagggacgagctgacactcgccctgcagactccaaagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgaacccgtcaggaaaccgtagcagctgcgcctcaacggggcaggtaggatcccagagcatggacgccatgcaaacacaggacgaaatacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaaatccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccattggtgaccggtaaagaaatgacgatagaataatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcatttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgactaatatccacaagaaacagaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtctatgactcaatggataaaaaagagtctacgtttgacaaggttttcgaacttatagacaggtaccgtcataagttcctttgttaattaagaaaatcttgttatgttaattgctactacgaatcatagctttagactccatgtagggcttggtatcggttccgtcatttggtccgcggcaaatggagagaaagacttaggcggaagttcaaatttcctgtgagtacacatgctctacatttatatttctccgattcaaatacacatacaagtgtatattaattagatctctcgttgtttgtcatttatttgtagtgcgcaaagcaaaagcagggaactaacttgtgcggctattacatgtgtgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatatatctactacttaaaaaataagaggtgcttccatcgtccgtcaaaaaaaccgtgtaaaaaaaccgggcagaaaaaaccaggtttatccgataaaaaaaccggaacggaaaaagaagtccgatccagaaaaaaaaaagggggcgaaaaaaaccaaaaagcaaaacggacggagtccgatccaggaaaaaaaaaggcaaaaaaaaaccaaaaaaaaccggacagagtccgatccaaaaaaaagccgaaaaaaccgacaaaacaagggacggaaaaagccatgtttgtctgataaaaaaacaaaaaaaataagtctgactcctatatccttaacagtaaaaaaaaaaagttcgactcctatatcaaccaaaaaaaaatctgactcagattggtgaaataaattgatgtgccggattgaagatctgtttgcaaaaacggaatctacatgtcgagagcattccatttttatatgattttaatttttggatttgtaattttatatttgagtccctgtaatttttatatttgcatttgagtccctataattttgcaacaagctacttgaggttgtttttgttaaaaaaaataaaagagaaagagaacaaaggcagaaaggtgcataaaaagaaaaagaaaagccaaaaaaaagtctgactcagattggtgaaaaaaattgatgtgccggattgaagatcggtttgcaaaaacggaatctacatgtctgagagcatttcatttttatatgattttaatttttagatttgtacttttatatttgagtccctgtattttttatatttgtcgtatattctcctgtattagaaaaaaagcaaaaaagaaccttcgaaaaaaacaagcaaaaaaacgtgtgagaaaacaagaaaaaacacacgagaaaagaaaagcaaaaaaaggagaaaaatatggttttcttcgtaagtgaaaaaagcgaaaaaaaaaacatggtaggagaaaactgttagaaagaaatgcgccttttcaaaaaatggtttgagaaaatcgcgcaagaaaaaaaacattgtttataaaaaaacaagccgctcattaaaatagaaacattgtcattgacatgattatgcatgaaaaacgtatattattattagaatttttttacccgttgcaacgcacgggcatttttgctagtatatatatatatatatacttatatggtactagtattaatatatatacttatatggtactagtattaattaatttcttgcactgcaaacatgcatgtgcattcgatcatgcacgtgtacgtagaacaagcggactccacgatgtcggtgttagctgggttactagctcaagatcaggatggtgatgatcaagaggttactagtcatgcagcagctgcctccacgcagggggacgcgaacttcaccggcggcctcgacggcgtcgatgatgcagccagcctttgggtgcagccgaaggcgaagaaccctcttgttgatgaccccgacttgatacgctttgctgacgacctcctcaacttaaccggtacgtacagctacggatggttctcctcaccgtcattggtgatccgcgcagacagcatcattatatttttttatataatagcatatatgttttcgtagtatattattaaaatatattaaaataataatttattttctcatataatataatgagactctcccgctggcctagtatggatttcaccggtgcgtacaaacgagcttgctacgtactctctccgtcccaaaaaaaagataaactttaggttttcgtgtccaatgtttgactgtccgtcttatatgaattttttgtataattaatattttcattgttgttggatgataaaacatgattaatactttatgcgtgacttatctttttaattttttcataattttttcaaataagacggacggtcaaacgttgtatacggaaacccagggtttgtcttttttttttgggacggagggagtaatgaataagcatcatcattgtgaattgatgatgattatatatcacatgtgcgatgatgttgttactatacatgtgttaaaaaatatgatgtgcatcccctccatgcagcagctgccatcggcgccgccagtgtcgaatatgatgtgcatccaaacggaggccagggaagaagaaggtcaacaataagaagaagaagaagaagaagaagaagatcagtggtatggaaatacatgacattagatccgtcgggaaacgaggcatcgtgcacctactgcaccaagaagctgtcggctaattccaaaggcggcacaagtcatctcaggagacacgtcaacaaatgtgcgttgcgacgactgcaggcactcctcatggacatctgaacgcgtacgcaacgtctaccatggactgccgttgctgctaaattgatcgatcgatctcatgtttgttttcatgcatgcatgtatagctcagatcgatctgtagtactacttgtaattagcatatgcgtgctaaatttgtgttgtgtgtgcgtgtgctcgtttgtacgtgatacatcggtactgtactccttttttattcccctaattgattgtgctatgaaatactccctccatattttaatgtatggcgctgttgacttttcgaccaacgtttgaccatttattttattcaaaaattttatgcaaatatgaaaatatttatatcatacttaaagaacattggatgacgaatcaaatcacaataaaataaatgataattacatgaattttttgaataagacgaatggtcaaacgttggataaaaagttaacagcgtcatacattgaaatatggaggtagtaattatttattcacgcttgattaaataaagaaagaacatgtgtaatgtactccttttttattcccatattcgattgtgctatgaaataattatttattcatgtaatttccccctttttcttaaagcctgattgatcgagcatcatgttaagcgggatgaggcgtacgcgaaggttgctgatcgatgcaatatggctacacacacgcactttttttttttgactaaagggcttttagttgaaagccaaatggcaaggtccgctggggatcccagctacattgtcagcttacaaacaagcagcaggttaagcatgaaaaactttaaacatagaaagaggcagacacaaaagctaccagcaccaacatctaccacaaactgcccttagggcttgtttgggagagtttaatattctgagaagcagatagttggtagacagcttctgagaatctagaaaaaccgggtttctcagcttctggcttctagttcattttctggattttaaactacaacttcttagaacctagatcaaaagctggactgtttgggggagtttatgattctgggagaagctgtagcagttataacctcccccgaacaggcccttaacatcacagctaccaaaacacaggaaaacaacactatcaaagctagcccacgccagcccttggaggtgtcaaacttgtcaccagcatcctcaacttctctaccaacgcttccagcttgtgttcttcctcaggtcgaaacagtttcctccactgtaaaagattggaaatgatttgaaaaggaatagttagtggagaataaaccagattcgctctaagcaccatattattgtgagtgagccaaagattccaatagattgcagctaaaagactcaaagtgactctaaaagaagtatggtcagaaatccctttgcacaacaagaagaaatctttgaagtttccgggcaaggtaatccaattaagagcatcggcctacaaatacaccaaatcagcctcaccatgtcacaggtaaaaaggatatgattagttgattccagagctccacacagttgacagaattttgaaccctcccaaccttttttcttcagttgttcagcagcctgaaatcctatctctaaaagccaaccataaaaaatgtttaatattcatggacaaggacaagttcacaactcaatgttaacctccctaatccctctaaaggttaattaaggctctgtagagagatctagttgtatattttttgttaactgtcaaaccccataccaatttgtcactagagtccgagctctctatattctctatgacacgcacagattgggcggtcacggtcgcccgatgacagagtcaagttacagcccattgccacatcactgtatgatgcggcccagcccatcgatttcactggtatacgggccacactagccgataggctacgatatgagccttggcagccgagtacactctagagatgggattcttcgtgtgatgacgcataaagcgagtgtaactggattctcagccttcttcttcctcctctctccccatctcccctctcttcatctctctcctctctccaggcgccggggaggtgtcctgggcatgcggcggcggcggcggcgctgtctcggaaggggagcgcagatttggcgctgctgctactgcggtggtggcaggcgtcggctccggatccgcaagctccctgcctcgccggtgacctcctcctttggccacctccaccgccgctccgctcgcccctctgctttgccggcgacctgccgactccccgccccctccctccccaagcactcccgctgtcgctgccgtatcgccggccagacgacctccctagcccctggagagaggagaggggagagagaagtgaagagaggggtgaggggagatggggagaaaggaggaagaagaaggctgagagtgatatttttttaattaattcttttagtgcaactgacaagtggggtcactgtttttattaattttcaaatcaaattgccacgttagatgaaagccgggtcaatttagccacgtaggcgccacgtaagctaaaaccaccgtcttattcgccatggaacctatattgcaccggttttaacagttgagggacctgttgtatctggttgaaagacgaaaatcggattcgttgacaagataagggacctcagatgaacttgttcctagccatggctgcgaactggttgagaggccagtttacttgttagatcggtgggctgggccatatcatatggtggtgtggtgatgggcaatgaactaagagttttcgttttatgaaaactaaatcatttttttataaaagcaaaattattctggcaaagtcaaattaactaaattaagggacatgcacctcagcctaaggttttccgcaccaaacttaatttaccacacgtgtttgccatgcttctctattctgcttttttgatctatcgatcactcgacaaatatgttgtgtaggatcgaaacacaataactatttaagcctaccgcgggttgttcaatggtagaaacgcccagaaccaaaactttaagtggcactaaaagctaccctcaaaatccgatggagattggtctgatcgacctgattactccagcctgaccgcaccaatacctttggtctgaatagtgtagatgccctattccaactgcccttcactctactgtcgattgatgccattgctggtctaattggagtgaagccatcggtctgaccacgcagttgctgccggtctgagtactgctatctagttggtgtgaccaccaaacccaagcaaatacaaattgaagaattcttgaaagtagatcaaacttccttaccttaattcatgtttacaaaatgcaacaacaacacttttctctcaaaattcgactaaattcaaaaccctaacttttatctcaactcaactctcacaacccctcttgtatttatacctagaggtaagagcctaaagccacgaatccaacctatacaagtctatctaatccactaggaaaccttcatgtacaagtatccaacttatcttattataattcagactccaatcttcccaaatttggtctccttccaaattcgattttgccttttcatacgcacacactctccaatatcgtatgccgcatgaaatcttcaccaaccacgtaaattgttctttaggataagcatccctcatgtatcccgatcgtccagatgtcatcatatcccaagttgaccctcgattatcatcgacaacactctcccggggtatcaagacatacctacacatgaatcaaacaagaaaccatatccgagcacaagttttttcccaacttaactaaacattagaacacaaacaatatctcatagtatatatagaaatcatctagaagtcataatcacgagataatcacaagtatccaaataaacaacctgaaaccgacttcaatcaggaatcagtaggttagactgccaggctagtcggtctgatcgcatgctacacgttggtctgactgaccttctccacctggtctgaccggtcccacgtaatccacaccacttaactaattattcaccaaatatatatcaaaaccaattatctcatatgcctattgttcatcacaaaatatctatgttaatagaaaacactttgatttcacatatgctgctgaaaaaaattatagagtaaattccatattaggccaaatgtttaaaccaacatttcacgatagatttgggcttagctcaccttttcacttatataacaccatatgtctttgcatttgttagcgatttggactagggttgagtaaaaaaaaatggcatatgggccggagagaaaatatagttcaaatcacataaaacattttttaatctaataagaaaacggttcttttagcaaatcacaaaaattggagatgatgcgaaatatgttcatatgtaaaaagggcacaagtattgatccgcacaacaaagatgaaaattagcacaagaagggaaatagaaataaaagtagctggctagctagatacatttcacactgaaaaagaacaaagaaataatacacgatatcattttgcctttgtaaaatgcgtcgtggacttgcctttgccatgtgctttctggacaatcagatcgacggcacgtacgtcttggactcgatcacggtaataaagcacagtagcttcaacggctgaactgcatgcattcgagactggctcgggccatatggatcccgatgatctccgatcccccaatgcatcgatctctctgcagctagctggtgcttgcaacctaaatatatgccctggaccatcacctgcacaacggcacaaaatgattgagattgcatgaaaatgaattaatggaggaaataatgtagaaacttttacatttctgctaatatatatgtatatattactcctaccacatggtatatatatggtgatatatagttttccttgttagattttgattaatatttagtgtcgatcgttttctcttaagataaatacgtacctgtacgttctttatatacgtgaggcagtgaaaatgtgcccaaaatactactagtactactactccagctacctggcaaaccaacatcagttatacatgctccacgttaatccgtacgtttttatattgtagtggagtactatatatcataatcacatctaccaatacactgtcagttgttgtttaatttgctgcatctgacagtatgttttcaatcctttgccagctagtataagcttgtgtgtgtgtgtgtgtcccctttaatttggccacttaattcggctgagtaaacaagcatatatatagagaataatcgttacttgtttcttcttctgcgtccgatcccgtggcccgtgattgcttgcaacgaccagcagtactggagggaaagtattctaattcctcgagtggatgttttctcgtttgctcaaaaaccatttaaacggttatgaaaaattttggaaaaaaattgacaacattcatacaacacatatatacaactttacagaattttaagtctaaactcaactcacacgtcgagatataaaaaagacaaattcagcatatgaatagtagcatactgtttatatctaaa

SEQ ID NO: 71749 - DNA, 15158 bp, Oryza sativa
ctaatttttccttaagaagtcaagaacccatttttgtgctttgttcctgcttgttgcagcttcggaagatccgctcttcgtggaggttgaagccgatgtttgggaaagtgagcaaggcaagtcacatcatccttgaacatattgaatcccagtttataaaattattttgatttaaattattgcattatcgctttatttaaatttccgcgttatcactgttttatctagccatgcctatttacctttgttatgaccttattattgttattgttattatttccttgttcaccctagaaaaaaaacaaaaccccaactagtggacactctactcatggtaccactagtatgattttaggtagatgcttcgctggttaagtaggcaacattaggtggttttacaactctagactttgggaatactcttatcacctggacactatggaatggttggattattatggaattggattcacacctccccctctattcaaaaccctcaaaatggttttaggctaggctcggggtgcatggttttgatagtagcacctcggccatataaggaccggtcttctggcctctgttgcaaagcactaccgtacttccacatgtctagtgggtaaggcttagtttgttgcttagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggcggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacttgcctaacaactaaaatgtggaatggttggcctgggttggtttgggacgagctgggacccagggtcgggttgccagtttggtctgaatcatcgtaggccttgggttaaggcaggttcgtgtgggttcacggccttagttaataatattgtatagctctaggaccgtgtttacaaagtagctttgaccaactaagtgacttttaatgctgtatactgcaaaccctaaccccctatattatggctcccttgtactcccttgcatttattctgcacttgtgggtgtgtcttgttgagtacggtggttgtactcagtcttgctcaattttttccaaacccagaagaggagcccctggatgatgaaggctttggtgtctagctcgtgcctgccgtcaagcgcatgtggtcgtcgccctagtcttccgctgtttttcatttgtcttcttgtgtgctgggtcttcgccgcccatgtaataaattaattaattacgcttccgcttattaaactctgaattgtatcaatttttggtgtaccttgcctcctgggacaaggaataatgcacgcacgtaaggaacgcccgttgggttatttccggtcgtgacaatgacccatatatacaaccttcctacagtgcttaagatacgtactttctgtttcatccatacagtgagtgcaacccttgtaccccttgttggactatccggataggttgctaagtgcaggccaatcgttgatggttacgaacagcagcgctcgtaggttaaactcctcctgtttgtccttgtcacacacggggacaccttccttcttccacaacagtttaagatcttcgaccagtggtcttaggtacacatcgatgtcgttaccaggttgcttggggccttgaataataatcggcatcattatgtacttcctcttcatgcatagccaggggggaggttgtagatacacatcgtaacgggccaagtgctatggccgctgctcatctctctaaaaggatttatgacatccgtactcaaactaaactgtatgtttcgtgcgtcctttccaaagtctttaaattttctgtcaatgtttcgccactgcgaaccatcggcggggtgtctcaacatcccgtcctgttgacgctcttcagcgtgccatcgcatcattctagcatttctcttgttcctgaataaacgccttagccgtggtattatagggaaataccacatcaccttagcaggaattctcttctttgttagctgcccgtcaacttctcctggatcgtctcgtctaatcttgtatcgtagtgctttgcaaatagggcatgcttctaggttctcctactcctcaccgcgatataggatacaatcattcggacatgcgtgaatcttctgaacttccagtcctagagggcagactatcttcttagcctcgtacattgtctccggcaatttgtttcccttcggaagaatgttcttgatgagtttcaataaatcgccaaatgccttgtcactaaccccattttttgccttccattgcaagaactccagagtgatatccaactttttgtgcccctgctcgcaacctgggtacaacgacgttctgtggtcctctaacatcttatccaatttatgggcccccttttcactttcgcactcctctttggcgtcctgcaacatctgaccaagatcatccgcaacgtcgttaccatcagcatccctttcctcctcgcccgtttgatttccttcaaatccaacatactgagcaaagtccggaatattgtcgtcttccacttcatcttcttctatttcaacaccttgctctccgtgggatgtccaacaattatagcttggcatgaactccgactcaaacaagtagaaatgaatagtcctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgagtcgaaaaaaaatcgtacacaaataattattcttacaataatgacagtcatacaataattataagataattacaaactctttcaacagtcatacaataatgacatatctttattcatacaaaaatcataaaatattacaccaagtaattcttatttactatttctaaagttttaaactaattttaatgtgttttacttcttttaattttcattttagtttgttttttattatttaagattaactttcactatattttccttctcaactattttataaaaccttctttagcaaatcaactaaatttctatatattctttcttccccacacaaattttctctctcatcaacttacaactaaattttggagaaaaaaaactgtgcaaaacatagctccaaatgtaatatgacaaaaaaaacattggaggatgaagttgcaaaccttttaggcacctccgatttgtatgtaatcacaaaaataaattcactagaaattttggcatgacctcccctcttttttgaagaaattttgaagcttgctcgggcagctggaggaggaagaaaacatatatataggggtgggactttagtagatccccgagatctttagccccggttggtaacaccaaccgggactaaagatatgatctttagtcccggttggtgtttcctgacagtatttgaaccgggactaaagatagccccggtttttattgtatccgggactatcgtggaattcggccgaccgacgaaagacggtttctccaccagtgccatggcgtcaatacgaacgaaataaaagcgcctgcccatattatctcctagggttcggtataaaatatcttagcagtctttcttgtgcctctcactctctcagtactccacccaagatcaactcaacgaagaaggcactggataagaaatagaataaccagcattatattggtccccccgtgtccgccatgcaggtcccacgtgatacttacgtggtgaacagagatcagtgtatgtaactagaagaaaaacacagaagaggaattagctgtgctagctagtctagatgctggaaatgggaggaatctggaatgagctagccagagaatccggagaatgatgggaatgcacaccggagactggaaagtgccgttgttggacaaaataacggcgcccgtcaagggccatggctgcaggcagcggtatattgcctagccgtgccttcgaagagtatggcactgaagttgcatcaaacgagatgtatgtggctctctgtaggttcaggtgctaagctatagctttggttttttttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgcgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgactgcaatcctgcgaaacaaggttgcacggacggtctgccctcaacccgaacgacgaacccagcatgggtaccactgtatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaattccaccccctcccctcacgccggcgatcggagggtcgccggagatggaagggaaggggccgggagaaaaggggattttttttttctcctgaaacgcctgtttcgggagagctcgagaggctcgcccatcctcctactactccttgaggtctcttcagctatagctttggttgttgtcccaattccaaccagctaagagcaggtttaatagtataatcagcaacgggctacagaaactccaactcagcaaaaaaaatattttctcatagtctattctctctcattgagggcattgggaagcgtgcaaatggtgagaaaagtttgcagctgcagcatgcatggacgacgattggtcatgatgctttttctacggctgcagcccggccatagattaagcgccagccactctctctctctcctattttgtcactcttccatgtaggatttatcttagatgtatagtactaccgcctgctaactgtaccctattgtacctgctctaaacaaaacttgaaggcttttctcggttcgcatcgatcacttaatgccaaaactgcaccgtagttacacaaaaatccaggacaaactgcactgctctgataggtattattgaaaaagaaatccctctcactttaaaatgtgtggtttggtctgtacattgaaatcttctttgtcatgtgctttaatttgcaattatatatgtagaagatgcaaaatatcatcctagtggcagcctataaaaattgattttcatatacaaggtgagatccacattagttcctcgccattattaggctccgttgggtagttcaagttcccaactcctttttctcgttttccgcgcacacgcttttcaaactgctaaacggtgcgttttttgtaaaaagtttctatacgaaagttgcttaaaaaaatcatattaatcaatttttgaaaaaaaattagctaaaacttaattaatcacgcactaaaatactgcttcgttttgtgtgccgaggagtgagggttcccaaccctcactcccgaacagagccttagaagtgtgattgttttccactttgtaaaattaaatccccacctgcaaacatagtgttttaagtcaatgaccatgaaaactaattttccaggcggtcactagaatagcaccccccgtgaaccatgtgagtgatattacaaagctgagacactcctccagagatcacgcctctacctccttttctcccctctatagaccggcggagctcgattacttaatttattaaaagaagcatccgccaaggtacaagcgagagaaaaatgccgataactttagtgcttctctgaaactccaatggaagaatgtcgataaaccctacacttctccagaactttttggagagaactccgatatttggggcactcctttcgtattttcccctcactctctacctaattccgcatactaaagtggtgcctaaaatataagtgagttgttttgcattggagagtgacttgagctcctgcttttatagccttcaatgatggttgtagaggtcggttcaccgacaactgccattactatccaatggaaggctgccacatgcaaggggatggttgggggtgctagcacaggttcaactgacagccgaaccagctccaccgtcaccagccatcaactttatccagtgaatgacaggtgggtcctatgacggttagcagtggattggctcaagtttagtcagttttgactgacatgtatctttggtcggaggtgcatatcgtcgcatggcgggtgaatcttcctccagcattcacttgcatactcacatttaccaattctagtggaaatggttagtaataaacccttaccagtaagtttggtattctattttacatttttttatgcaggagttgatggttaaagtttgcacttaactaccataaacagtaatcgctatggtatgcctcataaacgtcccatcgctatcgcatctttctatcatcattttgtgaaggattttaataccattgccgcaccattgaatgagctatcggataaaggcgctctgttccaatggggacaatcccaagaagagactttcaacttgttgaaggataatttgacacatgcgccactactccaactcctttagtttggtaagacccttaaacttgattgtgatgctagtggatttgggaccgaaggtgtgctgattcaaaaaggtaaacttgttgcttattttagtgataagttatatgggcctagtttgaagtactctaattatgataaagaatcatatgctttagttcaaactttagaaacctagcaacattatttatggcccaaggaatttgttatacattctaatcactaatctttgaagcatattcgaagccaaagtaaactgaatcatatagtaattgtgaatcttttccttatgtcataaaacaccataaggataaggagaatgttattgctaatgctttcacaatttgatttcaatttttttttggtttgggagcgattaaagatcattatgtacatgatgttgattttaaggttttttattgtactgtatggaaggaaaaatgtggaacaaaattgtaattactaatggttttgtatttagatctcacaagttatgcattccagctagctccgttcgtttattgttattataggaagcccatggaggcagcttgatggcatattttggcatgaaaaatacggaggatgtgttggctagccacttctattgctcaaggatgaggcgagacattgagcactgcgtttcccattgtaccacgtgtaataaagctaagtctcgactaaatcacatggtttgtacatgcctctttctgttcctagcgttctgtgggaggatatttcaattaattttgttttgagattatataggactaagagggggagggatagtatatatttgtagattttctatgatgccacatattatacattttcatatgagcgatgatgctacacaaatcgatgagttattttttagggaagccgttcacttaaacgaagtgatgtctacagttgtttcagactgtgacacagtttgagttatttttggagaactttgtggaacaagttggggaccaagctgctattttccacaataaatcatcgctaagcagatggacaaaagaatttgacttcaataagtcatcgctgttaacagaagtggtcaatctcacattatcaacaatgttgcggccttatatggaaaagaatttgaagatgtgagaagagtctctaactcatgtggagtttgtatacaatcgctcattgcactcgaacccttttcacgtggtatatgatttcaatcctcatgctcctgttgatattttacctttgccatcttctgaaaaagtgaactttgatgcttctaaacgtgttgaatttgtcttaaagctgcatgaaaccactagggagaacatagaacgcatgaatgacaagtataaggtcactagtaatcagggtcgaagggaattaacttttaaacttggtgatctcgtgtggttgcccatgagaaaagaaatatttccatacttgcacaggtcaaaattgatacctagagccgatggtccttttaaagcaattactaagattaatgataatgcatacaagatttagttgtttgtagattacattgttagcgatgccttcagtgtggctgatctaaagtcgtagttgggcggagagcatgagcttgagtcaaggatgacttcaattcaaacaatgggaggataataaggacatctctaccatggatactgttgacagtcattgtcgaccagtttcgaccgtcaatattacccaattaatgaacactagctatgcttgcaatgcattattccataaataaaatattctattccactatatgcttggaaaattaaccatgcaggagaagctatcaaaatggaggagaatcgacagtacaacaatcgatcaatcaaacggacgctgtcgagaatcagacttatggatggatgggccaagaactcggaaatgagcaatcattctgagccaaaacattgtgtaccataaagtggggcccacatgtcagcatcctgaagaaggctgtgggccaggggagccagctaaggttcggcggaacccctggttcgtccgaacccccagctggcccaatcctgcccatcttcggccaggcggttactaccggcatcctatgacggttggagctaattctacctgaagaaaacatcgtggacacatggcaagaagagatgaaatatgctctttggatgcttcatcatgccacatgtcatgacgagagcaaagatgctcctaggatgcttgaagcatctccacactcccaaggcacctctccacctataaataccccacctctcattcattccctcacacaccttaagaagaagatcatgagctctcccaagttagtttagtagttctagtgctagtggagtaggaaataaaatagtcttcatagtcctcaagtcttcagttgatttctggtatggctctagtagcttccctctcttcttttgtaagacttattgaattaatagaatattcttctttatacaagttcggtattttattccattcatattacttgagtaccgactttactttatactcgaatcaatatagtcatgtaactagctttccagataggtgtattggtgtgggtttagtgtccgagtatccggttgctctatgtcggttgcaaggatgtagagtagtatttagtaatgtaagcgcggtgcttagattattagataccattaattggggtaatatacagtggttcagaggctggccgctaatggtgacgactcagtacgggtgccctctgcatgagtatattatcctaagtgcaatttcctggggagggtactcctccgtatttagccccggttgtatggccatgacaggttgtcgtatggaactcggcaactaggggtggtctctcgagaggacactgggtacggggtattggttgcatgagtgtataatagcaagtatagactaaagatgtatgtatactagaagtacaggaatgatacttttcttgttctttctctacttagcttagactgtattttagtgagagtagttcttagttctttcttctgtgtgtcaccctaccctttgaagtgaattaacccatgcatagactttgatgtatataagtaatatatgaattgttagcatagttctctcttatcatgtcttcccttgggataaaataaatacgataccttggagtactcccgggtgaaatgctacaatggtatatccgtgtgcttgtgaatcatatctgtcaccataatataccaggattatttctagtgctattgctgggaattatattcccagtagtgtcgctaagaaataccaacagatacaaccacatcaactccacaagttgaaccaaatatacaaggatcaattactcgagcctgtgcaaattaactcaattatccaataaattcgttcttagaatgcataagcacagtttattgagtgagatactactaaaagcttgtgatgatgttattttacttagcaatcatgcagaaagatacacacaatccaaaaggttatgcaagacacatgattccagttcggcctcctgaaaagccagaagttaaaccaagcatactcattgattcctgttggcggtcattagcgatcagtttcgaccgtcaatattaccggaataaaggagaactagttatgcttgcaatgcatatttgtgttagaataataatattccactagtattaggtatactaaccttttgcagaggataaccataaagtggaggagaatcgacatcaaatcagacgatcaatcaatcggacgatgtcgagaatcagacttatgcatgaatgggccaagaactcagaattgacacgaacaattgggccaaaattcaaaagtctgcgaggagaagcaacaaaggagttcgccagccaaaacctgggctagttgggccggcccatggttcgaccgaaccagggggtttggctgaaccctcctcagtgccatccaacccagtgctttgcctggacggtgtggattagctcccaatgacagttggagagtatttccgaccattccaaccatcacaaccgtcattgggaggctataaaaggagttcccatcctcacttcctccacacacttcaagcaatgctctctcatattctctcaagcttagtttagtattcttaagctagtggagtaggaatagaattgaaatcggagtccggaagcctttggaggagttcgggtatagctctagtagctctcatttcctcttttgtaagctttgtactttatttagaatactcttctttatacatttctggtattgaaatactttccgagtatatgaatgccaacttatgttcatgttatactgattatactgctagcttatctaggagatgcataggtacgggtataatgtttgctattacaattactctatgtcatgacgatgatattagagtatagtatctggtagtttaggcgtggtgtctagattattgggtatcattatttggggttatatgctgcggatgagtggtggggcgctgatggtgacagctcagcacgggtattcctccgcgcgtgtatatggtcctaagttaatttcctgggaaggttactcctccgtatttagccccggttgtatggtaatgatgggctgtcgtaaggaactcggcaatcaggggcttctcgaagtactaggagggcatcggaaagagggtattagctagttaatcatataactagaatgtatgtataatatgtatactagaagtataggaatagattattttctactttctttccacttagcttagataatttggtatgaggatgagtagttctatgcttgtgtgtcactctaccctttggatgatattaacacctgtttagactatgattattacaagtaacatataaattattagtaaggttctttcttctatgatcttcccacgggattaaataaatatgatactcttggaatactcttgggtgaaatgctacaatggtatatccatgcgcttgcggatgaactctgtaaccataatatatcaagagtatttctgcgccattgctgggaattatatttctagtaatgtcattaagaaataccaacaattccgaagtccgttttatctctagaagtacttgatgtaaatatactgccctctttcaaactaatccggtatcacttcaaaattcaatctgactcatccgcaattgccaaaagagttgtggtttgttcatggaaaccaagacccatagtactgcatcactttcagttgggtcaatgggccttgtaggatgtagggcggtgtgccacatcctggttaccgtccctagtcctctttcatgtataaatacttacatatacctttagatttagttttgattttgtttagatcaaagtttagcgtcactactttaccgggtaaagtcgtagttatttaaatcgatcactattttctcgttatgaagccccacctttgcatatagattgaaggatttatattttatttgcaatttgagttgcttgtttgtcttgttgctagttatcgattgcttataggaacaaataccctcgtggttgggttaattgttctccatcaatatcacgaataacccgtgaagttgatgtataattgctaaggcgcaacgtcctttgactattgtagtcgggtcatcaatgtcgcatccttccaatcgaagttaaccctctcatcgagagattgagacacctgagagcatatcacatgggatgtagcctatatatactggtgctggcatggaggaagccctggtggagatctcgcataaaaattgtggcatgtccgcgattgattgccatagaagggaactgacaatgtgaagatgagagtttgccgaaccaaccagtagagaccatgtggtgggtagttgttgcctcctttgcctcctcaagctccaccaataaccctttgcctcccctctcttgctctcgcttttctcccctctctcgcactcctcatcgccgccgacaccactcgcggacaccgccctcccgcgggaggtgagggaggtgaggcggcgggctcccatggccggtggcagcgccccgccctccccgatgtgttcacgtgcgagatcaagttctccaccactgccatcctagcgacgctcaagggaaaggaggaggcgacccaagggccctatcgccgccgcatcatcctcaacgctgttgtggttcgagtgctgatagatgaccggatctatggttggtgtcttttttttgtctcgttcatgttctcttgttaaatttatctcatgtttctcttgttcatgtgtgtacggatttggatcgaatgaacattgttctggatgtaaagttctggatgaatgtgctttgatgaatgtgttgaacattgttctagatgtgacgatgtggaggggatcatggggtgtggacaggttctggattaggctcgattcaagctggagtttctttgttttttttttggcttgtgcagacacaaagatgccggttctattttacctataggtgccggtggcatgtattggtgccgagcaattggtgaattcacttgcaaattaaacaaactttacaattaatggtcactagtacagatccttctatctgtgacggcctctaacatgcctagaaatagcgggccgtcacaaggaagtgatctcaatcgggccgaaaaagtgcccgattgagatatggtcgcacagacatattagaagagcataaaacttaagcctgtcatggatgacacctatcagtgatgggccgtagtttaggctcgattgagataacattccatatctcaaacgggcctgaagttggggcccgtcacagatgaccatcatccgtgacgggcaccaactttgtgcccgattgagataacattctatatctcaaacgggccttaagttagggcccgtcacagatgaccatcatccgtgacgtgcaccaacttgaggcccgttacaaatgactcatcagtgacgggctatatactaatccccggttgacatgacttaatatctatcgggcattaactaaagcccgtcaccgagtattttttccattttttctatgaaatgtttatatttgtaagttgaactatagcaaaataattaacttgcagtataataattcaatttatgagtcaaataattttacgcgtagtaaatgatatcaaatggaaaagtcatcaacaacaaagttgtataactcatcaagatcaataacttttattttggtcatttttctatataataattttggaacagtttgaatttgaatttgaaaatatgataacttcaaacaacattttcaaatactaaatgatttcaactaaaaaagttatcaacaacaaagttgaataactcattaagatctataacttttattttggtcatttttctatataacgttttttaaaccgtttgaatttgaattttaaaatatgaaaacttcaaataatattttcaaatattaaatgatttcaactgaaaaagttatcaacaacaaagttgaataactcatcaagatctaaaa

SEQ ID NO: 71750 - DNA, 3013 bp, Oryza sativa
tgtcttaacatctcgcctgttaaactcaattttccatggcggtcggctaatcgccagtgaaaatgcattattttcactggctttagttcgctcgcggcaccgtcggccgccagcaaaaaactattttagtcactagcaaaaatgattttccacgatatagattgaaagatgtacgcacgtatttggttgagacaagaagggaccagatcaccagatgggacaaagaaactaagaaaactgaaaaaattaagtacaggaaacgcgacgtgcacatacgtaccgcttgtgccacgagcatctttaacgtattaagcaggaacacccatgtgtggacgcggatgacatgttgctttacgcgagaattgagatagatgcgggcatgtgggattcggtatccatgtggtaattcgacaacataccgagctttggcaaaaacaacttatatttttataatggcaaattttgctacagaacatcgtgacttcgtggtattagctgtaagataacacacgaagtaacttttgggggaagacactctataaacgtggtaatttatcagcggacatcgcactcattaaaataataatttctgattgaagagaagagaaaaatcacgtgaaatatcagaaatacccctggacccatatgtcaacccttctctatatatgaccacctcgcattcttcctcgaggtgcctgaccccttctgtcgagcttgacccgtcggccacgtcgcagcgggaggtggaggaggggcacgaggaggagtttcgtgctcaaccaaccccctcaagtcgccgtcttcggccgcagcgcctccgtgctcccgctcgccttcgtcctctttgttacagcatatgacgcagacggtcgcggccctcaccctcacggcgagctccctggtatcgcgctccttctctgtccttggccactagaagaagtggcggaacaactccctctcccgcccacccgcattgcttcccttcagcggctgcgacctccacgaaatatttttataatggcaaattttgctacagaacatcgtgacttcgtggtattagctgtaagacaacacacgaagtaactttcattctcctctttcacagaagggatagagagagaagagagatgtgatagctgacatgtctgggtccaggggcatttgtgtacactttatactattcttctcttctcctcaaccaattaattattattttaatgagtgcggtgtccgctgacaaattatcacgtttatagagtgttttcccccaaagtcactttatgcggtgtcttatagctaaaatcgcgaagtcacgatgtcatgtagcaaaatttgccttttataatagataaaggttgagagaatgcttgtaaaggaaaggattcgtgtccgtcgtaatatgaccgttgagggttttcggcttttagggccgatttgggccctgtcttatttaatccatggaaaatgttcacttcaatccatagaaaatgttcacttcagatcctttaaatataggcccaatttgaatcgtatctctcaacgaccgttgaccctaaaatttctcttgaaataaatggagcgtaaagtcggcgctattatttcatttagacaaaacaaaagggagctaccccccccccccccccccaattgaagggactagctaggtacgcaatatactctgcagcatcaatgtggggatatatgagaaacacaaataatctgttgaattttatttagtattgtataacaatggttatattgagagaaataagattctttagaagcttaatttgcctctgaagattaagatctttatgtggtacttacttaaaggggtagtgttaactaaagataatttggcaaggagaaactggaatgggagtttgaaatgttgtttctgtatgaagaatgaaactattcagcatctttttatggaatgccattttgcaaagtttatttggagagctgtacagttctcttttggtctttaccctcctaatagcatatctcatattttttatgattgtcttctgggggtggacaagaaaaataggaaacttattctcataggagcttctgctatatgttggactctatggttgagtagaaatgatatgatttttgacaaatcaccatctgtttatatatgcaggtaattttcaggacaacgcactggctcaggtcttgggcactgctacaaaagtgtgatgaagagggcgagcgtttaaaagttgtatgtcgtaattttgagacaacggttatgcaaatgtttaccaattttggatggagattcacaaacagaattcaataattgtgtactccttatcttgggttggtaggtgtcttctttttttatgtgagaaactttttattttgtgtgttactctgtaataattggctgtagctcgttgagcaaaggctgggatattctattccattatctaaaaaaagtataataactatctcataggatataccccatccatttctaaatatatatataggacatgttcggttgtgctttgcacacataaaagtactgtactgcaacacggtggcacggtgcaaataaagacagccgaacacgccaatagagtatggaaacttgtattacaagttagtaaacctaacctccagaattatatctggagagctttattttatcttgataattcgtatttttactcttattcctaaacgtagttctaacacctggatcggcctgcttagttctaatcggttcttgggtactctcatagatccattgtctagcctttatccattgttgccgcgtccggaagagataggaggatggtgttcaccgccgggacctgaaatgaaattagattctaggcatcaaaccaaatggaactcaacatatggtgctacaagatatgcccattattttgaggaaaaaaacacagagaccgggctatcatctattctaactattgctaaaattcttttaccaattaaattgctactttctaccgatcatgattattcgacgttg

SEQ ID NO: 71751 - DNA, 2923 bp, Oryza sativa
ataggttcctttcctgccacgttcatagtttctacctgaaacaggaagtgacatatcacaattcatacactctccagaggtgtgtcgctctgtacccacagacgccttaaacattttaatactcacgcccgttagcgcttgaagcatacttcatggtgtatgccagcaaggctaaggtcataagcttttcatcaatcccatctatcaattatctctacgggtgattccctcaacaacggcgatccacatcatctaatcggatcccgcaacaacggcaatcctcatcgctagcctacgctcacggggttcacggaagtccttaagcccgcaggataaagccattaagaaagatctactacgctagcctgtcccattccaggtcatgtggtctataatacaccgagtttcaaattagtgtatttcagaaaatattagaacagatgcgcaaaagtgcaatttttaaattgttgttcgaatagacgaccaggaaccatggatgcgtagggcttgccgactaatgcaaaatagactataagttagtttatagtaatcggagtccaaacgaagtctcggggattgaatcgatttggaccgttgttctcctttctagactatatataaccaacagtaaaaaaaaaagggggcaaagagagggatcgatcccagccctagccgtctttatctgttttgggcaccgccatcgccggacgtcgccgctgtcgccgatcgtcgccggtcgtcgccacagccgtcgtcgtccacagccggtcgctggtgagctgctgctccttctgttaatttccctgctgctgccgatctgatctcttccttgctgctgatgcatggcttgttgttgctgccgatcctcgttgctgcttctgctgttgttgatgatctgcaacgaatgctgctgctcctgttgatggtctgcaacgaacagagaggaggagggttagaaggcagagaagaacatgaaggagggagagggggaaattagatagaagaaaggaaatttggggaatttggtggatatttcaaaattcattgttttttttacaaattagtactgctaggtaattcgttttagtctctatttgtttctaatttatacataagacgatctgtttccgatagctcaaatttattttattggctgctgggctgaaaacgtatttttaaatctggtattaaaccatcgggattcagattagttgttctaaataaagtttgtagtcatcgccgatatctttctaacggcgctggtttcactcgattctgataaacggtttgagacaaacatcagaaacaacagtgctgacctggtccggaaatcaagatagcaattcgttttgtttaatctgagaccaataaagacttaatctgattttgtgcccaacatgaaagatgtagacaattttatctagatgtccgaagtagtattatttgctagatttcgtaaacggtttgcgagttacgcataaaacagtaatgaagctgctatatgttgtttaatataaatcggttaaagtttatatgttctaggtttcgattttagtgtaactattattagttgaacatagtggtttattcgtagttttgctgcataggtgtggggagatctggtgtggagggtggttcgtcgggttaccgtcaaggttaaaggcaagtgcatgatgaactaattgtgtgattcttggatcgtttactctatctatttatttctgacatatttttatgtgataagtgactgtttatgttcagactgttgtttacgccatttagatttcaagtttatcttatgtctatgacgttattcttgtttcgatattccggattctggttctggttaaataattcaagttccatgcttgccatggatgtgcaatatggtttcaatttggttctttgtttccggtttcagttattcatgttccatgtgagtcatggatgtgctacttggttttctatttatattcctgtgggtaagtgctgatcacgcttactcagctttgccggcaaatgctaggatgtattcacaattgtccgggatggaaactactatttcaattcatatttgtctgggatgggaactactattgtctttaacttggtgtttgaaatatgattcttttcaaagaaagaaagttttctgttcaggctttattgcgcatgatgtgtatacgtgttttctagttccatattatacttgctgagtatttctgtactactataaaaaaagtatttctgtactcactcttctgtttatttgattttagatacacattgagatcgacatgcatgggcgggaagtagcacccttggattacacatttatagcactaaaaaaatttggttttagattatgatcctgcttagcataagttttgcgtagaatttgtaaatgtcaattaaagttatggttcgtattcttatgtgggatttatggaactaggatggtttggattgtgcgaattatttcattattgatttatcttataactgcctgtcgtggatgttcgtatttataggggagactgtcgaaatttctaataattttgggagttagtggttttgagtgtttttggtgtggcactctaggtacgtggttacctgggctgttacatagtcgacacgatcgctacgacacttgcatgccatataccagttgtttttttaaccttatgatgataaatatatgcaactgagcccccaccacaatgacaagtttagaatacatccataatatgaccaactgctccaacaaccaatcgaatccttcaacatatttattttaattgcagaaaatataattaatgcaaggtgatacatatagattgcaaatacgaaaatataacaagagttggtcaaaggtgttggacttgcttgagatacccgaaatcgaagaatgaataaatcaataaag

SEQ ID NO: 71752 - DNA, 4494 bp, Oryza sativa
taattagtgtcattagcagttaattaattaattattttttatttaattaacatcattagtaattaattaatcattaattatacgttaatcatgatccatgtcaggccatctcgcacgctgctcaagcgagatcgcttcttgttttgctgtcacgctggtcccgtgtcctggtgttgcgagaccgtgcggtatcgctccaacaacctgtgagaccgtggtctatcgtcacgctatcgttactttcgctgaatgaatcagcgatattgttttgctttcgcactttcaatcagcgactatggtatatttgtgtaaaaaattttacatcccgaatattaatgaaaaaaaaatgaatgaatggtatattttaaaattgattcttactttctccgtttattttcacacaattctttatttaaattcattaacacctatataaacacctatataaagaacatatataatatacgaaacacatatatgcatccgttcaaaatgtagactggaatttatagtgcaaaaccagggaaaaactataaaaaaaaacgaaactaaaactgaatgtagcatatatatatatatatagtagtataatgtcatgtgcagttttagatttgtttttttagactgagagagtaccaccaaaccaaccatatgcgttcgcgcacgacaacgacagatatacgacttttactatacggctatacgcctctctctctatcaggggcggtaccacccattaggcggggttgggcggccggcccagctacggcccgcgccaccccaaccctccatatcctttttaggccgcctaccaccatatccaattcacaattgacccataaataagcagtccaagtgtccaattttaatcctgcatatgtaatgctttcctgagtcaattcctcgacactgctcacccccgtcccctactatagttagctgcctaatgtttttctctctctctcccttctaagcaaaataataatcatcttattctgggtatgcgatatcttctcatatatttattttttaaaagatatctatcaaccatgctttatgaattgactcatatttgcaaattgatatgtttatctttttatgtatgatgaattatgtatggcgcaaaaattattactttatttttaatatcatttttgtttttgtttgccttaatttattgtttatactatatatttatatgattacaacataaatatggtattttttgcgtttagttgttcttattgagacgagcatcttcgcctcatctttattttaatcttgcgtccgccactgctctctatgaatatcgattatccatgttgcctctataaataataatgacccggcacgaaatgctggtatcagatatgagcagcgtgcagatcgtttgagcagctagcaacaaattacaagagggtggtagctaggcagctagctagttaggccggatggcgcggctgcagcgacgacgtctcgtgctgccgctcctgcagctcgccgtggtgctctggttggcggctaccagcggctgcttgtgccgccggccgccgaccccgatcgccggcgtcccgtcgccgccgattctgccggacggcgaccggacaccggagtcgcctccaggtgatcagagattcatttaaccatcatatatacatgcacctatacgcagctcaagctaaatttcaaagcccattgcgcgcatgagcaaatcaacttatatattatcttacttttcaaatatatctgaataacttgtcgtttaattatttgtcttatttagaagaactatatgtaaatgtcgtctaatttcctcgtggcttgttttattataaggaatataaataacttataattttaatatctgtatttaatttgtgataatatgaatattcaaacaccatcacaaatgtataaattcaaaagcaaagagagattatttgttaatcttaatttgtgcgacataataataaataaatacatgtgacgatatattgacgcagtttgctttttcccttgttttgcagctcccgtatccgcaaaacacccgaacttctcggtccttccgccgccgggctgctcgccggattgcaccgaccagcaacgtcagccttaattagttagggactatcaacgacgtacgttcagcatatatactctggttgcaaacgtgtaattatatagtatgctctgtaagttcgttccgatttcaaatgtaatgcaatttagcgcattgtatatttgtattctcaactacttgtaagtgtaatttctattgctagtgtaaatgtacggccgagcgatcagacttggccgctagctaatcaacgacgagactagtacgcatgcaactcctaccgccgtcaagcccggcgtgcagttagtgtgcatgaacctgcgctattaaccaccttcttcgtccacgaaaataaaacatgacaaatatttccgataatgctttaaatcgaacgtttgatacgacgaaatatcggacgcaccaccgagtgggtcccacctaaccactttcccacctttttctctctaccggtcaaacttatctctatctcaaccactcattcttctctctctcccctcaacacgagtgttcgtggtttcgccaggaagaaggagcatgccagcggccactatggctaggggtggaaacgagccaagccgagccaagctcggctcggctcgtgaaagcttggtaaagaacaggctcggctcggcttgataaagagaacgagcaaaaaatgcagctcggcttggctcgtttcaaagctcgagccagctcgagccagcttgtgatgcacaacagcaagtaaatacttcaacaatagtgcaatcaattttcagcaagttaacagcaagtgtgcattacagattctatttactacacaaaacatatggctcgaattaagtatagtatattagtgtaggtataacaattttgatctatttgcctcaacctttctgtgattgaatcattgataatagcacacactgcacacatacacatcaattcatcacgcatatacacatcaattcatcacgcatatacacagctactgagaaatgaatcacaaaaatcagaaaatacatcacgaacctcttcatcctaggctcgtcgctgtgtgaactgtcgtcgatcggttggcgtctcggcgaggtgatggacggcgtcgaccgtcgagtcagggacgcgggtagcacaggagagggaggccgaaggcggtgcagggtagagaggcggcgccgcgacggcactggggtcgagcgtcgctgggcggctggggagggaggccggagccagcgcagccgcgcagggcgcaggggagggaggcggctggctggcggaactgaggctgccgcgtcgagcggcgcgccggcgcttctgctagggactgggagggaggcggcgggccagcggccggcaactccttgcgccgcccagagggagggactcggtctcggtgcgatggagtagcggcggcgacgaactgggaagtgggaaggggaatagtttctgtagcaagggaaggttagggttttcattaggcctgggatggggaattgttaatgggccaaggtcattttttcaccagcttgacaagcctaccgagcggcttgtgagctagctcgggctcggctcaatttacaaacgagctctggaggcagctcgggctcggctcgttttcttttcgagccaagccgagctttgcgagctcgagccaagcccgagccgagctcacgagcccgagctttttgtccacccctaactatggcggtggtggggcggcacgacgcaaaaagggaggagaacaccggcgaccatgctagtggcagcgaagaaggccgacacgaaaggaaggaccggataagacattggacctttggtgtcggcagagtagccgcgagcccacgatgcgaaggaggtcgcgcgacttgccctggcaaggtcgccctcctgcatcgctacttgccatggtccacgtgaccacgtctacaccatgccaatcggttgattccggtgagcggacttgaagaagatagaggtaggcgctgctagggaattttagatgttgtagcttgtttgttctattaagttgtttcatttcattttagtgaagttggaattttagtgatgttgcagcttatttgtatttttgttgcaatttgttctattaagttgtttcattccgttttgattcattgttacataaattaatttcttggtgttacagtgagtatgtttgactattttcatttggttgaaacaattttgtttaagcactgaaacattttctctggtagtgaaacatctgaaatattttcatttaaatatttttttatcaacaagtgaaacatgtgaaacattcttaaacaacaccaacaccgtccgataatttgcacaaaattggacgtctgatccgtagcaacctccaaatacttcttaagcaaattaaagattggtataaaattattggcaaaatt

SEQ ID NO: 71753 - DNA, 1721 bp, Oryza sativa
gctgccagcctgaatatgttctgtggctcctcatgagtctgcccccaagctaaccctagccatcaacccctctccaatcgatgctgctgctggctactgctctcaacgactgagattggaatttcccagccccatcgcccctgattcaagcatggctcagaccagccgtgtctccccgagctcccctctgatcccttctttccctacttctgtggtgtgatctaattggtgttctcttgtgtggtaacctattgtgaatttcgatgcttgtgaacacgtcctaatgacgaacttgatggtgctatactaaggattatcctgctgtctgtagggatgaatgaatgaaggcaaaaaattgcttaagggcatccaaaaaagtgtaataaaaaaagtgtaattagttggtggacaccgaaataacgtgagtttgttgttgggcaccacgaaaaactgataattagctgatggacacttgcaaccttattttatgattctgcccttgcgtggctccaacacaatattctctcaagtcctcatccctatttacccaagatatttttgatgttcttgttagcaatagctaatcgctttttgggaattgaatttaaatttttctggatcacaccgtcagtccaaaagctagggaaagcaaggaagcagcggactcaccaatgcacttgccggagctctccttgggaggcggccgttgcggttcatctcgtccaagaagcgatcgacatacttcgatccctccttcctgccggccggacgtcttgtcgaggaagtggaggtcgcggagccccacctgcgcgttggactgcatccacgtcatccttccccccggtcgcatgcccatcccggccaccctttccggcactagaacgacgacgtcgacagcaactgctccaccccattcgccaacgccatggacgacagcatcgacagcaactacggagctcgagttcggcgagctctaccacaacggccagatccagccgcgaaccttgtccccgcccccgaatctcgaccctgacagcgatgacgatgacgactgctgccctgtgccagtacgaggctgtgagccatcgtcgcggagcggatccgcgcaccacacgcacaaggtccatgtcgtcgctctggatcttggctgggctctcttgcactcggctgggtcggaggagctagccgcgaaggcgtcgcatgaggatccttgatgccgcccaggtccctcgagctccgccgccgccacccaactgctggtcgctgtcgtcctactgccagcctcgtcgaactagaggaagatccagcgaagaagacaagtcttacaggtaggccccacagaagaagtttgacaagggtaaatttgtctttaatgagtgtttctctctctaatttctccataaatagtaaaataatcttaggagtgttcatcagctaattatcagttttttgtgatgtccaacagcaaattcgtattcttacggtgtccaccagctaattacatattttttgaatgccctgtagcaaattttgccatgaatgaatacttacataatatatcctagagtaaatgcagtactgaaattaaaagcacactaacatgattttgtccttataaatatgcttgcatgtagaataaccgaatttctgaaattagtggcacattagcaggattaaatccctgaattaggtttattgagcaatttacatgttctacaatt

SEQ ID NO: 71754 - DNA, 14118 bp, Oryza sativa
gaacaatgttactatcactttagcagataaagaaatgaccaaaataaaagttttagatcttgatgagttattcaattttgttgataactttttcagttgaaattatttagtatttgaaaatgttgtttgaagttgtcatatttttaaattcaaatttaaacggttcaaaaaatattatatagaaaaatgaccaaaataaaagttatagatcttgatgagttatacaattttgttattgatgacttttttagttgaagtcgttcactaacaaaaaattctatttgaatttcttaaactttgaatttcaaatttcaaattgtttaaatatagttagatggagaaatgaccaaaataaaaattttgcacctcgatgagctctacaactttggttttggtgacttttccatttaaaatcatttattaaccctaatttttgttccaagttgtcaaattttgaaaattcaaaatttgaattgttcaaatgaaattatttgtacaaaggaccgatacaatagttgtagatctcgatgagttatataattttgttgtttataatttttgatggttgtgtatgtgaatgaatgtatatgaatgagggatgttggggtgtgacatcctggcctagggcttaataggactaatagaatactcactataactactcttccgaaagctgatctccaaagaactttgatgttaagcgtgcttggcctgaagcaatttcgggaagggtgacccatcgggaagctcttcccaggtgcacatgagtaaggacaaaaaagactggctctgagagacgcgggacggcatgcctaaaaataaatttttttttggcattatactcatctatgacgggcattaacttaggcccgattgagatgactcatctgtgacgggcattaacttagactcgattgagatgacttatctgtgacgggctatagttaatacccgtcacagataagggtcatctatgacggactatagtttgactggtcgtctgggtcaaagctatcgatgacgggctttaattatggcccgattgagataggttcatctgtgacggccgtttgtccgattgagataacttttcatatcagtaacttctagcctgtgacggacgccatgcccgattgagatgagggttgccgcccgattgatatgatggtatctgttctagtgggtggactttcgagcatgtgctgttggcagttgggggcgaccatattggatgaagatggtttactgggaaggcatgcaagagttacgttggaacatgtcagctaattcatccgtcagtacgagtacgtgtgcatccatccatccacacactgatcctattgcctgtctgaggaaaacaatactactactggtggctggtcacagtagcagatatatttgatgctagtaccatttgtaagttcgctgattaatttgttcacaacagtgtcgtcagagatagttcctaccacgagataagaacgtgaatgtggatgcgactggtgattgaaatagatggctgcatttgttgtaccgaaaagccatctgcaatatcgtgatatcaacgttaattatgcttgcttgtttgactaaccaacagttagagttttcaaatttcttgtgcgatagagattgccgatatatgtgttgacggcatctttgcccgcttcccgtgggacccaatcggatcctaacgagaaataaactgcatcgtccattctaaaatggataacatactaaatgcttatagtcaaatctccacatcttaattcattaatacatgtgtagaaatattaggatttggtatgtgaaaacgatgttgattagattttttatgaaaaaacatttcatgtgttttatttttaatattttttatcaatatatagctagaaacataaatgatgaaacattaataactggaaaaagtccattttactccctagaacaaattaaatgaatctgttaaccccctaaactattttcgccttattttatcccctaagctagtgaatctgttctctttttaagttccattttaagctgaaattatttgttaagagatatagatggtactgttataagagtataaaaatatttccaattttttcatggttgtttgcttgaaccttaaagtactaaagttttgatatttaaatcagtatttaattcagtattaagtgcttccagcctacgtaaatagtgagaaataatttcagaaaaaaaaaagttaagacgatgtaagttgtaatgcatttatcatcctctaccaagttttcagcgcaaaatatgacttatctggagaaaaaaagaaatagtgttagggaagttaagtgaataatgttcagggtgtaaaatgagaaaaaatagtttaggggtaagtgttttgttgaaatagtttggggagtaattaaaatggggtctttcccttagttatatacacataaattttgtcactgtctaaaatgtcaagtgaaaaagaacgaatgtagcatcatccttgtcatgatctccaatcatccacgtagatcactgctcaccaaacgtccaaacctatcattgtgttattatgcgcttgaatgtacttgcatgtttccaagcaagttggatacgtgggcaactttgccaacttatctgtgttttgaaaataatttaatttacaaacaaaatgttttgaaaggtcaaaaaatgcaactagattcctaaaaaacaaataatattcaaatgaaacttaatacatagaacactaattcctaacaggaaaacgttaaaatcaaattgaagttgtgacatgaacaaatgaaaaagaaattgtaaataaacacaaaatcaatttagtcaaagcttgtaacgtaccatttggaatggaacttgcagtaagacagcaaattcaaaattggcagggccgaaataatcgattcttaattagattttgaattaactagctagcttggggaaatactagattcaactatgagagctactaatgttattaaagagaagatgaaatatatattattttacaaataaatagcgatagatgagaagtgcaggaaaatataaagtaaataaataagcacgtgaacatataaaaagatgagagaaaccccagaacccttttgtggctgattttacccctaaacgattggaaaaggttcgctttacaccttaatatcatttctcttattttactctttatacaagttgtattttaagttcaaattagttatagccataaacggtactgttatcaaagttgaaaaatggtactattaccagtaaagttttgtatttaaatcagtcttaagtgcttttaacctacgtaaacagtgagaaaaaaaatcaaaaataaaatgttgacacataagtatagagaaggaaaaatagtgtaagaggagtgaagagtgaaccattttcaatagttcgggagtgaaatgagaaaaagaatggtttagagggttaagtggtccagtgaaatagaagtaaggaaatggaatggacttttttttccaaaatataaagcaacttaacaagtaaatttatgtcatagaaaaattgtactgttctttttatattgcgcaaattttgggcatatcttttgtaaacctcgctgatttaaaaaaaaaaatcattataagtcgattgagaaatactttctccgtctcaaaatatataagtattttttagatggttacaagtagcaagaaagtaggtgaaaataattggagaaatattatgattggttgagaagataaagttggtgaagaaattgaatagagaacggttgtgattggtgagacttgagaggatgataagtacagaaatagttttattttgggacaaggcactgtaatagaaataactatattttataattgtgatggtagcaaagttaattttggatcaaatcaattttctctatgccactttatatttatgaacaagtggatcatgagcattgactttccaagatgtgaacaagactgcaataaataacaaacgaattgaaggatcgatcggcccggccgggtcgaaggtagttgccgtataagaatgccctatggcggcatggctcatccatccatcgactagtcattgtacgtagccacaccggtccaacctaagcgagagctaatggaagctctaactagctcgccaaattagctagtcaccatcactatatcttcctctatgtgtaatatgtacttgcaataactaataagaagatttgcctcctaatcagacaactaattagcttgatctgacagcgtgcattctgacgagtcgtacgtgcatcctgacacggcgtcgatcgttcgaatatataaacacagctgcgctctacgccaacaactaactgtccgtgtgcgagttgcgaccttgctggaaaacttgtacctagagctagctgaaggaagcaatatggccaccgtggatggcacaacggcgccgagctccggcggcaagacggcgacggtggcgttggagtcgggcggcggccgctacggtgggccggctccggcgaaatgctccggcgccaacctggccctgagggcgctgctcttcgccgtgtcgctgtccgcgctcgtggtgcttgtcaccgccaagcagacggtgatggtcccgttcgtcatccggccgccgcagttcatcctcgcgccggtccccgccaagtacacgcactcaccggcgctcatgtgagtacactaaaaaataattaatatgttattgattttgtttttttgctttgttgtactggatatatgtactattgtgtactactcctatatatgttgttgacttttgggatggtttttggctgtagatatctgctggctgcgctgtgcgcgacgtgcttttacagcctgatcacggccatcagctcggtgaggttgctctccagctcggcttgctctgccaagacgctcttctacctcatcctgcttgatgtggtgagctctctatgcatgcgtaaactgtttcaacacggcatatgcatgcatggttaccgaactactactgctcttgcgatcgttaattatcctgtcaaatagtagtactaactaaatagtatatgtatgaccgtcgatttttcgacgtacagacgtagcatccccctagctgatgtaactcgggcatattagtcagagcatagagttatactatcaaaatttaatcaaagtattttaagagggaacgactaattcaatcaatcacagtatatatactctatatcgacggatgattggaaaggtagcctgcagatatttcgttatagaagtagtaacgttaattgaagtatatactggtcagtttcaccgccttgacttggctagtatgaaaactaaagcaaaggaaaaatattcaacaaattaatatcaaatcacacacactacgtacgtacgacaagtcatggtgtgtgaaattcaacgaacatatcaggggatcggacacactaatagatggtcctccctctgtgtcaaaatgtttgacaccgtagactttttaaaacatgtttgataattcgtctcattcaaaaaatttaagtaattattaattcttttcctatcatttgattcattgttaaatatattttaatgtatacatatagttttacatatttcataaaagtttttgaataagatgaacagtcaaacatgtttaaaaaagtcaacggcgttaaacatttagggaaggagggagtatataacgcgacgtatttaaatttaaaagggatggaatttttatatttctgaccaatttatttttgctcttgtgtgcaaattcgtggcagttctacgcagccgtgatggcgtcggcgaccgggacagcgggggccgtggcgtgggtgggactgaaggggaactcccacacccggtggaacaagatatgcaacgtctacggcaagttctgccgccacatcggcagctccaccttcctcgccctcatcgccgccatcgttctcgtcctcctcgccttcctcaacgcctactccctctaccgccgaagccgttgattcattccccatgaacttgtttgctgccgccgcccccggaccgtagagttgcttgcttccgtcgtcgcatcgaccgtccgtgtgtggatggattcttgtgtttaattagtttttgtccctaagtgtttgaaacatttgggtggtgtgatgtttttttagtgcttgccggccgtatatgttagctgttgtctcacatctccggaaattcaacgttatcctctcagtgatatataatgtttcatggttgaactaatgaactagaacatgtacgttaacgttgtcgcattccgttgcatcaaattttactatcattcgttgtgtggatcgagtcttgtgtagcagaaacaaagtattccagttaggtgatctatatgttgttatcgaccgagaaatataatgttttgcaggtagctttgcgcctgtgtttacgtgtagcggctggccctgaaagcttacctatatacttcctccgtctaaaaatataagcatttttagctataaatttggaacaaagggagtactacatatatttgggtcatatatattaatttaatggtaaaatttatcgcatgacactaaaattttatgtaatttaatgggagacaccgcaaaatcacgtcactgtgttgatggacatggaaaaattcatgcaattttctgtagtacatgtaacatacccaaaaatttaaatttcaaattttgcatctaaaattattcaaaatgatgttcttaaataaaaatctaaaaattttccatctaagacctagatatgtctaatatagctagtgcgcttatgaaaaatttggaaacaatttaaaactttttccttgctaatttaaaatgaaaataaagcatagggagtgcttgcattttgcatgattgttttggtgtgacttgagtcctttgtgtctttctggatttcaaatgcactttataatataaataggtgtcatgagcattaagtagaaacttaaatgaactaatgtcgcattttcgaagatttatacaacttaactaattaatacaacatggcatttgttatattccataatctgaggtcatgtataagctaattataaatttaatgagtatttagttgcatctccatattaggaacacatggataacatcaaacctacacagattgtaaaacaaattggtgcaagataaaataatggaataagggaaccccagccagtctagagacgaaaagacgtggataagctgctagcgctgaatctttaggaccggtggttctctagacacgcgtcgcacatgcccagcgacacccgattcagccaaacaggcaaaattgtaaccatggcaccatttcgagcaggctgggactcgccaggcccaccactcaccacgtggtgagcatgctggcgcacccacctggcccaaatgtgagcccgaggagcctggggtattgtaatcatatttgttaggtaggtttctcggggaatttttggaggggactagccggtgttgacaagaaggccgaatgacaaggcaaaaagactagtagcactgtgagctccttcttatactataacagaaaagggacatgctacatagaaagggttgcttgtttctaacttggaaaagacaaagtttgtatttcaccagatccataccaacaaagaaacaggagtatggtattacacctccggtggcctgaacctttataaatctcttgtgttcatctgcttggcagggagcttgggccccgcagattgtcttcttgattgtcgtgtgcaactaacccctggtcagatcttcatttttagggaggggtcttctgcacttccctgttgtcggagaatcgcctctccaacaatgtgcaatgggaatttttttgtcacaggcatatataagttgcgtactgttaattccaatgtcccctttccttccttcattgtaaatacagctgaagcatgttgttttcagtaaattattaaagctaacaaatttagtagtcttaattgacacgcctagcttggctagctcttgtatgttatatatagccgcgctgcctaccagaggacctccgttgcttttccatttcaccatacatacacataagtttgtacagaagttccgttgttattgtttctttgaatgggagagggatctggaacggcgagagtggatcaaacaaacatttgagcctgaaacatagtgatgtcgcacctgtttaatttccatgaactcctaaactaatggcacaaagtaagggggacaaacatgtggaacatgcgtacatcagcacaatatgcttttccattattagtcccttagattccgttccatctgaaaaataagggaaaacctcgtgtttcgtcggaattgagtgattttgtttgctccattgagcaatattattttgtcccatgagcccaaacaatatccaaaattgaatcggagtatttctactctcgtttggtctgccaccagtagatcgagcgaccaccatttatggtgaattaacaagactaataatatgcccgtgctaaacgctacggtacaattctatttgtctttaataatttttaaaatttcatgttagcaaaaaaaattttatatgatttgtacatttgagctttaataacctccggcaaggccaggtctgttttgtgctttgtccgtgaacattatagctattcacttgacattttccccgtatcgttttactgctgattaatcacgttataataaaccatcttttcttgattcacatagagccataactgagcattgcaatgctataatcatttatgtaggtgaaaatgctaagtacattaaagcgatatgatggataagtcatgacattgcgtgtagagtcaaatatagatctgaaagacacaatcgtatgcaactgtaaaaaaaattggttcaaacgcaattatgaatatctcaagatatatggccctgcaatgttatgcggttcgtgtcaatgcccagagaatatatagggaacaataatcaccaatcgatcaacaatgcatagtgttatggattgaacaacccatgtcacgtgtacagttgcatgagctatcttctatatatttccggcgctacatataacttcgatgttcatttgtgttattcacatgggatgtctattttccaggcttacatctcagccagttctcaaagttgtgtagaatgaatgatgtctcacccaatttctccattatcaacttgttttcttcaaaagtagcaaagctttctatctacttcaagaagcactcccccagttaattacacttattctgcacatgtgtaaaataattagcaatccataagaagcatgcacacaagcattatagatagaagaataaaaaactattaaaaaggattcggtggctgaaaaaaaaatgaaaaacatactgatttaatcatttaagctcacagccaaagttcagacaagataaaaaaatggagctatctcagaatcattctaaagcttgctgtctcctattcacatgctttaaaatagatttgagtttaataattgcgcgtagtcttttatgagagtcgatggttttccatatccaacttgttatgagaaatgtgagaaaataaagttctgttgagctgtattttatagtcaacagtactgcagaaccaaatgttcgaagcaaatgcacagaaactttggtgtttttcccttacaaagcaagttactgaaaatttataaacacattttcaaatatgtgacgatacgctttgactttttagatggcttgctagcagacaagagcgaaaatacagcttcgtccgagctatttgatgaacgcacaagcacctcttctttatgaaactcaacagatccaactgatcctgtgtgccctaattaggatatttctctcaattaatttaaggctgttaccagaatttttatttcaaatgcttccttgaactacaacagttcggatatctctcaaatgcagctgatgtagatagccctaattgaagaaacagtatatttctttcgaagttgcaactcaattttttcttgcttttttacgtaccttcgtacatctaattttaggtttctactataccatagatacttgtaatccaaacatcctttttaagacgtacatgcaattggagaccactgaagtgaccagccactgccaggttgtggtctctgcttcttctaataagtaaccgggtttcttcagaaccgacggatcaaattctacactcattccaaaatactggcatggttatattatgcataaaaattcagaataaactgaaaggttgatttcaaatactacagagtgaggatggttattataaaaatttcagaacatgaaccagttgctaatccacggctgaaatccaaccagcagagtgagggttcaccctggagcaaagcagctgtgcatcattagttaccatggttaggccctgcaagtcaaatacgaaaatgaatcaatcaattaagctgaaagtagcgtaaaagattctaccttgtatctgaactctgaaggaagcagtatgattaaagaggatcacaccatccattatgcacttcatgaacagcatagatatccttattcattcaaaccccctgatctgataaatgaatcgatggagtcaacatggatagcagttttcatttcattttttaaacaacgagtcccccttcagcctgaaacaatgaacagtcacaaatgtatcaactttgatttaagaaaaaaatcatagaagtaatttagtttgttatgatagaccatcctctataaaattgcaactatcagtctcacaaatagagaactgattaatgattaggtcatgccatagactattcaattttagttctgggaagttcagttttctaaacatagctcaatcagctatataatcacacaatactccaagcaaaagagcacatgcaaaaatagtcctttatcgtctcttgttgactgaaaaagctttattgtctttcccattttttgaatggagtggcctgactatttcttatgacaccataatgaccagaacccgaagaaaacattgccaggttaaaactgaaccatgtattccgtaggctagtagcaacccatacagcagctgaatttttcagaaatgagagtgtttcatttcaccatagtttcagaattatattttcagaaatgtttagacaaaataataatctgtcccctgtctccatgagcaatcaaatttcgaagctggcaccataagttagcatcgctccagattctatttgaactgacatacaacttaaacgagaatagtgtaccaaatatacaggaacaactgaaaacatatatagggtgaataatgtgaggatatctaaaaaatgtggaattttcaggagtggagcttatgacctcttctgcattaagtggatgttttaacagcttgcttctcaacgctaaactgatctaccaagctgaactgcagagaacaggcaaaccatcataagatgaaagaaccggattcggcggtgactcttggaggagccatgggcgatggtcaatggcgagcggcaggaagcccaacgggagatcgaggcatggggaatcgacgatgcaggatgacgatttgcgctatgaggggccggcgacgagcggagacaggacaatcggcaacaatacctgaggatgagggtgagaagggaggggatcgacgacggggaggctcgtgcgacggcgagtgggcgggtgacgggatggatgtgggcgtgaggagggtgtgcgaatgaaaagggggaggagattggggcggtttccggcgtcagcggcggagacggcggagggaggcgtgggagggaggtgcggtttctggaagggttgtgggaggaggaggtgcatggggagggggcgtgggaggggcgcgatcgggagggaggcgtcgatgccgtccgatacgactcatcagattaatttggataattggatatgtgacatgatgaatgatgaatgagtaaaactatttgtttaactatagcctagactagtactaagatcaccttatactatcttttatgccggcgtttttctttagaccaccattcagctaatgttttcactttagaccgagtaatcttgcaattatttcactttgaagcactccgacttgcttcttaaccatatgaacgaccatcaactacaccagctcctattcgtaataaactccatcagctatatatgttgaccgttactttgacatatgacaaattggatataaatggataaaagagttgagagtgatccaaagtaccataaaggtaaaattacccggtcgaaagtgaaaaaattagttgaagggtggtccaatatgaaacacgagtaataaaagatgacccaaagtatactcaaatctgtattatagatatgtgaatggaaactctgaaataaaactgttccatataaggttcgaggagcgagcaatccttcctagcaacatcatttaggaatgcaaactatatcaactggtgatggtggtaattcactctgagggtattctggctgtagattggcaagtaggctgaaacagactatgacagttgtcttggcaaaatataatggtagtcctaattgtcttcgagtccaataatgaacaaaagatatataaaccaaaatgccatacacaattggaattcatacacaactaccagctattgctgctctcaaatgtcaccattctagctatttgctatcacaatctccacagctctccccatacacaagtggctcgcctgcaacctaatggccccctttacaaaaaatgatttgtgtagtaatgaatattaagttagtaactcacagaatcacagtgacgaggagtacattacaagcgacgggcttaatttgcgataaatttgtagtccaagtctgaaacagtaataagtattggtgagcacctacagcctcaagcctagcagagcagagctagccatccatgtatacgcatgttggcatctgttcagaaaactgcttcacctttcaagatcgttatcttaccataacaatttctgctccactcccctgattcaatctccagaaattgaggtgacaagatagaaaaaaaaaggaaacaaaccttacaatgtatctagaagttaaaagtagacagaaatttattctataaattaaatatgtaagaatggtacaggtattgggaatggaacgacggtcgcaagcatatgctgcctgggctgtccagttaacatgaagaagacacatcttaatcgttttctcctgtcacctctggcatcatatatattgctattttaattttgttcttaaaccatattctatgtccaagctaaaaataaacatgttattccagtactgtgatgacagaaagaatggctcaaattacatatatttctcaataatctgagtagtaccaaatttagtattcactgtggtttaaggactatttatgatcataatttccatgtttatctagaagcatttatttcttttgattggctaatatattagtatagtattatgtttatcaactttatatttactcaggtctaaactttctaaaagacgagaatgggctatgtcaatttgtacttcactaaccgtaagtctgtaaaactacgagctggagtatatatgttttatataccatctacactgccatttccatttttctttgttatacctcagatatatgttagcaaccttcttcaccaaattaaatagcaacaatctctaattcaactcaatcacatgtatttgttggaaagtggtaagaaataagctatacatgattctagaaggttctagaacattatagaagagatagtatgaggagttgagagggatagagacattcacaaggttcaattcatgcgtaaccagatcaccactcccgagcctctaatgcctttcttctattcgatgcccataaattcagctgcacaagcttttgttccctatcacttgggcttgcttgggccttttgtgcaagagcacctaacccagcccatgatgcgcccattcgtggcatgaattttttttatttataatttttattattaaaagttttacaaaaataattttccattttgaaaattgacggaaatagtcgcctaccgccct

SEQ ID NO: 71755 - DNA, 2882 bp, Oryza sativa
atcgtggattctgagtcgtcgccgccgctgctagggttccagatgagatggaatcctctctctctatatctcgcggtgatgttttagggtcaccataatccgaaattgctaattagcgcccagttgcgctcccccctccccgcgcgcgactgggcacgtggcgcgatgggggagggggagggctgagcgacgcgatgggggaggggtcacgtggcgctggttggttttttttcggttttttccgtttggtttttttccggttttggttttttttcttttccttttttgcggttttcctttcaggttttttctttctgatttttttatatatacgtatataaactttttatatgtacgtatacaaagtttgtatacatgtatacaaactttgtatatacacatacaaactttgtatatgcatgtatataaagtttatatacaaacttttgtatacgtacatatacaatgtttgtatatgtgatgttttttttttgttttttcaattttttaatacgtacatatacaaagtatacaaagtttgtacacatcgtatataaagtttgtacatgtatatatttcttttgatacattagaaatatatattttttatagtagtagtactaatagttatagtagtagtgtagtactagtagtgtactgtagtagtactagtactactagggggcaccgcacggcaggctgggcgtgcgtccagtcgcttgtggcatcatcaatgtttactacctactttatgaataagggtgggccctgcatcagtgggtattagttgttgttgtagccacaatggtgaaagaataaaagtgggtagtaagctggaccccacaatcactagccatgagagaaatcatttgtttattccttatgactaggtagtaagtatatgacctggtattagttacttactactcccacaatgtatacaacctggtagtagtagtattttattctttattatccactttagatgtacattgtagatgctctgagtggatgtaaatccggctcctctaactgctagtaaagagtatacaaaacagagttaaactaggaccactaggagggatatttcttgcaattgtctgtagcaggttcagtcacgttggcgacaaaaaaactaaaaaagtcacaaaagaataaaagcaaaacaagtaattcctccgttttacgatgtaagtcattttaacattttcattaatatgaatgtggaaaatggtagaacgatttatattgtgaaacggaggggtagatatttagatgtgaagcatttacacatcatccatattttgctcctcaattttgtactacttatcgtacttccttgtacgtgcgattccattcattacttcttgtttgggtaaagactatcttatcagcttaagtgattgcgatgtgttacccacaccatttaactcgaatggataaaagtcatgtgacaccaacatcattaaatcttaactaattaaaagattcatatttttccgttcgtcacatgattttcgtccgtatgcacgatttttcacccgtccgtgcgatccgtccctcccagagtccgagtctgtattaaaaaaaaatccccgagctagatccccaaatcaatcaatcaaccagacaaccaaaaacaacacgaaaataccaaatttaaccttaacctcatgaatttgatcaccacaagaaacctaatacccatgtatttcctccctcccaatccgatccgatccggcaatacagaaagtcaaacaaaggcaatcatgtatgaatttgctggcaaacaagaggcagcaggaggcacgtcgggttgcaggcgacgtgcggcggcggaagtgtttggcgcggtcgttgggcttgttgtaggatcgagatgtcgactagaggggggtgaataggcgatttaaaattaaatgacacctaatcaaaactaacctaagttactaggctcggtgagggacaagactaactaagcaactaagttatgttttgcaatcctggggtgaaagtggctcaagtatatcactaggaaagtaaatcacacttcctaagtctagtttagcaatcctagggtgaaatgatctctagtatgtctctagaaatataaattgcacaaatgtaaatgcaacaagtaaatgagacaaggagacgagatttttgaccgaggttcggaaactcgccggtttcctactccccattgaggcgatctcaactccaccgctcaaccacgaagccaccgtacgcccccttcgtcaaggggtgggcaaggcgggagccggcccacggagaggactacccaagcctcgatcactagggtagttcttccttcactccgaaggtggtgaacttcaaaccactcacaaaccggcaccgggcctcctccacaattttctcggagaggtcaccgggaaactcctccacaagccgtctaggaggcggcaacctccaagagtaacaagcaatgacccggcgtggagataatcaatcaagtgccacactagctctacaatggaagcaaatgcacttgactcttggctagaacaacctcaaccactacaatggatgaacactaagctcaaaggtgtgtgagagaggtgcaaggggtgtatgcaattgaattgggtgccaagagaatccccttgttgctagagggggagtatttatactcccaccaaccaaaactagccgttgggggcgaaatcccccaactcagtgctctgccggtctgaccggaggtatgtggccggtcagaccatactactctacaacagctagttttctagccgttgcagggctgtcattgggccccactgcctaggccggtcagaccgacttggggtggccggccaaacgggcctcggtaaagtagaccgcca

SEQ ID NO: 71756 - DNA, 6838 bp, Oryza sativa
tgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcggttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaataccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgctcaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcatatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaatatagagcacagtacaaaatcgc

SEQ ID NO: 71757 - DNA, 9341 bp, Oryza sativa
tgttgttttcaagttttaaccatgtttaaagcatatgttaggaaagaacaccctacaggagcgactggcggcggggagggcgacggcgatggcaggggcacgccgcgctgggcggcggtggctgaaggtggaggggatggcgatggcggcggggacgaagtcggccgagggcgtggaggcggcggcggcggtcccgtggcggcaacggcgcggtgcccagcggcgacggcggcggtgtcccccaaatccacgcctctcggccggatctagagggtggctagcggcagtcgcggcaggtggctgcggtgtcgactggcgacggcggtggaagacatggcgtcgaggcggctgctagctgctcggtggtggagggtgacgacgcagtggcggtttgtggaggcagtggctggtgtcggtggcagtggcgacggcggccatgactgtggaagcggtggtgatgtcggcgtcggggaaggagtcgggtgcgaggtgaggatggcgacggtgaggtggctgggtattcggcagcagcggctgtggtggtggtgagcgtgtctgcggtcaccggaggcatggcggcctcggttgactagccgagggcatgggagacggctgcatctggccggcacggcatcgttcggtggaggggtcggagactggcttggtgcaaagaagtgcagccgatggcaccggaggccggctcggcgcgagaggcgcgggcggcggagatggaggtcggcttggcgcgagaggcgcggccgatggagagaggccggattggcgtgagaggcgcgtccagtggaggaggccggcttggcgcagagaggcgcggccagcggtggaggaggagacctaggtgtgaggagctgccggtgggtgtgacgcggccttcggtgcgcgaaggctagctggcgggggacgccggtgcaggggtcccacatgtcggcaaagcttgtgtggtggtggagcatcgatgcgtcagccgtggtttcgcaggtggtgagaggcgggtgaaaacccagtctagccttggccagaccgacaacgatggttattccccctcctgaggcgttgttgtgctgtctctctcctcaagggtgattgctggtcgaaagcccagtcttggctcttttgagtcccgacggatggcggcggcggttcttccgtatggcgcgatctcgtctgtgtctctttgttggtctagtggcggtcggtcacgcttagcggcggccggtccggtgctagtcttttcctgggcttgtgtgttggcgatgtcggtgtgtgggtggtggtatatttttttctttttcctggttacgaccctccatggttgtaatcttgtaattttttccggctctatccatagaacttcgcaccgtctcgtgcgagtcgttcaaaaaaaattagtggttagactacaaggtgaaatgagcaattgccccttcttatattggaaggaacacactaaaagtctaaaactatatactctctctgttacaatttacttgtcatccaggcaaataccgtgcaaaccatgaagatgtgaaagattacatggttacccttgtcaaatagtactccctccatactcataaaggaagtcgtttaagatagcgacacggtctccaaaacacaactttgacttcttgtttctataaaaatgtttattgaaaaatgatatacgtatatttttatgaaagtatttttcaagacaaatatatttatataatctttacattttcaaactcaacaactttagagttattcatgatttatattcccaaagtttgacttgaacattgtcctaaacgacttcctttatgagtatggagggagtacatcttaattaattatcttttcaaagcagatgagccaattatgaccgcatcaatatgtattgctacattactataggtagggagggaataatatcaatcacctttaaaagttctttggatcgtgaaaacgacaaataatttaatacaaaattaaatcctagaacgacggtgatgagcaatatgaaacagaaggaagaacatgaataagcagtgcacattctagttgttcatgcctctgcttaaatccttccatgtcctttctccatttgagttatgcatgtcccggcgacataggaggattgtgtcccccgtttgggccgcctgaaatgtactcatattaagtatggacttgaagagttggagtgacatcaattccaattaatcgtatgtacaaaagaaaataatattcactctggttaaaaatacgcgtccttttggttttcaagaaaggtaatgtattttctaatgtaaaatttagtatccttaagtacatcagttacctagagatattagatggggataaacgaagacgatgacctgagggagagaggggaccgacctgagaggtgatgagcagcaagcggccaaaagctccattggatttgtaccgtcatctaggtttggagcccgcgacaacagcgaggttgagcgaagaacggcctggcaacgtacggctctcctcttgtcgctgcagccaccgccttccttgacgtctgttctgtcaccaccggcgtttcttcgatggcggcggcaatagagcgcgcagcagcagctgttgacaatggcgacgaagaatgcaatggcggcgctcagcaatggcggcggcagtgtaggacgttgctggggcagtgctcggcgatggcggtggcggaggagttggaggcagaggtggcagtgcgatgaggaggcgtaggcggcgcttggcggcaggggggggggtgtgtggaggcggcggcgcgacggggaggcggcaaaactagcgacagggacggtgtgaggggaggtggaggtggcggcgcgggagaagtagagggagtgggagtgggcggcagaggctgttagagtcatatttgtattgggttcggtttcctaattatctcctgattctgttcctataagtcgggtagagatacgggtccaccgtccctatatatgttctctatccatgatcaatctattatcgtgttgacttatacgctttcatggtatcagatgcttttagcttcggcctccaactctaaatctcgcaccgcgccatgcgctcctctgctgtgcacgcttctgtcgccgctgccgcagccgccgccgccgccgccgccgcatggctcctttgccatggccaacaacgctccccataccccctctcccgcaattgaggccaccacatctgtcatcaccaaggcagttcgggatgccttccaaccctcatctagggttaatgtcgacctagccatagccgcctccgtcgtcgacacggcgtccaccactgttgcctgcgccactaggaaagcccttgcctctttcatcgagaagctggtactgacacctccatcgccggcaacacccaccacggcggcaactcttcttcctcggccgcgactgccaccatgacggctgcgacgatgtctgccaggctcttcaccactgcccccgcaggcacgacactgccgccgacctctctcccactaccgccggagctcacggccatccttgccaccgatggcctctacggcacctccgacgcctttgcatccgctctgcctgctcaggacgtctctgccttcttcatcacgcccagcgctacatcggcaacactccctctactgggtcttcctcctccggcagccggtgcaccaccaccacctcctcccggctacggtggtttcatccctctgatgaccggtgctgctccttctgcccctaccgcctagaacttctacaacgtcgacctcgacgacgacgccaccgccaatctccacgctcaggcagtctggtgctgaacatcaagtctctcgtgcccgtcaccctcgatctcaacttcggcaatggtgtggtctcatcctcgtcaccctcgagaagtacgtgctcgccgatcatgtcctcaccaacctctacaggccggatcatcaagattggatgcgcatggactgcgttcagggccggccctaggcctagcgggttgtgcgaccgcccaggcccagccagcaggggcccatcaacccccacccccaccccattccccctcctgctgcacaggccttgcaggccaccccgcagcccagttggcgtagcgtgtgcgatgcaattagtagggaaggagagtaggagatgcgagagtgcgacgtaatcgaagcgacgcatcatcgcgccggttcgttctctgtgcttgttgttcctcctgacgatagccgacgcgacgacgtcaacgccaaatgatgcccccacacagtgagtccgcgacgcgacgccgacgagcgagggcaactgacgacggcgtgaccgcaagtgtgatcagtcacaactccggagtccggaatctctactccggcagagacggcagcagcaggcgctagcgctcccaacgccctagcctccatccaggcaggcagccagaaacctaatcgtgactggtgaggacttctaatgatttgattttctcttaatctcatttgcctctaaccatctatttagactgtgactggtgaggacttctaactaggttagggttttgttttgtgcaaaaattaggttagggtcttgttttgttcctgttgatatagtgcaataaacttctaatgatgttcttgttgtttactttagttggaaatttcaggcgtcagaatgttgcgtcagaaatgcttgaagcagagatttttatgagaggtattgtatatttgcagtttcatatttaaggtattaataatcatactattttgtttctacaattcttttagttgtttattatactatcagcaatatttattaagaataaaataccatatcgcaatttgcattgtgtaatttactgttcagtagtgtttattaatgtcactttataaaaaaaaatgatttatagagtatatattacaaataaaaaaaattagggcctatagcgtcgagtttgcctagggccctcgaaattataggaccggccctgactgcgttgtagttctgtggctctacggcaccatctccatcgacttactggagtccgtgatgacgcacaacaccacggctcgcatcgtgtggcgtggcctcaaatatcagttcttgggcaaccgcgagtccagcgctctcatccactccaccgagttttacatcttctaccaagatgatttgagcatcaacgactactgctgcctcttgaagaccatggcagatgacttgggtgatgtgggcgaccgcactctttccctaactgcaatacaagatttgaatgaaaaattcggtcaccttctgctcaacttccgaagtacatgctcaacttctgctcgaagatctgacgaagggtcgtcctcgctaagcttctactgctctcctcgccggcactggagaccgaccttccacttccggggggggggggtgccgttaggaagcaagcccgcacactccactggctatggcaacgctggaaatcgtggcaacaacaccagtcgacatggaggtaacccgcaaccgtcgctgcaacaacaacaacagaggacaacagcagcaaccgccccagcagtaccaaccacccagtagcagtggccagtcagccaattggccctcggcactcaacccgtggaacggtacgctccagatgtggccggcattggtcgattttgctccttcccgcgtcaactaccctagcctcctccgtccaccgctgcccaagaacacgcgcattgtcaggggcttcctcggcttggcgggctactaccgttgtttcatccgcaacttcgacaccattgccgcgctcctcacagcgctgctgcggaagtaggactttcactggactaacgccgcgacatcggcgttccggcagctacaacacgcactcacggcagccccagtcctccagctcccggacttggccaaggagttcatcgtggagtgcaacgcgtcgggctccggcctaggcgctgttcttcatcaaggcaccggcctggtggcattcttcagcaagctgactgcgtcgcgccacgccaagctcgctgcctacaaatgcgagttgattggcctcgtccaggcggtccgccattggcggccatacttatgggggcgccgcttcctcatccgcacggaccactacagcttgcgcttcctcttggatcagcgtctctccactgttccacagcatcagtgggcatgcaagctcctcgggtttgactttggcgtgcagtacaagtcgggaatggcgaactttgtggcggacacgctctccagacgggacgaacacctagcggaggtgttcgccttatcggcgccccaattctccctgttcgatgagctgtcccgcgaggtagcctccacacccacccagttccccattcacgaagacatcgccaagggtgccaaaccgccagcctgggcgttcacagacggcctcatcacattcaagggctgcgtcctcgtgccgctgtcgtccgcatcattgccgaccatcctcgagccggcgcatggcttgggacctgaaggaacacaaaatgatggaataagccttgtggtctttggtctttgtggtccttcccttgcttttaggttgtttttctccttttaggatagcatcctttcagttttgcttttagtatctttcagttttacttttagcattttagtacagcatctctgctagcatctcctttatgctttatgctttcaaattttgaattttagactagcttgcagccatccagccagctatggctatatatatatcatatatgtatccaacctcccccgggacggcatggctttgagtttgtgaatggaagaaaaccagaaaattgcccatctagagtgccatcctcttatcaatgagagtaaccattgaaataataacatctggtatcagagctacactttcctgtagactaaatatctcgtgttcctccccttcccaagttcgagggagcattcagccagctgctgcagcagcaccggctgctccttcccctttcccttccacttctccaagaagcagcccccggaggcgtgccatgtccgacgtacggtctcggcgttcggtcgcctcgagccctcggcgtcaacaggacgtcgagctcgccgcagcagaagagcgcaggcgagcaacggctcagaccgctgcagcagcagcgagggcggccatattggcggcagcggagttggcagcggccagggcagaggcggaagcagaggaggcagaagatgcggcacgtgcggcggaggtagaggttgacacgttgcgcagcagcatcaatggctccatcgccggtgacatcaccgccgacagggagcttgaagagctggcaagaggaagggcgcgggagcgggcagagcggtgggcagcagcccaccccacggcggcggcggcccaagagaccgcgcgcccgccgacgggaacccgagcgggcgcgggcgtgccggcggcagcccggagcacgcgcgcggcgacggtgctcccagtggaggtggctggttcgacggagagcgcggccctcgcaggcaacgcggctctccctcccctaaccggcgacatgaccaccacggtgtccagacggtggtcagggaccttggtcccggtggtgggtggcctaccctctacaaaaccaactacatcgagtgggcggcggtcatgagggtgaggctccaggtgcggtacatgtgggaggcagttcagtacggcaacagcgactacgacgaggatcaacgaccgctggatgccctcatcgccgcagtcctacccgagttgcagttctcgctttctcagaagcggactaccaaggaggcctgggacgctatcgctgcggcacgcatcggcagcgatcgcgcccgcaagtccacactgcaggcactccgcaaggagtgggagaacctggccttcaagccaggtgaggatgttgatgactttgccctccgtctcaacactcttttgcagaagatggtgcagtatggcgacgacacctacgacgaggagagagccgtcgagatgagccacagcctctctcaaggcctatcaccactggggggagctccatctcactcaagagcagtgggaggccagccagggagacgggaggaagggggagtcatctcccctgacaggcggccgcaagccgcgcaaggcgcggggaggtgtccagctacggtgggcgcggaaacgcgccgagggtggcgcttgcagaggcacccaaggcggcgccgccggcaaccacaagccggcacgagacgacgcctgccgcaactgtggcaagcttggccattgggccaaagactgtcgacagccacgacgcggccaggcccacgtcgcacaggcggaggaggaagagccggttctgctcctagcacacgcaagcatcgagctacctccagcggcaccggccgcaatagctttcctccaccttgatgagccaaaggtactcctctccctctgcaacggctctagcgacgacaaggctgatgggtggtacctcgacaccggcgcaacccatcacatgaccggccgacaggagttcttcaccgaacttgactccagcgtccaaggctctgtcaagtttggggacgcctccgacgtggagatcaagggcgttggctccgtcaccttcactgccaagtccggtgagcacaggctgctcaccagaatctactacatccctgcgttgaggaactctgtcatcagcgtggggcagctggatgagaacggctcacgcgtgttggtcgagcacggagtcatgaggatttgggatcgccgtcgtcaccttcttgccaaggtaaccagaggcaccaatcgactctacatcctcagtgtgcaggtggcacaaccggtgtgcctcgccgctcgtcgggacgacgaggcgtggcagtggcacgagcgctacgggcacctccacttcgaggccctgaggtggctcagtgccaaggagatggtgcgaggcctgctgtgccttgaccatgtggagcagctctgcgacgtctgtgtggtaacgaagcagaggcggctcccctttccccagcagacgagcttccgagctaaggagcggctcgagctcgtgcacgaggacttgtgtggcccagtgacaccggccacaccaggaggacgacgttacttcctactgctcgtcgacgacctctcccgctacatgtgggtgatggtcctcggcagcaagggagaggctgcggacgccatcaggcgtgcgcaggctgctgcggaggcggagtgcggccgcaagttgcgcgtgctgcgcaccgacaacggcggtgaattcacggcgactgaattcgcgtcgtactacgctgatgagggcattcagcgccactaca

SEQ ID NO: 71758 - DNA, 2830 bp, Oryza sativa
tccaaacaggcaccgacacaccactgagcaaagattattacagagcccagttaaggctggcagtaagagactcgtggtatgattgaaaataacaaagcagtcagctgaattttgttccatacgaaaagtgtgaacatccatgcatgcttatgcttctaccatgctggtaaaacattatggtacactgttcacctattggcatatactcctacataatacaaaggtggtaaagatggaatgcagatctgttcatcaaattcagagtgatagaacaggggcctcaatccccatagggaaagcaaacacgatcttgaagaagcttccaaaaatatggactccttccatgttttatccatttgtgtttgtaggcaaaagctcaagaatttgacatcctcatcaaaaaggttactgctggaaaaacaatactacatgcacatgaatcctaagctccataagttgtcattgtggtaaaagctgtgctatactgctatggatgtgtcgacacaatttccgcccttaggtaagctggacaacgaggtttaggcagcagagcagtctggcagcttaacatcagaacaacctcctgcatggtgggccggttggcagggttctcctccacacacagcagtgctatgtgaatgcatcttagtatctctctcgtctccaattcatcacctgagggcgaatcgacaagcttgatcaatcttcctgttctccataagtgccatgactgaggaagtgggtaagaaaaacaaaaattctcatatagattggccattaaattagcacttggttgtgcaagttaataaatgatgacaggggcaccattaatattcaaaattcgagacaaatttcaaaaattctacacaccctcttgttcagaaatcgatagtcgtctccagaatctccactcacaagtgaaaagcatcgctttccactaatgatctcgagaaccaatgctccaaagccatacacatcagacttcgttgagaaaagtcgtctttcccgacattcgggagcaataaaaccactaaaatgtggaaacaaaaattaagagcttaaacaataagaaggataaaagagcccgctgggatatcaaaaattgtgatattgatctgataagttcttacattgaccccagtatgcgatcggcgtactcttcatctacacctggactataccttctagccaggctaaaatcggagatcttgggattcatgttggagtccagaagaatgttgcttggcttcagatctccatgtacaatatgtagtccgcagtgcttatggagataaagcagtccctcagctatcccatcaattatccgagagcgtgtagaccagtccagatgcaaccttcttgttcttgcacctataaaatggaaacacaaatgagatcattaactaagcatagtctgcacagaacttttgatccaaaattgaggtgaagtaatactgaacacatgccaaagatgaaggtatcaacgcttccaatcagcatatactcatagaccaaaatcctctctgttccctgaatacagtatcccagaagcttaactacattggtgtgctgaagcttcccaaggaagcaaatctcattttggaactccaaatcttggaaatccatttgattacgtgaacaaggtaactcaaaacatcttttaacagctacctcaagcccatcgtgcagttgaccctgactgcaaacaaaaagtgcagttgacctaaagaagaaaccaattatataataatgaagtttctaaagttacaacacattccattgtcgtttgatagctatgatttttgcaatatcctcaaagattaattaggatgaattggaatcacagtaaacacatgaataacagtaggaaaagcaaatgatctgtttcttatgatatcaaagtatggaaactgaattttgtgaagcaagcatattcattactcctccggacaagataaggtggttccttttttactttgcaaagtcaataagaagtcacttcaaccaattaatttttcttggcttgtcttcattgaagatgtatatgaaaaaaaataatcatgttattttggtaaatccaaattacatattctagatatatgtctcactaaaatgaatagaagatgattgaacgcaaatctaggatgacattttttttttctattgaagagagtaccttgtaaacacagccaaagctaccttgtccaattttatttccgtcggagaagttttctgtagcatcaactaactgggacaaatagaacttgacagaccctgttatgaaataaagagttttgggacacacaacatcattctatttggcacccatcgaactctattgtctcccttcattctactgtttaacgggacatacctgtacaacatgattgcagtgagcacctttcaacttcacaatgtgcttcaatcctgcggtggcaacattattgtgactatttacggaagaaaatgtagcctttggatattaaagatccatgtcgaaagggttatagatgccataaaatttttacatggatctttcactgaacaatttcacttaagtaggacactggaaaccatttaacaaaattctgaattatgtgacagactataattattatgtatctattgtggaccagagaatctgaagtctcaccatggatgtaaactaccattggagctttaaattcaaggaatgccacatcccactgagaaaaaatggcaacaagaaatgtgttcacaaatctcacctggcatcaggagggaagctcaagcaaccagtagaactagatgttgcataaacattaaacagccttggccccccttttacagc

SEQ ID NO: 71759 - DNA, 3556 bp, Oryza sativa
caattagcgctgtcattaattaccaaaattaacaccgggggcctagatgcttcacttgtggacaagctcgacgcgggccggcggcagggatagcatcaaggcgaccggcgcatttggtggcggcgtggctctgaagcccttcctcctgctagatctggcggagggagggcgcctctgggcggccgccgctcctcccgccgcacaccgctgccgtggaggggagggcgcgaccatcactaccgatgccgcctcccgccgctgggccgcaccgtctccacctgccgccgccacctgtcgtccgccgcctcccctcttgcgccgcggcctgccgcctcggctccgagagagaggagagcaaaacgagagagaagaccgacagagaggagaggaaaacgagagagccttatttcctcggtgggccccgccgaggggagggcgccgtcagccgggcggagggcgccgtgcgagggggacgggaagcggcgcactggtgaggggagaggggagggcgtcgctggctgcgacggcagtgggggagagaacaccaagaaagaggaaaaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcataaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggtttttgtcgcttcggccgacacgaacgcaagacagtaagtatagttcagttcctcttcagtatttgttgctgcagtgctaattttgatgttcttcttgtctatctctgcagctgctggcctcaatgggattgcaggtagctgggacacggacaccaaaccatcgaactgggggaatggcaacgatccatgtggagacaaatggatcgggataatttgcaccgggaaccgggtcacgtccatgttagtatatcagcatcagagatttgtatatgtccatggagtgatttttttttcttgcaattatgcagtaatatgagtaacaaagatcactcatgttgtcttcttgtttcatggtgtttttacagaagactgtcaagttttggattgtccgggacgctttccggggacattcagtccttatcagaattgcagtacctgtatgtattctcttctctctgtagtttgagcactttggattgcgaattaggcgtaaacatgtgcatagttggaaatttggaaatttatgcaaacttctgaaacgcttctgtttttgttgcagggacttatcctacaacaagaacttgcgtggaccccttccttcaaccattggaaccttgagcaagctccaaaacttgtgagtagtttaactttggagaagttcagttagtctgctaacttgagatttttcagtcagttcatggattcttgtttgacttgtcccctctcatttctctgcagaattcttgttggctgcagctttactggtgaaataccaaaagagataggccagctctcaaacctgatatttctgtagggaacttagacctgattcttgattatgtctaaaatcttaggcctgcggtcgcattccctgaacttctctagatcatatctaatctgaaaatagaatacatctaatagatttatagtctggttgaaaaatgttttaatataaactccatcatttgaaaaataaacaatttcgaactttattggttggacttttacctcagaatttaaagttcacctagtgatgtagattgacatgatggtaacattgtatattttaatcctaattttaaaatatggcaggtaagattatttcacttattagccaaccatgcttatacagagtatccattatctaaaaaaatgcttgtacagagtaaacagcaaggtaaaaattaattaatttcctcctgtgagagtattacctccattgggataataggaataacaaccaaatggatggcctaaaaagcttaactacaaaaaaaatcctataagcttgtaacaagttacgaacttgtatctggacatttagaaagataagtgtgatgcagttaaaccttttcccttttgggataatcaagtaccttaggtatggaggaggtggttatctggttttattagttggtaatattgaattctcaggcctggtgttcatctattatattattaaaacaacctttacagaagtcaccatattcaccgtgaaa

SEQ ID NO: 71760 - DNA, 2365 bp, Oryza sativa
gtctgtagtaatgttggatgcaagattactgaattaggatggggagaaaagaaggtaaaccttattgtcaatcatgacataaacagacagattatcatgtgaaatctgtagtaatgttgaatgtaaattaagcaaatctttgaacatggtgttgacaggggggcaaacaaaatgtagtacctttctgagaacggctttctttcttgctaacttctacttttctcacttttggtgaagctgacttcaggttttctccttaacgtcagcaacagcattttctgctccatacaccttcttgttgctcttcactagggaagcaggtttttctttcttgactgctctcatctttatgctcaaaagggacttggatgacaagtttatagaacgagacagtttcactggacttattttctcttcttccttcttttgccaaacacgagcattcttggcaacattcatcactgtcatctttctgtcagtttgtttctctgaattaactgatggagatggagcatcatttgcaaccaaggacttcagctttgattgcctagtaggtttggaagattgatccatcacagtagctggtgatgtaactttgatctccttcacttttggtacattcgatgcgacggtagatctgaattcttgtccctattgaacttggtggctctcactacctttgatccattggagctttcaattgttgtacctgaagctttccgatccaatgttcttacaattttctggcttgacgcattgcttcgcgttgcagtcgatgtctctttcaccttcggttttactgaaacattatacaaactcttcgatttagttccatgcccagatttttcacgcttctcggaggccatcacaatctgagtgctcttcttctctgaacctgcacactcatttcctgatccatcatcacacatgtcatccacaagtaactgttcaccagctttgtacacacattcaggaggcgaaatggcatctgcgatatgatcgtcagacgcgtcactgtcctggatggccaacggcatctccagctcaatgcttacagctccctctgatgattctccatccacaaaacatgcagcattgccatcagggatcaagaatttatcatcaccacatggcagatcagctccatcctcaacacgtttggattcttcagctgatgacaactgatcttgcacgcatggtgaggtttcagagttgtcagatgccatttcaataggcggcttcttcacctcgatgaattcaggcttgtcatgaacattaccatctttcacaagacaaatcttcagctccaggtccttgtttctggatctgcctttttgtgtctggatttcatcctggccttgctttccgcacccggcattggcacggtcctgatgtcgcctgcgacgaacaggccagtacttcttgggttcaggggaatgatgtgccccaaatttgcagctgtcatggcaagaaccagtggatgctctcaggtaatgtggcactgacttctccttcctcttcaggtcagatggcacactgctgacatccacattttcaagagaattcaccgggaaatcgccgcttgtcgatttagatgattcgggagttgagactatgataacctctttgaccacttcctctgtcatttaggagcacagatgctgcaatttttcacaatgcagacacacatgtgagcacatgaagaactagcatacttacatccgacacaagcacacaacaatgtaaaatgtggagatcgcagaacatacatagcatgataaatacagaactttaatcttctatttatattgtattgctgcatatgcaacactacagtaggtttgggttgcctacttgatgacaataggagccacataattcatcagcaggacatgcaagttaatcagataattaatgagtgaatggcatgataaatccagtcctcaaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagccgccgttctcgccggcaaaacgacggcggcgacagatcgcagggacagaaagcgagcgaatcaacgagcaacgagcagatataactgaacggaatgattgcgaggaaaatggagatggaaagcgagagagatttggagagaatggagaggtcgct

SEQ ID NO: 71761 - DNA, 2906 bp, Oryza sativa
cagcattaatatatggtcatacctatcatacacacattgcattttggagtccatgttgcagctggctacttatctgtatcctgttactctttttgttatcttttatcttctcgatatgtgtttatagttggattatagtttgctattgtaccaactctaatagatatatgcagagtgaggcgtatagtaagtatatcggtcgttgtcgtgcacggacgcatatggttggctggtcgccgttgctatggctaactagtactccctccaccctaaaatataagagattttggatgaatgtgatagattctagtattataaacctggctttctattcaaattcacagtactaggatatgtcttattcatagaaattctcttatattttagaacacaaggagtagatacttctccggtttaacactataagccattttagattttgaacggatatatatatatatatatatatatatatatatatatatatatatatatatatatatggtgagattaaactacagaggaagtactatcttcgtctaaaaataaatgcagttatgaatatttgtgtacaatgtttgaccacccatcttatttaaaaaattgttgaaaaaaataaaaaattagtattattcatgttttatcatctaataacaataaaaatcctaatcataaaaaaaaattaaataagatgaacagttcaacgttagatatgaacaatttaaaactatatttattttagggaacaattcaaaactatacttagtttgggactgaggcgcagcagtagttactgtcttactggtacgatgcatggatggtgtgcttaatttgacatgtcactaaaaccaagggtccatgcaggtctggaggagtcaagcagaagcggcaacagacttgtctgtccaaggagctctaaattaacactgtactgcgcactctacacgtctacttcctctgtcccataaaaatcaacccaataccgtataaaacactgtactgcgtatactacatgtctactccaaacataaatatttgtacaattgaaaatttatagatacaagttataaacatttttagttacttcattctcgccaactactcatgttttaatttcgttatgatttctgccaaccagggatttaacatgggcactgaaataattttggcaaaatttgctacaggacaccctaaaatcgtgtaattggctgtgggacaccgtaaaatcttggctttgcccacggacactacgaaagttgtgaaattggctgtgagacgccggaggcaatattttataatttccgaggcaaaagaggtcagaaaattttctaaatgaccaatctacccttgcgcgccgctacctctaagcctgactccatcccccctccctccacagcctgattccccattcccaaacctaaccctaggcgacggcggcggcggggccggcggcgacagcggcggtggcggggccggcggcggaggcggcagtgttgaggacggcgacgacggcggcctagtcggcttcggttggtgcggcgatggacagctcggcgtcatcttcagtggtacggcgccgtggtggtggcgagttgcccttgggcaaatgtccattgtgccactgatggggattgttggctcagaaatgaagggagttgaaggagtgggacgaattttagtgtaccttggagttgtgcaagctttattattactgttgattttggtagttgtcattagcaagtaatatggactgtaataggcaatttagtatttggaagcaatgtaatgttgaacttatgaatgccctgtggaattaatgaatgtagtatggttttcagatgaaatgcagccattcgaatttggtttgatatggcatctgagcaattggaatttttgcagtactctgtgatgttgctttgatatggcattgagtaatagtgcacagcatttgcagtagtatatggcatctgagcaatttggacaacatgttgacaaaatttggccagagaaaaatttggacagcatgttggcaaaatttggccagacaaaaaattggacagcatgttggcatctgagcagtaaatgtttgctgtctgaaacattggcaaaaaatttgcccagacagcaaattgacagtttggcaaaatttcagacagcaaactggcatacatccatacaacaaacatttacaagcatgttggacagtaaacaaaattttatacagcaataatttagaagccattccagaaatactcactgccattccacatcaactagtgccatacatccagtgccacacatggtactgccactgccattaagcttggtctatacaaaagccatacatgaaagtctttaggcacattttgcctagcaaatatgagtagtactgcccattggctccataacaaaagcagtgcacttagcacataaaggagtccatgccattaaaagctaacatcagtgaacatagcatcctacatttatacaaaagcaaatttcatgtcattgaacttcagtcttcagatggcaccagctgccttgttgcttggagcatcaacatccaaattgagagctctagccctgctccttgttattgggcttgtttgagttaccccagatgcttgtgatcttgaaggtgtggacctgcaaaaaaatgaaaatcaacataaatatgtagagtaaatatagcaaatgtatggcataaaaaagaaattttgctgttgacaacatacacagtagctgttgggacttgtatgacaggatcttgcacagaaagcacaactttcttcactctttttctcttgggctttttctcttcccagcacacttcttccttggcgacatcttcctagctgccgctcggccgcctaccaatatgacagctccatcggccaccgtcgtcg

SEQ ID NO: 71762 - DNA, 4908 bp, Oryza sativa
caaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagccgccgttctcgccggcaaaacgacggcggcgacagatcgcagggacagaaagcgagcgaatcaacgagcaacgagcagatataactgaacggaatgattgcgaggaaaatggagatggaaagcgagagagatttggagagaatggagaggtcgctggctggcttttgctgctgctgatgatgagttggagtagcgatgcaggtggaatttggaaccgaggaaggtggagaatggagatgcagaggtggtttggggtgcacccggtccatggaccaccgaggatggtttttccatggcttcccttctatgtttttgccttctaaaattgttgccaactttgttagagtttcggctttcttaataaatttttagctaaaaaaaaagtagtcggtgttatgttcgttggatttacgttgagatccgcgcatgactttgctttctccgttggcacctgactttctcgatccatgttttgtgtgctgatctagctagcgtttgtcatctatatagtggtagtactgataggagtattggtttctctagaagttcgtttcctttaccgtgcaaatgaaaccaagtcatgccacactaccaacacattgttactcaaccagaaatcgtacttatgaaaaaataataaaaagaaaagagcgataataagactacaccatagttacaatgcaactttaggatgggttatgttttctagtctagctactagttttcatgttaatgaattttgtatgtttaatattattcttatttaataatttgttgttaattatgttttagggaccaaaattattgtttggttgttgtcaactatgacgtgtcacacatttttagataatgggtccaatcggcatagagacatttttttttgtcataattgatatatcaatttacaagattgatccatcaataactattggaccaaaagtagaaatagataatcacttgagatttcatttcgaacctacaaaatattgaagccactttcgttttcaccaaaggcaacaccatgtcattttgttgggatttagtactctacacctcccatggtgcatgaaacgggtccacgcaaaattgaagggcccccatctctgatatggttgacaagcaaaattagatggcatctgctcaactaaaccaccgacctccatccaacccaactcctctctctctctctctctctctctctctctctctctctcccattgacaatttggcatgtcaccatcatgtgattctcacaacaagaccaacagctcttgcatgcaagcctagtgtttgtttatctgcacccgcttatgcatttctgcctctgatagcgacctgcttaattaaacaagatatttaactatttgtcactcttacaaatagtaattaagaatttaccaccgaacccacatgtcatagacacatgagggcccacatgacatataccgcgagtggcagccatcagtccaattattagcaggggcggatccaggaacaaaaaaaaattagggggctcaattacgcagtttcttcaacctctagctatttaagaacctttagttatcatttatggtgaaaaaatcgaagggggtgctccgagggtatccatgggtcttgtagttgtaggggggactcttgcacccacgttggatccaaccctgattattagtaatgagctttcattgagcttgtcatttagctgcctaatgctcctgtgaaaactctaacagaaattacagatgttactacttactgatcagtgatcacacacacacatgttattatgttaatgtccaagatcaactgaactagtgatggcaatggcaataggtctcaaatgcaaaaacacattactaaattttatattttgtctgagttcattctcttggaatattctgggttaggtatacaatgctagattgctagtgtggtagtttttgcctaacaaggcaggacaagcaactagtgtcagaaaatggattgtgagacaaatttttactgaaatcctttgccaattctaggcttttctgttcacataaactggccaagtttaagatgtcctaaaccagtagtaggttttagcagagttccaggacataaacataaagtataagtagaccaaatgttgacactgacaaagcaatgaaaatatcaagtataaggagactagtagcagatcaaacaaagcatgggctaaaatcttgagtttcagttcagatgctcacagttcaggttgtaattcagtaaagttgcaatcacttgatgttctactgaaaactgaactgcaactacatgattacatgaaggtaccagactgcaattactgaaagtaaagctgaactgcaacacaacctgagaaacaaaacaagggcctaattatttgagttgtaagctgctgtccacagttcagaactgaaactggtgaatatcttgagataagacaggcaaaggccaagcaaagaatgaaaagagaaatagttttgacaagctagtaaagagacaggagcagatcaaagataagcatttgacaacaagatcatgtttcaccatagaaatagctcaaatcttggcttttcaattcagacaacctccattcaagttgcaattcagtaccaaatgctctgctgagaactgaactttcaactacaggattacatgaagatactaaactgcaaactactgaaactaaaactgaactcaaagcagtatctggtaaaacaaaacataagggcctaattattcaagttcagaactgaaactggagagagagagcatcttgtagatggacaggcaaaggatagttggggctcaaaactcaatccagcctcttgaggaggtactgcacttgcacttccttggtcagtggcatgatccacttgtcatacagctccacggccagctccggctcgatcttgagcttaatttcgttctccagatcttcactcaccacctggccgaaggtcatggccttgctcatcacgcgggccctcacgtcatcctccaccttcgcgaacgtcagcaattccatcagcttgtcactgtcctgaaaacacccaaaaaaaaaggtttgatcagtgagatgtacaatgctgatagatcaggattgcaatgtagtactagagattaagatggttgtgcttaattgtgtgattactggttagtaagtaactcaagcagataatgtacaatgaagtagagatgatgaactgtactgtgttccatttcagaaaaaaagaaagagagagaactgtatccttgccttgtttaagattgcaggcgtgtacgtgtcaggtgccccctggaacttagcctctgccacatacttgccatagtgaatcctcttggagagtgcctgcaattgcaagagtttcccaagttcagttcaaaccaaagaaaaaaggagtgaacttctggttgcacaaattttcatgaggcccaaaacatgtttcacatactaatttcattttttgagcagggtgccacattaagagtttaagaaattctgtgtaaactgcaacattggatcataagcacaataatattgtttcaacaagaaatcacttgtcatttggactacccataatacattcaaggtttcaagactaagttgtgacatgagtttaaatgtgaggtgatcagattatcaaacaaaatcacctgcagaattaacatgtcccagcatgcgctcgatccacagttaccgtcacttccttccttcacaagccttggcagaaggtcaccaaagtacacatcccagatccttttgtttatgttgatgttagcagcagctggatgcagaacctgtgtagtgtgtacacaagtgccaattttgtaaggttcagtatcaaatagtacagtttttgctgatgacatgattttggagacagacagtaacagacaatttgttctgaataaagagtagcagatgactgaatatagatgggtactaagatgttgacctgaaacttctaattttaaatgtcaccaatcataagtagtaagttcagaaatttatattaggaaacagtgacatgatcacattatcataagaacctaataccaatatcattatcagcatgtgcacgaaagaactggaattgcagagctagtaaacagcatggcaagacagacagatttaaacatataaatcacattgtcaaaaagtacagcacatcagcatggcacaaaaagagtaaaacacagacagatttaacagtcaacacataaatcacattatcacaaagtgactctaaaattgggggagtgagatatatatattacattctcatactcaacagatggctccaccacctccagcaaattctcagggaagaaaggatgctcatccgggctcttgtacctccccatctgaaaggatgtcacaacattattctgtccctgtcacaaattcagaatgcagaaatgaatgaactcactctagcatgcatcttctcggtctttttaaccatgaactcgaccagggagccattgaaccggacgatcctggaagcgttggggtcgtaggtgtccgggttgtagcagaactgtgacctctccagaaggccgaagatgatggtgtcctcatgcttcatcagcgtgctcctgatgctgccaatggtcaacacattgctcttgttgctct

SEQ ID NO: 71763 - DNA, 2936 bp, Oryza sativa
ctaagctttgcaaaaaacaacctctctggccgtattccagattccattggtaacctttcccaactaaacgagtttatctagatagaaacaacctcaacgggagtatacctgcaaatatagggcagtggagacaattagagaagcttaacctctctcacaattcattcagtggaagcatgccaagtgaggtctttaaaatttcttcactgtcacaaaatttggatttgtcacataatctgtttactgggcccatactgccagaaattggcaacctcataaaccttggaagcatcagtattgcaaacaatcgcttgaccggcgatataccgtctactctagggaaatgtgtgcttttggaataccttcacatggaagggaaccttcttactggaagcattccacaatctttcatgaacttaaaaagcatcaaggagttggatctctctcgtaacagattgtcaggaaaagttccagagttcctcacactttttagttctttgcagaaactcaacctttcattcaatgactttgaagggacaataccatcaaatggtgtctttggtaatgctagcagggttatcttggacggaaactacaggttgtgtgcgaatgctccagggtacagcctgcccctttgccctgaatcaggattacaaattaaaagcaagtctactgttttgaaaatagtaattccaatcgtagtgtctgctgttgtaatttcattgttatgtttaactattgttctcatgaagagaagaaaagaagaaccaaaccagcagcactccagtgtgaacttaaggaaaatatcatatgaagatattgccaaagcaacagatgggttctctgccacaaatttggttggtttgggatcctttggggctgtttacaagggccttctggcatttgaggacaatccagttgctattaaggttttcaatctcaacaagtacggagcacccacaagcttcaatgcggagtgtgaggcattaagatatattcgccatcgaaatcttgtcaaaatcattacattatgctctacagttgatccaaatggctatgattttaaagcacttgtctttcagtatatgcctaatgggagtctagaaatgtggctacatccagaggaccatgggcatggtaagcagagattcctaactttgggtgaaaggattaacgtagccctggacatcgcatacgctttagattatcttcacaaccagtgtgtatccccactaatacattgtgacatgaagccaagcaatgttcttttggatcttgaaatgactgcatatgtcagtgactttgggttggcaagatttatgtgtgctaattcaacagaagcacctggtaactctacaagtttggctgacctaaaaggatccattggatatattgcaccgggtgagagaaattggaaacctatacttattctttacttgtatgcttcaatcattttattaactttgtgaatcatatttttctccattcacctttgttatgttttcaaatgaaaatgcagagtatggaatgggtgcgcaaatatccacgaagggtgatgtctatagctatggagtgctgttgttagagatattaactggaaagcgtccaactgatgaaaaattcaaagatggtaggagcctccatgaacttgttgataccgcatttccccacagagtaaccgagattttagaccccaatatgctacacaatgatttggatggtggaaacttcgaaatgatgcaaagttgtgtcctcccactggttaagttggccctcatgtgctcgatggcatcaccgaaagaccggttaggtatggcgcaggtttccactgaaatacactccatcaagcaagaatttcttgatctttccagtggaggaaaaatagtgtgagtaataattagacctaggcagtacatttggcactccacaaaataaacctagctaaggttgtcttccttcttatttttgcttcctgagattagtgcaaagctgttctgcattgcaactactatgtacagctacttctattaccataatgaagtccacacaaaattaacctcttggtcctaaaatttgtttggggcagcagcaaatgcaatggtcagcaaacagcagagagcaggctggcagcacgaccaaatatggctaataacttacaaactaacaattccacggtggttagtcagcagcacaactcacaacattcaggcgtaaggatacgcatagagcaaaacggccacacctgtggcgtgccttcgcgcgcgtgtactgcgtgctactttcagaggcatttccacaaacacgccacgcgcgttcggaggccgtacacgaaaccgaactcacaagcataggcaaaggcatatagaacagtagcgtgctgacctcggaatacgacggcgggccggggaaacctccatcgtcctgcgccggccgactcggcgtcgccatcgcccatcgcgtcttcggcggcggcggcggcgcgacaggctcggcgcggccatggtctcgacgccgtcggagagagaaaaagagacggtgggacaacaagattggctgggcctggctgatgttgggctcatgggcccgaattgagtttcttttagtaaagggacaatttcgtttttcccccactttgagctctaatattgattttgtagggttttcgtttttgcccccacttttttaatcgaaagagacgtttacccctggtttggatggaagtcagtgggaccgagtttgtgacagtaaaataaagagaaataaaggaaataaagatttttttagttagtgatttacctttttaccctcgctgcacacggtcaaacccgagacctacctggcggcgctggcggcagcggagagcgggcggcggccaggcgcagctcctcccggcgcgagcaggaggcgagcacgccaggcggcggggagagggcagc

SEQ ID NO: 71764 - DNA, 1002 bp, Oryza sativa
cgtcagcgaaaccgctcaccaaaaccgtcgagggagtcaaattgcaccggttttaacagtttaggggtcaagatatactgattttgcggttcagggtcatggattaaatttgggtcagttttaagggagtcaaagtggacttattcctcatcataattgtgtttaattattgttgttaagctcagacctgagactgatttctaccatctgtatattatccaggcttcttgacaacaacaaattatccggaagcatcccttctactttaggccttcttaatacattggaagttctgtgagtacaagcgcatattatggatgagacaataaaattcatagattgacactgctgccttatgtcatgaagttcgatcgatgcaggcgtttcgataacaatgcgcaattgacaggaccagttcctaccaacctcaacaacttaaccaggcttacagaactgtgagtttactatgtgtgtctgctttattaattgtcaattattcaatattaatagcttacgcgctatgctttcatttgacactagccatcttgcaaactgcaatcttactggtccactgccagacctaactggaatgaacgaactcatgtatttgtaagtgatcagtcaacccttccaatgttaaaactaaaattgactttccatttatcatactatgcaactttctggatggtttcatcttactaacttgcaattcaatttgttacaggtacatgaacaacaatagcttcagttcatcattatttgaataatcactagccgacgcattataggctgaggcgctatcagattcataatttacatacctaaaataattatttgaataatcaccagccgacgcggtatatatatccattaaaaataggtctaacaacatatgtatgagaattaatggtacttgtaaaattattttgagaaacatatatatttgtaaattttacctcaggcttggtgtagtagggaaacggtgtagttctatggtatgct

SEQ ID NO: 71765 - DNA, 826 bp, Oryza sativa
caaattcagaatgcagaaatgaatgaactcactctagcatgcatcttctcggtctttttaaccatgaactcgaccagggagccattgaaccggacgatcctggaagcgttggggtcgtaggtgtccgggttgtagcagaactgtgacctctccagaaggccgaagatgatggtgtcctcatgcttcatcagcgtgctcctgatgctgccaatggtcaacacattgctcttgttgctctcttccacaccctctttgctcttttccacggccctacaacaacatgattagagataaatagagtcagggtgttgaacaaagctaaataagcagtaaacctgatcatatctaatagacggtgtgatgttagaattaacccaaacggaatttcaaacgatgcagtaggtttaattggtacaactgtgtatatgtcaaggtttaatgtagtactaaatgatgaataatgcaataaatgaacagtgaactcttaacacagctaaaaactaatgttacacttaaaatatacttgaacagtgcaattaatacgggaacagtgaactaatgttacacagtatattattatacaaatatacttgaagatttcagacaaacttcaagatgaaactttagcctgacccgcatgaccagaaataagcttcaagatgttcaagaaagctaaaaaaggggggactaacaccttgcactagttcatgttgtgacaaaacaagatcaaggtgaagcccaaagtgatccaaagtaccatagttatcaacttgcacgcgatgaataatcataaataaaacaaccgaaatctctaaatggagtaagg

SEQ ID NO: 71766 - DNA, 2009 bp, Oryza sativa
gcatatatgacaactcgacgatttacataaataggattagagtatcatgaagatgtcagcactaatcacgagaacgcaagccgccataacaagttttacctcttgccggagatcgaacccgatgcagcccgacttgaaagcaagaattcgtcgaaacaaaaatagaaaaggtggcgatgcgccaaaagtgttattaaactgattgttcttcatttacaaggtcttgggtcatatttatacccaaaatacataatatgtccttgccggatacgactccaaatctgttacaactctaagatacgaacaagtcttttaggcaaacacttgccgacaaatatctctaaagaaactattcaaaatactctagttaatagatacaattgcccctttttcggatttatcccaatcgtggaaatacttgctcagcacatcaatcgatcccgaagatgattctagaaccaccttaccaagatcggctacatcggctgttctttgtccgatccaatgtcagccgatgcagacgttagccgacgtgcccccgtagccgacacgtactctgtttatgagaaacgatctcctatcaaatccgcttcgactttagctttgaatttgatgcatgatttaccaaatttggtcatcaacagggtcgagctatactacagatcaagcaattacccactcccgcttgtggtaagcgttgtatgtcttccagggtttcccgtgaactggtccttaattgctataggtgcgactagcaaaaccatgcacccacaaccaccattcagtcgcattttagttggataattacgaccaatgaaacattataacgccccaattttcggtcgggattaaaaatcaattaataatgcatttccagaaattatattaaaaattaaatcaatttaatcaagtgacatagtgagggaattaaaaatttcctttaaaaatcatggccgaaaatattttgtaatattctctgtgccctaatgtactctctggatttttccacgaattttcagagctcaagaaataattttaaagttacaaagttcatttaatcaattaaaataaaagcaaacaattttaaatctccatccttgtctttgggccgctatcggaccaatcctccatcccctccccgcggccttcctactcctctcccttaccaggctgtcggcccagcttggtccctccctcgcaagtccatgccgcctcccttctcctccctcctctccccgagttgcctacagatgggcccatattgccgggctctccttgaacctctagcctgggctggcagccgccacggccgcctgagccgcccacgtcgccgcctcctccagctccccctcgccctctcccgtgcgggcccgacgctgccccactccctccactctccttcccccactcccttcgcggaattcggcgccgtgccgccgcctctctctccccacgatgccgctccacgttgccgccacgcccggccacggttttccctccccgagcctataaaatccatccccgggatcccctcgtccgtttcctcctcctccccgagcttctcacgcccccttccgctctctccacgccgcctgccatttccgccgcactccggcgagcttcggccacgtgccaccgccgctcagccgtcctcgttccgtgccgcttgtaccaccagcatcgccactccttgccgcaccttggcctccgctccgcgccttcaatctgccgccgaagcaccacttccaccgccgacccgagctccaccaccgcccgccacacttcagccgcctattgccgccatccccgtctacctcaggttgtgccacctatttccctctctccaccgccgaatccccacctccattgcaaacccgaggctaccgccacattcgtcgcctccggtcaccgtttgccgccgctcccggccatcctgagccgcgccgtggccacctctggcgccgccgcatacatccgcaccttggccgtcgctcctcaccgctggaatc

SEQ ID NO: 71767 - DNA, 4356 bp, Oryza sativa
cctcacaccgccgccctctccctcctctctccgcggccgccgcgccgctctcttcttgtgtcgccgccgtcgcaactccggccgcccctcgccggtggtcgagactcatcggagcccggcgtcgccaccatccgcttcgtcgcttcctcctcttccccgtccacccctccgtcgagtacaaggaccgcgggaacgacgccgacgccgacgacccgaagcttctcgccgtttcttcctcaccgccggcaacaccgtcgacctctcgccgccgtgtctgctcggtgagaaccgtcgtctcctcccctttccgtttttccccttcccgtactccgtcgcaccgtcgccgcgccgttggccgtcgccggcgtgccgcctggactcgggtgcttctccttcccgggcgtgcttgtgcgccgtgagccgccctcatggtgtaccgagcggctgccaagtgggacccgcccatggacccctctctctcttctctgtgcaataaatcaatttcctttagaaaaataattcataaaattgcaaatttccatttaaacagcacataaacttcaaatggccatatcttgaccgtttgaactcagaatcgacccgttcaaatctctaatttctcctaaaaatgagtagaacccatttatgtgctttattgcttctgttcatatggtttttattagcctttttgtttttcttcgcgttggtcgtgtagatcccgccgttccggaagatcagcttttcatcgccgttgacgccgaagactttgtgagcgatcaaggcaagtcatatctaccttgaacatgttgaatcccatattgtgaaaattatgttgttttacttatattgcactgctttataaattataccgttcattattaatattgttttattagttattcctatgctctttgttatggccatgttattgatttgatatccatgatcgttgtgaaacctagtaaaattataacttgactagtctggtaccctacatgatggactgactagttgctttaggtaaatgcttagtcatgcttagttccaacctagaacttttggttaaactagactttggtggttaacaactaaaattggattagttatggactattgactggtttgtcaatagatgggtgataaaatgatttgtgcaactaaaatatatttttgggctgggcttggggtgcaagctagttactttggtagtcgcaccccggctaatataaggatcggtcttcgggcctctgttgcaaggcatcttcgtgcaaccacaagtcttgtgggtaaggcctgactggaaatttagatcttctcaaaacagagaccattggttggaagggtgtgaggccaggattaaggccgtttttaacccggcgcaagggggggcctgtctcgtcctgggggatccggcaacctttaccttgtcggggaccggcgggcagggaaaccacagcgggttctcctgttttgggtagacctagatggatagtcttgtcacgacctctatccgagtaccgtggtggtacctggcgcgtggcaacgcgtgttgaggttgggtattgtgggtaaagttgtacacctctgatcagagttagaactattcaaatagccgcgtcctcggttatgggcaagctaagcaatgtacccaaagttagttttgttttataaaaccttgggagggtgaaatcatgatggtgtagtcatgtgaagattagcctgggttaaggcaggttcgtaggctcatgcgaccttgatgatattaaaatattggcttagaacaggatcgtgttttaaaatgagctttaacttgattaaaatgtttaaattatggctttatgcaaaataaaccctattaggccattttcttgttttccctacgcattattgttgcatttccggtgtgacttgctgagtacggtggtggtactcactcttgctcacaaaaataatccagaggatggacctgaggaaggtgaaggctttgatctctagttcgctccgccgtcgagtgcctgtggctgctgctgttccgtagtcttccgctgttttatttgtttatctttgagtgtgagggcctaagtcgcccatgtaataaagtactcctttacgtttccgcaagtgtggcatgtaataaacaacaatgtctatgtgtacctcgcctcctgggacgaggattaatgcactgagcgtttggaaatggtgtatatttccaggcgtgacataagagcaatgaccggcttcggccaacaggatgtagggttattacctgacaattcaggggcccgaacctgtataaaaatcctcgtctccgtctcttttacctcaatctcacatatatcctggtaccaacgatcctcatactatgcaaataccggaattgcgacatcaaacatcgaaccaaatggaactcaacatatggtgctacaagatatgccacaggctgccgtcgcctctccgccgcgagctcgaggccagatccggccgccgcgttgacggggaagaccggatccgctgccgcgacgacgggggtggctggatccaccgccgcgatgacaggggaggccggatctgccgccaatgccgacgagcactacaagaaatatgaccttctgtgacgaattccttgtaacgtcggagctattcgtcattatcacattccattttatgacaattaatatgagatgggtggcttagtgacaaaaaaaaagtgttcgtcgttaataccaactagaaatctgtcgacgtttgatgtcgcgattccggtatttgcatagtatgggaatcgttggtaccagggtatatgcgagattgaggtaaaagagatggagacagagatttttatacaggttcaggctcctgaattgtcaggtaataactctatattctgttggccgaagccggtattgctcttattcaccataatcacaccagtacaatatttagggtaagcctatctaactgttgtcgacatggcggtctgaaagtctgactcgtagtcgacaacagggtagccttccttctcgaatccgcatccggcgagatcagagacagcgctatatctctcctgatggtggctataggcactataggggactagccatgcctatctctgaagtcgatatccggcgtcttgtcttggcgtatgttggcttgtatgttgatcttgtgtattgatctattgttctgtgtcccctctcctcctagggggccttgtatttatacccgtagatgtccccttgtctaagtagaactaggaaaaccaatatggatacaattcgagtagtttttgtcgtttccatgtaaaactctagtcatcctaccttatgcggaactcctcctatatcctaaggttgtttccatataaaacatggtatgtgatgggttctgccgagatttagtcaactactattaggtatgtggtatccatcaccctgacaaaatcatcataaaatatttcgatgagacattgtgacgaatattaatttgtcataagagtcaaaaagaaaacatcacagatttatataatgtatttctagaaaaaaatatattaaaaattgaagcaatttaatcaagtgaattaataaagaaactaaaattttcctttaaaatcatggccacaaatatttttgtaatattctacgtggtctaaattattctctaaaaatttccatgaattttcgaagctcaataactaattttaataccaccaagttcatttaacctattaaaataaatagaaaacaaattaaaatccctctctttgtccttggggctttttcggcccaagtattactctctccctccctcagcccgcagcttctttctccctcctcgggccggcttccccttccactcctccctcttcgggccgtcggcccaacccttttgctcctccctcgtcgagaagactatttgcctccctcctctcaattcaaattttttttcgtgtagtaaatgatttcaaatgaaaaaaatgtcaataataaagttgtataacttatcaacatctacaacttttgattttgttatatgactttatttcaataatttgaatttgaattttaaaatatgacaacttcaaacaacattttcaaatactaaatgattttcaaatgaaaaaatcataaacaataaagttgtataactcatcaatatctacaacttttgtttttgtcattttgctatatgactttgttgcaataatttgaatttgattctaatcatgacaacttcaaaaaaatattttcaaatactaaatgatttcaactgaaaaagtcatcaacaacaaagttgtataactcatcaatatctataacttttattttggtcatttctttgccgataaagtaaaaa

SEQ ID NO: 71768 - DNA, 682 bp, Oryza sativa
atgggggcgctcggcgcggctctcgcacgcgcgaacagcgagcggggggggaacgctccggggtgggaagggagcaagagagagagagagggggggagacgcccgggagagagggggccggggaagagatgggccgagcggaattcggcccatcgaacctggggaggcaaactagacttttgcggagggattcgatttggaaggaattggattcggggttgaactcgacgatagatcggggattgagatcttgagatggcacggacactagacaacaatcaaagaaacagatttcgcaattagggtttttcggagataattttcccgctaggcgccacgacggaacgggcgctacaaacttgttcgactgtgtcatcccggttcctaaacttgcagatcactcgtttaggtcctccaacttgttcagttgtgtcactccggtccttaaacttggatttgaatatcgtcttggtcaaataggacggtttaaatattttatatttaaaaataatttataactttttcatgtgagctctaatgaagacaaactttatatcaaacttgtagccctcaacgcgatctacaactttgtagttgaatttgtttttattttaagtcattttttgtcccaaaatgtaattttaaaattaaaatttcaaaatctataaacatgcaacaatat

SEQ ID NO: 71769 - DNA, 1149 bp, Oryza sativa
ccgcctgttgggttccgccgcgtctcgccatctgagctacaggaatgtccaccggcatctaggcgtcgttgtggccgctccccggcggaaggcctctgctggtcggcggtctctgcatcacaaccattgggcgaagcgtctccgccggcctccaagcccgtcaccaccgctaagtctcgatctgatttgagttttgttactgtatgtgttttcccttctcaatttcttagtgcaagactgcaagtgctatctcttttcttagatcccgtgaaatttggaattggaagctcaactacttctctcctacatacaacacattatccatgggatctacctgatgggcaagatttcctgtgatagcgctaaaagatttttggtgcattagacctgctagatgatatagcactgtcaatgatgctaacaccaattaaacttattcagccattgagtcgaatttgataccctgactagttcatgccatgtaatgctatatcttttttctctatttatagtgttgtaattatttatgtttttcttctatgttttttattttttttaaatatatatagacatatccccgtatcggtgtttttcagaaaatgccgtatcctcgtatccccgtatagcatatccatatatgtatccccgtatctaggtaacatagtcgtggttgtcttatactatgttggtggcaaattgatctatgtatcaatgtatgccttttcagctttccgatggaggatggaaagatacaagttactctcggtgatggtagcgcacatgagatggaagatcctccagaactgcatgatcaacataccatcaacatccaaggctgccgtcgacatcttcgccaagttcctcattgaaagagaaaaggtcaacaacaatggcgatgaagagagatatccatctgctatcctctattcaattagagtacttactatggctggagaagttgagatgaaattaatggcgactgacattgcccgcatatgtgttattcttcaattagtctaatctatagcctagtattgcagctgagatattatcatttctgtaggaacaaattatactttagtttgtagcaaattcctcaagtaatctaatcgagactaaattggaactgggatgatactgctgtaggaa

SEQ ID NO: 71770 - DNA, 1966 bp, Oryza sativa
aggaaggagcagaggcgagcttgactatggcaggcttactaccgtgtttggactgaaccgtttttcccggctattctgtagagtttttaaggcattttctgaccaaaaagtgttatgttgagtaagtttctacgttttgggacgacaactcccttactctctctgtcaaaaaaaaaaactcaaccccctcctaaaacaacaaatttagataaaggatagtacagatttactatactagaagatgttacatctctttctacgtttatttttttagaacggagagaatatgttgaaaaagtttcccgaattgctaaacagtccgttttatataaatttttttcttatagaagttcttttaataaccgaaataaatctattttaaagtttattagttactaatactcaattaatcatgtccctgattatctctcctgtgtttcgagtcactaaccgctctagcctaatagcttgaataagccttagggcccattcgaaccatcattttggggggtgtttagttcgtgaaaagaaaatttttaggtatcacatcggacgtttgaccggatattggaatgggttttcggacacgaatgaaaaatttaatttcataactcgcctggaaaccgcaagacaaattcattaaggctaattaatcagtcattagcagatgtggtttactgtagcactttatggttaatcatggattaattaggctcaaaatattcatctcgcgatttccatataaactgtgcaattggtttttttttaatctatatatccatgtatgtgtacgtccaaagatttgatatgacgttttttggaaaaaaaattgagaaaccttggtttagctgatcgagaagtatgctaacgtaaaatgagaaagttgtcggcccttcagaagtcaaccttaattaggaagaaccttttcttgctgagtaattgctgactctgcgtgatggccatctgcgcatctctacttcaatcttacagtgtggtactgagctactagcaaacagagagggattgcttgccagcatgggcgtgttggaagtatgtgtcaaggtgtctgtgctttgagtaggatgaaagatgagggatcattttcacagatatagaaaagttaaatgtcctagaatggtgggtggattttctatgcaacacaaattaatcaaaatgttgaatgttactaacttgtatttcctaaatatatgacttttgaaaataacacatctaactattcatctcattaaaaaaaatcatgtagtatcattcattttattatgacttgttttattattaaagatactttagacatgataatttgtaccaaaatttttagtaagacaaatggtcaaaacatcatatattttttaaaacaggagggagtataatacaagatagaaaaagtttatattcgtttaatatttacgcactaaattaaaataccattccagtatattgtccttgataacccatcagcatatagcccagttataatgtgtgaaatatctgtagtagcactgattagtcagctaacagtctccaaacatcaatatagctcttctataggagtgtacttccattcttgttgttgggaaccattatggctttatgttacgagtccgaatatctgaagtgaatatcttggatcgcctatggacaatatttgtatgtgtggtttgtcgaaaccaaataaagattaattatatggttcattcatggagggggaaccattgcaaattcttattgaggaagtttattgtcaagagattttagtcgatctcttttacgcctattgattttgctataaattagtcgacaattttttttctaaaaatttaatagatgtaaatatagtacaatcgtggtgtaattacgttgtaacttgcatgtaactacaatctaattttgaaccgttcgatttgctttaaaattcgtgcaaaggaggtaaaaaaggggatccact

SEQ ID NO: 71771 - DNA, 964 bp, Oryza sativa
ttttttctttctttcttttgaccggagaaaatatgaccgttttttttacgggagaaaatatgaccgttgctttgagaggagagtgagagagaaggaaaggttttttctttctttttttatgaggactagaaagaaaatatgaccgttgctttaagaggagattgagagagaggaaaaggtttttttctttttttatgtggactagaaaatatatgaccgttgctttaataggactagaaaatatgcccgttgcaacggattcattagaaactaaatatttatctgcttaagaaatctaggatgttttttccggttgttcctcatatggtcctttgttggtcatatctgtgcgatgagtgtagagagaccgggtagtacagaccgacagagcctgcaactggaccattccgaaattctcaacttgagcatgaaggtgaaagaactttaatttgtcagcaaattggaccctaatccattcaaataaaatcattagatagatccacgggatttcaccataaagaaatagataaatggaagctaaaattgtgcaggagtgcgagtgacaagagtgtacgacaacttatgtcgagacagcttcggccaagtagaacttgtccgccactgcaactgcagattacagtctttcacttggttacccttctcacacaccatcgctatcgcaggccccatggcagtcgtgctagcagcgccatcaccagcgaggtgcaccgcacggatctcctaggccactcgacgtgggtgatgtaagcagatatgcgggggagttgattgagcagggctacggtttgcgagggacttgactggtgtttgatactaatgaaaatgaatattaagtaagggcataaaaacaaaaaactagtagcatatgattaattgagttttaattattgcaaatttgaaaaatgaatttatttgatattttatagcaacttctatataaaaa

SEQ ID NO: 71772 - DNA, 11868 bp, Oryza sativa
tgaacctggcgcagtgtcgcgtccagattcataggccgcgccgacctataagtacactcgcggggcacgctctctctctctccgaggattgcggttgcaagcaggataaacggccaccggtaggcgtcggcggagaggagaggagcaagagagggtgggaaggagaggcacctccggattaattcctccgcgggagctggatattgtgagggaatcgaggtgggtttcttggggtggggattgcggggggttcttggtttttgatcgggcaatgcggtttttggttctttggtgttcgcgtctctgttcttggttggttggtttggtgctgttcgtggctaatttctcggtgttgcttccggtttcggttgagttttgcttcctctcgagtgaggatttgagtgttttggtgagtgttcttggatcatccgcgtcttgctttgagggctaattcgagttgttggttgtcgtttcagcgatcgagtcgtcgtcgtcttcccctgagcaatccggacgcacgcgccccccgcctgttctgcttccatcttctccacgcggatcggcgagacaagaatcaggaagcacccaggtaaagaacaccagactcacttcacttgttgttgcaaccattatggccccttctgtcgttcctggactatctgatcgaacgccatctgtgtgttcgcgcaaatgcttcaaaggagcaggaattagtggtttcagttcatgtgtgcttcatcttgcgtctcacaaacgttcttgccgaccttgcagttttctggaattccagctactataacacaagccatagccatttcacttgttgttgagttgttgctttttatgtttattattgtctttcctgaactactccttcaattgctaacttggtgattgcaaacatgcttcaaagaagcaacattagctgagttcatatttgcttttccaattttttttgccactgtagatagtgattctgcctttgttttatatacagcaagctgaagaaacaatagccgagttcatgtttgctttatcttacaatgttcatagaatatccagtttggccactgtagaaagtgattctgcttttccatacagcaagctgcagatcttttttttttcccttggtggtgaaggccatggttcttgatgcattacttggtttgcttccatggcagagcagttctgtagtttgttcagtcacttatcctatgtggttctgaattttacctctgggttgagaattggagcagtttaatgagctttcttgatcgcttgcacctgctttgagggctaattcacttcacgcattcttttttcagcgattgagtcgtcatctttccctgagcaacccggagtgccccacctattctgcttcctcttctccacacggatcgtcgagacaagaagcaagaagcatccaggtaaagaacgccatgctcacctcacttgctgttgcaaccattagggccctttctgttgtccctgtactatctgatgaaatgccatctctgtgttcacgcaaatgcttcaaaggagcaggaaattagtggtttaagttcatgcttgcttcatcttgtgtcacactgtgttcttgccatccagatatggctgaagccataacttcttcactggttgtaaggttgttgactcgttgctgtatgttattattgtacttcctgaaattttccttcaaatgctaacttagtggttgcaaacgtgcttcaaggaagcaacaatatctgagttcttgttgctttgttttacggtgttaaatacagtatccattttgcttacagtagatagtgattctgcggttttataaagaaaactgacgattgatttcccctgagtggtgaaggccatggttctggatacattgtttgtttccatggcagagcagttatgtagtttttcttttgtcactagtactatatgcgcctgtgatgctagttcttactaatattgtgttttgtgttgttaatataaatatatcttggtgaaaatttctgttttgacattcatattgtacatactcagtaagctttaaaattatctgacaataaaatgcgtatgatgcagcaattagtgaatccatgttttcttccttatgctatgttctaacttagtgtaactttccaatgatacagatatggcaccaagaggaaagccttggaagcattgttgcaacaagtgcgacaagagcttccgttcagggaatgctcttggaggccacatgtcctgccacaggagtgttggtaatcagccaaagagcacgtcaagcccacccactgttgttgatctgcacatgccactgctgagttcctgtgatgataatcttttgcttttgcccccagaaacacaatgccagatgtgctcaaaggtgttctccacctccggatcgctgagggagcacatgatgatgcacggtggggagaaggtggtggtcaaggctgaggaagaagctgccgggctgattgaagcactgggcattgctgatagcatgcaagatgtaatggtgttttcttcagtgaagcgtaagcgatcattccgatcaaagaggcagacaccagcactcagtttggaggagatagaggctgcagatgctctcctactgctttcagggtgctttgacaagacttcagcttatgaggattgctatctgggagatatagaagacagtagcttgagatccattgtgctgacagaggttaacatgaatgccgtggatcgttgttcggttcgatctgttggctccaaggagccaataaatgataataactcaggttacaaggattgctatggacaaagtgacaaggaaaactgtttgatcgttcccaaggaggagatggatccaaatgattttgatcatgagctggttagagatgctgctctcaggaaaccaagaaccgacaattcagatgaggagatgaagtttggtgatcttccagctgctgctatgaaggacaacagccaccgttgcaatacctgcggaaagtcatttggatcagggcaggcactgggaggccacatgcgacgtcattatgttcggaagtgcaatcgtcaacggggggttgctgaccacgctggttctgttcttatgaaagtgcaaaagctgaagcttagattggaccccatcttgtttgatgtcacacttccagctctcactgatggagactgctgcatttctgtgggtgtgaagcctgaacctcagctgtggtgtgtcacgagcaatcttcagtgaaccaatccggtgctcgatgtggtctgaaactctctgttcttttggtgaaatctggggtgttgtctgaaactggtacagttccttgagctgtctgtagactgtaggtagttcatcagccaggaagcaaaaaaaacccatgttgtcttccgatagatagtcacaagctcacaatactgataggagtagttctcttgactgacaaacttccatggatagcaaaggccaggatcttgagtgatagcttggttactgaacagtgaagctgatttccatgttgcatgcaatgcaatggacgagcttgtcattttttttttgtaccaacaatctgtaaaatcagttttgctttgctttctgtaaatgtctgtaccttgattcttgaaaggaatgctggtcagaatgaggtgaatttttgtactaaatggtgatatcctcattgtatgcactgatcagtcaatattaaagtacagtgacattttttttcaagaaaaagagaagtgagataggagtagttctcttcacttgagtgataggagcttttcaaattttcttttgtactgacgatctgtagatcaattttactttgctctacacttctgtgtttctgtaaatgcttgtctgctgaaagaaatggtggtcagaatgaggtgattttaatttgtacactaaattctaaattttgatatatattctactaatcagtcaatattaaactacagtctcaatttttcaagcaaaaccagtatatgatgtttttttttctcatgatagtaatgtgacaagttcttcttgacaacatcacagccgtccgatcatgacacgtgtcctcatcctgcgcctcaccacgaaccccctcttcttccccgatgcgtctctctctcccctcctctctccgcttccgcaaccaaaacctccacagctcgccgcggcgctggcgcggccgcgcaggatgaacctaggacgcggtacagtccaggttcatacgatgcggcgccctataagagcacccgcgcggctcgcacgcgcggcggtcagtttacaagcgccgtccaccgagagatcgagctccaagaatcggaattggtgggatgggtttaggaagctcgattcctcgccgcccgtgaaggcattggtcaattggcccccccaagaaccgttgcttagcggcctaggaggctaggaccccgggcctggaacaatctgaggtgggtttcaggttcttggggttcttggtttgttgtccatggtcgggtttttccagttcttgatttggtcttccaccaagaatatgggctcttggtttcgtttgcctgattcgatgagtgcatttcctgtgttgtttgtttcagcggttcaacctgcatgattttcgcctttccctcacgaatttgatcgcgagttcgctacccacattcgctagaagccttcaggtgcagattccgtgcccatcctacaatctgaagctctctggtctttaccgtgtaaattcgttgcgcattgcaccgtgtaaattctggtgtgtccttgtttggttaaatgctcgaaatgaagcaaaacaaatagcgagaggaattcctcatgattaaaaatctctagctcttggttagtaaacgattctatgatggcgtttcttcagttcttgagttgttttgtcaccagccaagaattctgaggcttcttgctgattcatttcttcttcttcttctttttcttgtttctggagcaacctgttgattgttaccttgagaaatctgattagttcttgtcttccttaattgatcgcgtggtaatgtttacgttttgtaagttattgcttaaaagttgaaagagtggcttgctttgttccttctccatgctgcatgtttacttactgcgatatgaccttgctgtgatccagaaatggcttctgatgttcctcaagatgacgtgcaatgccatttttgtggcacctacttaaggccaagaagttttaggaagcatcagcagcgttgcaagtacaatccggatgcgcttacgcgacagaatttgtccgcaagttcgataccaacatctgctacaagagcgacgcattcaggtgcagattctgtgcccatcctatgatctgaagctctagtctttactgtgtaaattcaattcacattgcagtggctattcttagttttgtgatcaaatggtgtccctttatttccctaaatgcttgaaataaaccagaagttagcaagaggaatcatcccaagacaaaactctccagttatttgttagttaatggttctgcagtggtgtttcagttcttcaattgttctgttgatggcaagaatttttgccatttgctaagaatttggccgcaccctgtgtctgccttaatgattcttacgataattccacaagttcttacttatccatccttttgatctttttttctaggagcaagttgttagtagttaccattaagaatctgactaattcttgtctttcttaattgatcacatggtattagtgtttgcattttgcaactatttacttgaaatagtggcttgcttgctaagttctgattctctatgatgtgtgtttacttactgcgacttgctgtgatccagaaatggcttctgatggcgtttcagttctatcaatgatctcagtacagtgatctcaatttcttctactactactactttttcttgtttccggagcaaacctgttgattgttaccttgagaaatctgattagttcttgtcttccttaattgatcgcgtggtaatttttacgttttctaagttattgcttgaaagttgaaagagtgggcttgctttgttccttctccatgccgcgtgtttacttactgcgatatgaccttgctgtgatccagaaatggcttctgatgttcctcaaggttacgtgcaatgtcatttttgtgacacctacttaaggccaagaagtttaaggaagcatcagcagcgttgcatgtacaatccggatgcgcttacgcgacagaatttgtccgcaagttcgataccaacatctgctagaagagcgacgcattcaggtgcagattctgtgcccatcctatgatctgaagctctagtctttaccgtgtaaattcaattcacattgcagtggctattcttagttctgtgatcaaatgatgtccctttatttccctaaatgcttgaaataaaccagaagttagcaagagtaataatcatcctaagacaaaactctccagttatgggttagttcatgattctgcagtggtgtttcagttcttcaattgttctgttgatggcaagaatttttgccatttgccaagaatttggccgaaccctgtgtctgccttaatgattcttatgataattccgcaagttcttacttatccatctttttgttcttttcttctaggagtaagctgttagtagttaccattaagaatctgattaattcttgtctttcttaattgatcacatggtattagtgtttgctttttgcaactatttacttgaaatagtggcttgcttgctaagttctgattctctatgatgtgtgtttacttactgcgacttgctgtgatccagaaatggcttctgatggtcctcaagagaactgtcagtgcagtttttgtcacaaggacttcgagggtagaagttcttgtgcagagcatgagctgcagtgcaagaacaatcccgacgtgcattcgcaaacagaaccttcaggcaatgctcagggtggcataggcagcttggatgttcatgtaccaaggcgaaagcgaacagccagaaatcagccgctgccagaacaacatctgaagaagccagcttctgattatgctcagggtggcaccagtgatgcaccagagactccaccgaagccaacaacaagtgaagtgaaagtggattctgctgtcaatgctcctgatatcactattcctgacaacaaagatccttctgtgatgcagaaacaaaagaagaagcttgatctcaatctgcaacctcacagtgacagttcagatcaggaggaacaggccgacaatttcagctctatcaatgatctcagtacaattgatacaaattcagacaagaagaaaaataccatcactggtgttgctgataccaatattcctgaccacaaagatccttctaggatgcagatgcaaatcaagcttgatctcaatctgccacctcacgacgacagttccagctctatggatgatctcaaaactctggctcccactgataccaattcagataaggagacgaacaccggcaatggtggtgttgataccaatattcctgaccacagtgatccttctgcgatgcagacgaaaaacaagcttgatttcaatcttccgcctcgcaatgacagttcagattcattagtctgaaatgaaagacttgattttcgtctactggtagatagttacaggctatgatactcatacgactttctgtttcagaagcaacaagtgtacaaacctcttctgaatggcaaagtccatacttctgtattctttgcactcttgcttcgatagtgaagcagtgttattcagttacatgcaatggatgaacattttactactaacaatatgttctaatgcatacacttctctgtttcagtaaatatggatatactaatgagtaacgacatgattgctgtgtaaaaagattctggttaatgtttgtgtaatttggttgttgcctagattatggcagccttgatgtgatgccatactgatctatgagtgtgttattgctgtttttttttttaatattgaaaggccatggcttggatgtgtgtgctagagcagttttgctcagttcctgcaatgtactgttccattatatatagctgatatatcttgaaatgatttctgggtaaataaatgctagttaaattggtgcagacagtagtgcactggcccttttgctcttgggtgtttcttgcgaaatatggcttgatgtgaaactgagcctggtggccagttgtgcttgcttatacagttatacttaccggttagtagcatgtgcacaacttgaggttattcccattttgtgcagttggtactgtatattctgaccagttagtggtaagtatgatgtgattttggcctcattaaaagttagtcacatttgttctttaagaaaatgtcattcatttttctgagatcagtttctgtgaacttaatttggtgccaatctgcagttgctctcttctcctcatggagtcactgctgccttgtcagatttcattagttttgccaaggttcacttctcaacctgttgatacatactataagcttatttaaagttgaaaattctaccttcaagaaagacaagaacataaatgaagctttgatacaacctgaagtcagtccagtaattgtgtcttttaattaacaacactgcctttttgcatccaccactgtcagaatcaaatttacactgcaaatacagtttttgcaaggagtggcatttgcagaaagaaatcgatgctcattttttcagagttcagcagaaaaaaaaaactgatgctcttatgctcagcctgatatgtgcatagattcctcaagtatttctgcttttgtcaagttatgcccataataaagaattactccctaagtttcagattataagttattttgagtttggtcaaagttaaactatttcaagtttaatcaagtttgtagacaaatatagtaatatttataacacaaaattattttcattaaatttataattgaatatatttttataatatatttgtcttgtgttaaaaatgttgctgcatttctctacaaacttaattaaatttaaagtagtttcgacttgtagtctgaaacgtcaaacgtaaggagtaccaaactatgattacttgcattatgtggacctcttattataatgtggctgcagtgacaggttctcctcgcggcaacaccatagccgtccgatcatgacacgtgtcgtcatcctgtagcccagcaagaaaccctctctccttctactcttcctctcccaccaccgcaacccaaaacccccccgcttccactgctcgccggcgccgcgcgcaacgccgcgcgatgaacctagtacgctgaagagtccagattcgtagaatggcgcggcctataagagcacgagcaccccccccgcgctcggttcagtttacacgcggcgtccaccgagagagaccgacctccaagaagagcaagaagcgagtggggaacgggggattaacaagaagctcgattcctcgctgctcgtgaaggaatcgctccccacgacgacctggacgtgtaccgatctgacgtgggttcaggacttcaggtttcttgagttcttggttgtgctgttcatggtgtggttcggttccacagttcttggtttggtcttcccgccgagaatctgatgcgagattcgtctctgggttcttggtttgtttgcctgattcgatgatttcatgctaatgaattggttgcattcattgtttcagcggttcgacctgcaagaatttcgccttccctgacgaatttgatcgccttcccgcgttctgaaaccctcacgcattcagaggtacagattccgtgcccaaagctctagtctgttccgtgtaaattcaatccacattgcagtggctatgtgactatgtcttgccttttcttgattctgtgatcaaatggtgtctccgtgtttggctgaatgcttgagataaagcaacaattagcgagaggaactcctgattaaaagtctgttgctcttagttagttaatgatgtcgcaatttggagaatttggggaatcaactctttgattacgctcaaagagagagacgggaaatatctaaatgcccctagatatactaccctttaacaaatgattctgtggtggcgtttcaattcttcagttattctgtcgatggcaagaatatttttgccatcagccaagaatttgtcttggttctgtgagttcttgctgatccatttctttattcttgtttctggagcaaacatgctagttcttgtctttcttaattgagcacatggtaatgttcgcatttgcaagttattgcttgatgaaagagtggcttgcttgtttaattatccttctccatgatgtgtgtttgcttactgcaatgcgaccttgctgtgatccagaaaaaatggcttctgagtgggactcaccatgccagttttgtggcaagaacttcaagagaagaggtgatctgctaaatcatgagttgacttgcaagtacatttcggatgtgcatccgcaaacagaatcttcaggagatgctcaggctcgcaaggatattttgggatttcatataccaaggcaaaagcgaacagttcccgcattcccagcttctgattatgctcagggtggcatcaatggtgcaacaagtgaagtgaaagtggattgggatcccgaagaagagactgatttttagaggctctcttgcttctcagggagcaacctgcctatcctggagaagagacattttctgatgatgaaccgggtgctggtaatgtagacgatgaaccagctgctagtaataatccagatcaggtgctgaagatgtgctctgacaagggttcatctcctgtggaatgttatggaggtgatgagaggagggtcggtgcgtgcgccattgcgggggtggaggaggatgatctcagcccaaatgttggttgtcgaggggtcaccgattgtgttgatgagtctaatgtgattcaaaagcaaaaaagacagcctgatcttagcgttgccgatctcagggaccttgttgagatgaaacagcaaaacatgaaggctgataccaatattcatgaccaaggacatccttctgtgatgcagatgcaaaaaaatgagcttagtcttgatctactgcctcacaagaacagttcagatcacgaggtaccaacccttagtgtcagctctatggatgatcccgatggcctggtttccactgatacaaactcagataaggagacggagactgtcaatgttggtattgatatcaatattcctgagcagagagaatcttcagtgacgcggatgcaaaacgagaagcttggtctcaatctgctgcctcgcaatgacagttcaggtcatgaggtaccaatcctcagtgttagctctaccgatgatctcaactccctgattcccactgatacaagctcagataaggatacaaactcaaatgtagcagacaggttaggccactgtcctgcacaagagtagtagtggagtccttgttgcggtgaaaaaggaggtgcaggcctagtgtttctgatcaaactcttgaagtgaaacctgagggtgaattctgaactgcagcaatgaagggtggttcagtgtgcgcctacgttttgtgttttgtctaactgatgatggttttttgattcattggtcttcatattcatcggtctgaggtgaaagacatgatttttgtctactggtatatagttacaggctataatactcatactatctttttgtttcgtaagcaacaaatgtacataccttttatgaatggcaaagtccatatagttcctgtattctttccacacttgcttccatagtgaagctgtgttgttcacatagatgcaagtgatgaacattttactactaatgatgt

SEQ ID NO: 71773 - DNA, 4195 bp, Oryza sativa
caccatccccctcctcctcctcctcctcctcctcacccaccacctcgccgccgccgtgctcctcctccttgtcaactctccccttccgcccgcaagcacaggcgcctcgatgtcgaggaatgggagtccgttccgcctacctcgtctgaggccgagtaggttttgtggatggtgttggagtggcacgatgcccctgcgctgtccgtggcggcgtcctcccccaccagaagttgccgcggggagtgccttagcaccaacgcctctagcgccatgcttgtccgtaaccgcttaccgtcattgcccatagccatggcatcttcgccgtcactgctagtgccacgctcctcagcttgccatcagcaatgcgatcccgcatattcatagctgtcggcgatggtagcgctgcggcgtttgcatcacgggcagcgccaacggcaatactccccgtatccaccaccagctccttattaggtgatgaccccactagagaagccaccaccgcaaacgatgataacgacgagggtcgtccctgcatatcctcacgagatagccttccctgccgagtggagcaacgcatctacatcctcccctgtcccctcctgttgcagcgcgctcgtcatcaccatccccaactccagatacacctccatcacgcaccggcagatgcggcggcaaagagctcctcctcggccacctctagggtgtgcctcctccttggcctccgtcggcgcatgcgcgaggagagtcatagttgccatagctcctcctcggcctccgccggcacgtgcacgaggagactcgcagcaaacaaggactgaagagaggtagaggaaggttagagggggaagagagggagagtagagataatatgacagacaagtcccaccaattgtttttttaaaatatgctgataggactgccacataggacgaaaacaactccgataccccaccagcccaccccctctgttccagtcgatggctaatggggcgttccccagatcgatgaacaattctctccctgcatcagcttgacgaggtgcagacgacactcctcctctacagctcaaaacttcccgcctccatctccattttccgaggtgccagcggctcaccgtcgatgagccccagcccattttcctttcccaccatgcctggtgcgtcgtctctcttccatcttcttccacaaacccacgagcaccgttcggagtgtggggacctgatgggtgtggggacgggggacattattctcctggtcgttggttcagggccagggatggggatgttccaacccaatccgcccttgccctgccccatttcacccctactcttgggaaggtttgcatgggcagccatcggagctccgtagctacatctctactttctctgtttcactaaaaaaataattaatgatttgaatctagatatagcctatatgtagattcgttgttagaagttgattttctattggacggagggagtaatgtcaagtgctctttcagttgttgttgatgtatgaaaaaaggttgttggcaaggtaaaaaatggtatcaaggataaacattggtagcactttactcacctaaaacaacctgtttataatctttatcaagataaggtaaaataaaacctggaggaactgagtagtgtcaattgctctgccgattgttgttgatgtacgaaaaaaaagtagtcggcaagccaagaaattgaggatgaacactagtaccactttattcacctaaaacgacttgcttacaatctttatcaagagaaggtaaattacaatctttatcaagagaaaaattagaatgaaaaataaaacccttatctttatcaagataaggtaaaataaaatccggagaaaccaaaagttgtccttccttcaccagcctgcagactgcagcctatgtgctaccatgttcgtggaacgacgaacccaacagacggaattagttaccttgttgccgatgattaggagggtcatgttctgaaacgtaactacaagtcagattaaatttttttttaccgggccggccaagaaaggccaaccaaatttacttcagattgaagaatatatacaaatatacaaagtcagattaaatcatgcatgtgaaagaaaatgatatgagtatatatatatatatatatatatatatatatatatatatatatatatatatgtgctcatcagtttgattagagttgcttctctagttcctggtaaaaacacattaacaccactttctacgcaaaattaacaatcagttctggattcagatacaacttacgcggcccggaaaagttctcatggagtaggattcgacgagaccatattgatttggttggagctaagagacgatgatggccttgatgcgtctccttgcccatgatcagtagctcggcagagttacctccggtggcgagcgtacatggcagaaatggcataatctgcagtagtaagagggacatcactagaactgcctgcaacccaacactaaggcgagcagctgccatattgaatttgccgacccgattcaccggcttatcttcgctgctgcagcatgaagaggcgtccaatttattgcgcgcaacaaattgtcttatgtgttgacttagttttctcgggttagcaatatatttcgcacactttatatttaaaaaaggcttgctacctccgtttcatacgattcgctttgactattttctagtattttttagatttaaccaaatttataataaaaaattaacagcaaaacgtacatattgtcaaaaaaaagacacggatattaaggaaagatataacatcaaataattagaagggatgaaagcttcgaacttaggtcgtttaacccaccaccttgtaaagctagccggaagacctttgggtgtttctcaacatattatcaaaatatactaaattttagtttattaaaactaatttggtgttgtaaatgtctaaaatacaaagatatacttgacaaagagaatattacaagtatgtttttagaaagcaaatatcacattttctttgggaggtttctaaatgtattctaacacaaagtttttaaaagttcctcctcgtgttgggtcttagcgagcacagctagagtccaatgggtcatgggtgatgggagtaacacccgacctccaacatctgtattggtcattttttacacatttagaaacaacattgaatttattgtgagataataataaaatgctcaattaatgcacattaagttagtaaatagtacaaaatggttagcgtacagaatacatcgatggccatgattaagcatgcgagcaatcaaatggttcctttttgtttggctcaattcatgttgagttattggtttcaattatatagaaatagtagaacttgcgtgttgaaaagggataagtagacaaggctgataaacagagagattacatgcaggtaactaaaataatactagcttccaatgttgactagaatagtttgatttccacatggctgctttttgactccctcgctatcttggcacacttttggcatgcgctctattcaatgaaacaacgtacgctgtctgatgctgttcgttgaaaaaaaaatacccgtaaagtaaagagtatccttctaaactaggttgctgactgaccaatagagcttagaagactgacttcttcatgtcatgtactcatgtcatgtatattgactacatggcattgatcgaccagaacagttcaaattatacatggagacccatatcagacctgttgagatgggtgacttttgctgatcaacgactggttattactctgtttagccctataagggcatggtttggatatttcatgttgttatccaaatcttgttcttaggcacttgtagtttttgttcatgtagttgctagtaattgttactatatccatctcaaaatataagaacataaaattagataggatattttctagtactacaaatatggacaaactgcttgtagattcgtagtactaataaatgtttcattcaattttaagttctcatattttgggacggaggaagtaacatttacactgctatgtactaggacattatgatatgtagatgcaattttttatatgcaaatgacggtttttagatgcaaattattttaggaatattatttattgatcatgtttggaagactaactatcaatctgaccctgcattt

SEQ ID NO: 71774 - DNA, 13218 bp, Oryza sativa
ggcgtggggagcggcctgctagacctcattaagctcaaggccgccgcccgccacttctcctaccgcaccgtcttccacaccgtcctcatcctcgccttcctcctccccttcgtcttcatcctcaccgccctcgtcaccctcgagggcttcaacaagtgctcctccctaggtaccttgccgccctcttcatgaaatgctcttcaaatggtcttgaaatggtgttactgtgcccctgcacagctagttcttcaggagtagtttatgtagcttactggtggtataccagaccagggatgtgcaatgtgcatgccgcggcggcgtgaattacacgtttcggtagataacaaccgctgggatgctcataattttcttgtgttttaaccgaaactcatgaaatgtactacacgcctgctttggtgctatgatcacttgccgtcactagattataggggcttatttgggcatgataatgatagtggcattgttttttttttgttgcatactatttgcttagttggctgctttaattgctttcttggttcacctgatgttccaaaactgctcgttttggcctcctatagaaagggttagtacaaatggggttgctttgcttaccacttatgtggcaacttaatggctgcttctatcactcttagatgttaaggtgttcatgataatgatatcttgatggttcattgagaaattaggcacatcacattgacacggtagaccaacacttccgtaagtaaactatgaatgtgaaatatatgtaacatcacttgttttctactccgtatgttagaaaatgaaacaacttttctccattgttacttccgatacttcatacttggtgagttggagctactatgaaggctcatactgaaccagccagaataccaaagtgtgcccctcgaatgcttttattttgttcgaataagtcattactttagcctaaactatcctcagacaaattccaatccataagttacgttactaatcataatgtacacatttataaacaaggcccatttccctatcatctaatccacttaatttgctattacatcatgatcctgctaaataatctgttacatgcaccccccttggttgtttttctgtacatggacctgaaatcttgccctatgttcatatgttggattcaaggttgcagcagactatgtttgtctttgatcataaaaatgtaaatagtggtaattcccctgtctggagaaaagagactgctgatcttatcagttctaaatgtgtaacagcatttagtagaagctttagttttatttttctcaaatggaatcttaggggttaagcagacattgttctaaagctcaggggggttatctggactttcgccttaactctactttagttggtgcctatgttgttatcctatcttttgtcgatgatactttatgtacttatctttctctttgttgtgctgcctgatccatcataatttatacatgttcaaatttgttcatagttgaaatttgtgtggtcaatgacttgctactaattcatgagttgttactatcagattgtctaggcagacggttaggtccacggcttcttggtaggggcaacgatggctccatggtactcacatctcctctgatattacccttctcctttcaattttgtggatttgcttagttccttatttaatttctatattctaatgcgcagagggtcatgagggatttgtataggatgcttgacgaaataaattctgaagaagtacctgttgatttgaaggtcccagactcttttgatgaattcatctgggacatgaagaataatgattatgatttaaggtcatttgcttttaggctgaaggcaacagtaagtttctttccctgttttgaagtactgtccatattttctatttctgtccaagcatgtgaattgcaaagtttctcagtaggttatgttggtggtgacttgtgcttgagaatgaacgtcatgattcctttgagtgtgtttttactttggaatccactgtaaagcttgtgtcacttcttgggtaatattattttatagcagttatgttattgtgttggatggtgatggacaagctatcttgtacataaaactgttattttcttgccattatttacaagcgttacatgctaaactggtagcttctacatagctaaactctaaatatcaaggctcactatagtagtgatgaaaataaataaatatcttgtttacaccacatgtatacaacaggtagtatttaatgattctcatccttctaaagttgccaagcagaacactaatggacttgaaggtccctaacatcatgctaatatgcttctattgttcagcaagcactaatattttcattgcctgcataacattacgcagatggagagcatggacagggaattgagaacatcaaggttatcagagcagttaaacaaacactacgcagcaattgctattcccaaaggccttcattgcctttccttgcgtctaactgatgaatactcatccaatgctcttgcaaggaaacaactccctccacctgagttgatccctcgtctttctgacaattcctatctccattttgttttagcatcagataacatccttgcagcctcagttgtggtcagttcaactattaggtcatcattaaaacctggcaggatagttttccatgtcatcactgacaagaagacctatcctgctatgcactcatggtttgctttgaatactctttctcctgccattgttgaggtgaaaggtgttcaccaatttgattggttaacaagagaaaacgtgccagttcttgaagctatagaaactcagcacactgtcagaagtcgtttccatggaaatcaccttgcaagaaatagtgcaggtgatagcccaagggtttttgctgccaagctgcaggcagggagtccaacatatacttcagtgctcaatcatattcgaatatacttgcctgaggtacaataattttttctaacttattttcagtacagtttcatcagctttggcataattgataaacaattaagcatgtgttgtcatatgtaatagaaacctgagtttaagcaatcgaaatacaacagatttgaagtttctttccttgttttaaatgtaaataatatatatgtatatactctgcataattttttttcttgcagaaatctgtattgtgcaacaatttataatgttctgtagttagttggactttcccatctgtagttgtgcaaatatattctaactgcatcatttattttttcaatctacctcatttttttcctgaaagatttgtagttgtgcaaatttattctaacttgcactttgtgaaatgcagttgttcccaaacctcaacaaagttgtatttcttgatgatgacgttgttgtccagcgggacttgtcatcactttgggatattgatctaggtgggaaggtaaatggagctgttgagacctgcagaggtggagatacttgggtgatgtccaagaggttcagaaattatttcaatttctcccatcccctcattgccaataacttcgacccttcggagtgtgcatgggcatatggcatgaatatatttgacctgagtgcatggagaaagacatccattaaagataaataccaccattgggtcagggaggtaaaacatcgatgccactaccttttcatctgcacacccccagttgtgttctacacatttttttccattttatagtaactaagtgaatattttctgatattggaatttggaagtctaacaggctccttgtttaaacataacgctctttttgtttgtggcaacgttctaaaagcaactatataaaattaatgcagagctgctgatatgttaaaaactagggaatttctcttgatcacttcaaaaggcatatggaaatatgctggacactatttttaatgatcatatatttgaccaatgcttggtccaaattttaacgttctaaataagctctgatgagtttgagctacctaccttactcatgctaccttctttccctgcagaatctgagctcaaacttcacactttggaggcttggaacattaccacctggccttatagcatttagaggtcatgttcatcctattgatccatcatggcatcttttaggcttggggtatcaggaaaagacagatatccccagtgttcagaaagcagcagtcatacattacaatgggcaaagtaaaccatggctggatattggttttaagcatctccagccattttggacaagacatgtgaactactcgaatgagttcataagaaactgtcatataatggagccccagttatagattggctagataaaccattctataaatattggcgtaaattatggaattaaattcattattttggagaccaataccagatagtccagaaggatacccacgaaatgctctctgaacagtaacccggagctggtacacgagcggatggagaatatttaatgaacacaaaggaaatattttcttcctatacactaggatctctttccctttatttattccatttgtatcatagctcatgaaattacagtattgtttaggatggttcttttgtatttattggagcaatataaattgcctgatttggcgggattgatggtaggcccatcgttattgtaattgttgggtatccagttcaccacatgaacaacatgggccagattttgattttgcaaagcaagccctgtacatttgcttcctgttttctttatctttttgtggtcatctggtatgatactctggtgtcactggtgtcatcagaattggattattatacttactgtaaatttgtaactcctgtcatatttggtctttgactatctataaccttttcaagtttagtacatacatcagtgtgtattgatcattttattgtacattgtttacaagaaataagaacttaaatgaatttctttagacgaacttcagtggatattggttatggttagcaggtactcctaaaacaatactggttggactagtttgagttctaattatttcttaagagggtgttctttttcttcttttaatctgcatgtaattctttatttttcataattcactcataccagcataaaacatcaaggacgacatttttctttcacatgtacattttttatatagtatgcggaacatgagcatgatatcactacatcaaatgtgcttcattgtgacccaaccaaacatagaagggaatggaactgcaggcttgctacatactgatcagtaaacactggaatcaagttattctatatatagcccaattggggaaaaaactagaaacacagaaaaatctttacagtggatgtaaccctgagaacacctatatcatcacatcagaaaagaaaaacctcatgatatttctatctaaactcgaaatcatcgttcgcaaccttcagcctcgaaatctgggaagacgacgaacgcgatcgacagcggggcgacatagattggggaattgactgagaccatcactggtggcagtgaagggatgtcaccatctccagtgagctgaagaggagctccattgagcagcactgtcctggcaaaagggttgccatcctgtggagtcagatggtactcctccctcttctccagcccatccgaggctttgctcccaacccaggagactgtcctcttcaggccatggacaaaggagttgtccctctttatccctgccatttctctgaaattaatgttgaggtcatttctgactgagaccatgaatcccatgttcttgttcaggttgagcatgaggagcgcgacgccgccctgtagcacggaaaaaccatttcgagagcatataggtcagcctatcttcactttcagtttaatcaaccacatgaatatatgatgctagaacactgtagtactatgcttgtgttaccaaaaagataacatggcagcattacagtttcatcttaggttgtttcaggtatctggaagtaaatgggtaggtaaccgaattctttctttggactcatcatggttcataccttttgctttccgcaatgcgcataggcacgcaagtacgaagaaccgctggtgtctaaggaaataactcccttccccatgagccgatgccacagcaaggcactgaacatataccgcggtttagtacaaaaggtatatagggtagtaaagcatgattgtggcagagcaaagtataggaatacttgcctgtagtaatcagggtttggaacaaaagtttcggtatcaagaaggccatagttgcctccaatcaaagtctgtctgcagtaaacctttgtgtcatactttgctgactgaccaagctgatcaagatacctagttgaaacagcaagtttacgaacaaaacaagaaaaatccccatggttggaataattatctgttgaactggcaagtaattaccagaagctattcaggaaagtattagacacttttcggctgccactgttatatgcaccaccagcttccccaacccagggagcagaccatggtccatgccgctgtatcgtcatttggagatctctgaatgtatcagagctctggctcaaatactgcggattcaagatcctatttgcaacttgcggatcgttacctaataaaatttggtttatgtcagtcatcttaaatgtgtagtacaacctaaaaacaaagatgaattaaggagtggttctaacattatatctaggaagtacttaccagcaccaagattgtaaatatgatgagtcattgtgtcgagaacatttggaccagagatatcaagaagctgagcataccatttttggtcatagaatcctcctggggcaaccaccaatggtttcctagagtttccatataactggctgatgatgttcttgagctcaattatatcttttccatattgttcagctccaacacttgcaccaattccacttccactcaactcattacctagtacataagcacaactactgatgtaaggattacacaaatgaccgatgcttctgactcattgtaggcagcaaatgaaggttttagtttttataattcataccaaattcccatgagtctatagggtagttcatcgaaacagtgtactccatgaactcccgagcattactggaattccaagcacctccccaaacacctctgcccatctgctgtcgcccttgaagcgcgttaaggccgaatgtaacaactgcactgaagggattaaatgaaaaaatgggtcaggaaacacacttaatgaaggtatatgataggttccgatttgtgatgtggtcaacaatttatcttataatatatcagaattcactacagaaaaaagaatgcacatcagaaactactggagaaggaaggccttaccctgtatccataaagatcttattaatagcatcccatctttccatggttatgcatccttgagaaaatccaaacaggccacttgaactctttgaaaatggggtgcatggagatcctaaattcggcgtgccatacaccacctgatcttgtaaggaacctccaagtctgatacgtagagggctaaaggctacaaaaacaaataaatgggaaaaaaagtccatgaatcatgggaaagtgtagaaaaccataagaaggcaaatacattttgtggaaagtagctctaaacaaattccaagcttaataaataaaggtacagaatgaaccacaaatgtcaatatgtttcttaaaacgggatttaccctctaatatcttatattagtcagtgtaacaagtaaacctccacacggtagaatgaaattgatcacagttgctggcatatgtagttgcaaaggaacagataaatctttgacaagaattctttgagtctttgactttgtaactttaatcctatttgcaatttagtatggaaattccctactgttgtccattttttttagttacagtagaaaattgttcgcagaaaataggtataatattcaccttggatagctttagctagcaaaggattagtcaagtcctgggaaattcacaaaaggatcaaaattagttctttgcaaaaatatcaattacaacatgataaaacacacacattcttgggaaattagcaatttaccaaatttaagatagaagcttgcccccatggacactggtcataattgcacttctctggaggccaccaatcaatggtggcgcaaatgaactcgttgctggtcgaagcgatcgtctcagcaccccgaacgacgatggtcacatccgagtaatcctcggatcgaatcaatgtagggaaacagagaagaagaggtatgagaaaccatagcctcatgctttcttcccctgcaaatggtgttgtccacccaacccaaaagacaaccagaaatgtctcagatttattgtgctaattaaataaggcaactactagttggtaaggactaaggagaaggccttaagttttaattttatcaacatggatgaaagtgacacctgccctatcatcatcttctatatgtcctatatttacatgtttaacaggtcaaatcaattacaaacgaacagtttaaactttgtttccatgcaagtaaacaactatgttactatctcaattattggagcaacttaggcatctccaaatgcagtatccagagaaatataattcttttaacatttgaggaaatcatccatgaactagcactaaacaacaaaatgcaaaaaaaaaaaagaaagaaagaaagaaaggatatttcattgaagaaaggggaaagtttatcagttgagcagggtgaaattctgcagttggcaaaatcatcccaaactgcaaagaggaccctgaaacttgaagaaaggaatccttttcaacatgcaaacgatcgacctgagcacgccatttctgctcaaattcgagaaagctgaagatcaaagtttctctgacatagaataaagttcagcaaaacccaaaataaacccagcagaatctgaacatcgaattaacaaaaacttctcaaactggctgatggaacacgctaacccaacttcctccaaaactgcacctaaacagaatcaaatcctcgaaggctcgaacaaactgaaaccaaatgaagcaaccacaaccaaagccaacacaggcgcagcgtaatttgccacagatttatatactaaaaacagcagaaatactgcacggaatccaagagaaaccaagaagagttccattacctgggaatcaaaccccaacccaagaatgtcccaagctgttcttcccaagaacagcaacagctcgtatctttcccaatgcaggggaaagaagccaagaaaagctcgtatctttcccctcgcaatctctgcccagaatcaaacccggaggaaatggtcgggaggatttaaaaagattgcgcaaggttcgagcttttgagcggttcttggatagaaaagaagaggagagattcttgaggaagtagaagtattggtggtagttgctgcctctcttttatgtctcccttggaagctactctcactcttcccttgctatagtacagaaagctatgtgctcctaattagatttagagtactaatactgtattatcttttttaaaaaataagtactaatgctcctactaacctttaaacagtgatgtttttgttctttacatgtgcttctggaaagttactgcctcagttgttttcttttctgggttgagatgaactggtctaataaatctgaaggcaacagccgcaacagaggagacatgataaaacaaaaaaaaaattctgactccaggttgtattaaaaataatatcctgattcctgcatttttattattacatcctgattcctgcttgataaaaataacaacttttttattacatcctgattcctgcatgatatttgaggaattttagtttgatttctgggtaaaagaattatgagtatcttggattttgtagaaatattttgttcacatgtaggatatagagtcatttacgtgttggatttttctcatctggaaatagtgtagtgtagttggtgtgagatgaatggcagacatgtggggcccattactcagcagcaggcatatcatagctgttgtctgttgaccgggtaaagtatgggcataagttgacgacaatgttccaattagctgcaagagtctctgtgaaaaaaaaacgatttttttaccaagataaacacctgttatactttttttttggtgccaaaagaacatcaaagttaatgaaatggcacatgagaaagtgattagggctgttaattcttggcttgaagaaagagcaaggaattatggcttgatgtgattttcagcaagaagtccaaatactaagttttgatttacaggacgaaaaggattggggagatgcaagtcaaagattaaccaatccacatcacaatttcaatgcaaattgcgtgttttcaaaaggacaaaaaaaaaacaaagtggagagaaaaaggtgaccttgcttctatccactttcctctgagatgcaacttgcacttgttgagtgggtaggcttagacaaacaaacctttccatccaatgtattgatccaaaaacctatcctaattaaatcaatgtttgcaactgtatcatgattgtgctgagggatactactaactcacaatcatcatcctctattcctttttattgctatcaggatctcagtagtcaatggtcacctaatgcaaatatgcaattagttgatactatttacctatgattctagaatgaatgagggtaaaagcacttgacaatttgacataactgcctgccctgtgaaaatggcactggttaatatcagtaattggctgtacatctttatttccaattatctgctgcaaatctaccgtattatgattcacaaatgctggaggtaaatttgtgagatgccaggaacatgaagtaactggtgagcactggaaaaattgcttgcccaaaataaaaaaaaaactcagtgatattgatacccttgtttttttttttagataatgtggtatccttttaaatggcatgattcgttcttgtcctaaagtccaatattataatattagaaatggttagatgaagagtatgtcatacaaggcatgctcatccaactacttcaaaccaagactttgtttttcattttcatattcaaataatatttatctatatcctacatccttttgggtgcttccgttgttcattgtgtcatcatagtatcatattgtcacaaactggtccaaatcattggactgattacgtgttggaattctctggccgcttcttccctcaaatgttgactctgaattccaattgatatgccaaatgaaatttataaacccaaattggatttgggcgtcacatcttatacttttcaattttgatgctactgcaggagccccctgaatccatacatgaatggtggttttgatgggtttgacctgctcaactaaatcacctcagcttagactccatggtcaacgttccagtcaagccaccaagaatgatcaaatcgtccttggaactcaacatacgtaaattacattgaacctgctgcaagtaggaagcaagcacaggaaatgaagcaaaaaaaaaagaatcaaaattggcagattctaacacagtttaggaattaagccactgaaatgaacttcagcatagtttataagaagtggatttttatctcttaaggggacatcccctcgttttgtgtatggtgtttaaaaagttatcaaaaagtttgaaataaattgtaaaaatagatcaatatatgatatatcttttcgcaaacatgaaaattaaaattcgacatatacaattcgaaacaaaaacaacaaatttgaccgtgaattacacgttcttttcatagtcaaatttgttatttttgtttttatttgtataagttgaatttgaatatgcatgtttgtgaagtgatatatcacatattgatctatcatactaatttttttaaaaaaaaattaataatttttaagtggcatacaaaaacgaggggatatccccttaagggatgaatatagttttcctagtttataatcactgtatattttctgtatttggtaaattattgcgcaaacacaaaaggtactggtcctgtatttcactaattaagcaccaagtcctatgactatgagaaaaacctcaaacatgcaaacttcaaagactccaaaatttacaggaagttcacaagctccaaaacgaaaacacacatcattcagctcagagctgcagctgtaactggagccaccttactttcttgaagcgagatcactgtctcgaaggcgccgacgagggccttcaccttgctcttcctcgtctcacaagcttgctcgctgtctcctcgatcacattgttcaacaatccctgctcgttcttcttcttgtccctgacatcctgatgcctcaggatgacaacttcaggtttcgaagagcctgaatcttttgacccggaagaggctgcactgtcactcttccttctccctctggtggattctttgctcctgttgctgtcttctacagtctttgcaggcctgaaccggagccgtctcggcgtgctgctcgactctgaattgctctgtaggttcagtacctttcctcgtcggaaagttagcttgcgaggcgactgcgctgggatggttgaggactttggctgccttgtgttttcagttcttggagtggcagaattttctgctaaatttgaatgagcacatgtcaatgtttgcttgagaaacaagtgttttctgcataaattgtctgtagtaatgttggatgcaagattactgaattaggatggggagaaaagaaggtaaaccttattgtcaatcatgacataaacagacagattatcatgtgaaatctgtagtaatgttgaatgtaaattaagcaaatctttgaacatggtgttgacaggggggcaaacaaaatgtagtacctttctgagaacggctttctttcttgctaacttctacttttctcacttttggtgaagctgacttcaggtttttctccttaacgtcagcaacagcattttctgctccatacaccttcttgttgctcttcactagggaagcaggtttttctttcttgactgctctcatctttatgctcaaaagggacttggatgacaagtttatagaacgagacagtttcactggacttattttctcttcttccttcttttgccaaacacgagcattcttggcaacattcatcactgtcatctttctgtcagtttgttt

SEQ ID NO: 71775 - DNA, 814 bp, Oryza sativa
gtatatttaacgatgaatcaaatgataggaaaataattaattattacttatgtcagggttatggataccacatacctaatagtagttgactaaatctcggcagggcccaccacataccatgtcctatacggaaacaacctgcggatataggaggagttccggataaggaaagacaaccagagttctacatggaaacgataagaattactcggattgtatccatattagtttcccagttctacttggacaagggaacacctatgggtataaatacaaggccccctaggaggagaggggagacacgaccaacacaatcaacagacacccaccatagatcaagacacaagatcaacatacaagccaacatacgccaacacaagacgccggatatcgacatcagagacatacctagatcgaccctatccggtacctacagaggccggccgtagggatctagcgctgtctttgatctcgccgggcacggattcgaggacgaagactaccctgttgtcgactacaagtcagaccttcaaaccgccatgtcgacaacagttagataggctaccccaaatattgtactggtgtgattatggtgaataagagcaataccggcttcggccaacaggatgtagggttattacctgacaattcaggggcccgaacctgtataaaaatccctgtctccatctcttttacctcagtctcgcgtatactctagtaccaacgatccccataccatgcaaataccggaatcgcgacatcaaacgtcgacaatttattttttaatattgacttaattagttaacggtgtcaa

SEQ ID NO: 71776 - DNA, 1319 bp, Oryza sativa
aagagatcgatttgacaatcagagagctatatagaaagtagtttaaatccatgaatttggctatctaatacagtactactaatctaggggggcaaagtatcttggaccagtagctagccagccatgacagaaaaaagccataaggcattcatgcacatatatacatagttaggggcggatccagtatgggggcggcggggtctcgagcttccactactgacgtgaagattattagagccctacgaagaccccactaattttttttaccatatatagatgggaggggactgtaactctatctagtttgctcagacccaccgttatttctttctagatccgccactgtacatagtcatatgtactgttgccaaaccatttccttcacgtcggtatatataaacggcatgatcgagtgaaacgaatcagggcatatcaatcactttccttaccactttacgacggctgctgtaattaagctcaggttccagtttgactagctagcagccgtgtgattgatcagtctaatcaataaggaatcatcttaactactgttacagtacgattcgttacagtatcatacatgcatgcacctgccgcgtaactactgttgttgactaattaagcagccgcgaaaattactccgaaattaaaatgagttcgatatatagagaggatactactccctatgactaaaaaactttctttgaaggtttttcttgcaaaaactgtctttttaaataagatctattagaactcgttaatattattttaacatgtttcttctcgttttctctatcaaaccagcaataccctatcatgttctcctttttccttattctctttcatattaatgaagggtataatagaatgttagtcatcctcttactttaataaccaattaaaacatcaattaaaggctagtaattaactatattaatcctagctaactggactttcaagccagttagcttttttttattattctattccattatattaaaaaaaggaaaaagtacgaattaccctcccccgaactatcgcggttgtctgaattaccccctgaaccacaaaaccggacattcttcatcatgaactatacaaaccggacgaattacccccctcgacccaatccgcggtggttttggtctacgtggcatatgcgtggcagtctagtcagcattctatataaaaaaaatatggggcctacatgtcatacgcttctctctgtttctctcactctcctccctcttgaggccgccgccctcagccgctgcccctgcctgccgctgaccgtgagagagagaggggaagaatgagaa

SEQ ID NO: 71777 - DNA, 2736 bp, Oryza sativa
taatgcatcgatggccatgattacgcatgtgcgagaagtccaacggctcttttttttaatgcggcagttccaattatatagataactttgcgtgctgaaaacggattaggtggatacatgcagatcattaaaacaatatgtatagcttccaatgttgactagaaaagtatgatttccacattgcttcttttttaactcccccactagcttggcacttaacttacttttggcatgcggtccataagttaaagagtccttgtaaactaggttgctgactagccaatagagattagaaagaccgacttgaagaccttgctcgcggtgacaaacgggcagaatttgaagtagatatatactagtatatattggctacagggcatcgatcgaccggaccagttcaaatttatgcattgagacccatcagacctgttgagatgggtgacttgttgctgatcaaagactgattactcagtgcagccctgtagagtcatgggttggattgatattatttgatgctgttatatatgatcctaatcttgtccttaggtacttttagtttttgttcttcatatagtgctatatatatactaagaatttataatgagtaatgcaacttttttatatgcaaatgccgcttgtttagatgcaaattgagaaacacctaggggtcttccggctagctccacaaggtggtgggctagacgacctaggttctaagcctcaccccttctaattatttgatattaggtcattccttaatatttgcgtttttttagatgcgaattgtttggatacattttatatgcaaatgatgattctaccatgaatggtgcatcgtctctctttcatcttcttccacagaacccacgagccctggtcggagtgtgggtatccgacaggtgtggagattggggacgttattcacctggtcgttggtttggggctaggggcggggacgttccaatccacctctgccctaccccgttgtcacccctactcctatgtaggttggtggacaaccatccgagctctgtatctacatctgtaattcctatgttccataaaaaattaatttatagttatgaatctagatatatatagcttacatctagatttatagtccgaagttgattttctataggacagagagagtaatgttaattgctctattggttgttgttgatgtatgaaaaaaaagttgtcagcaagccaaaaaaatgtatggaggataaacattggtagcaccttttattcacctaaaacaacttgcttgtaatctttatcaagataaggtacgtaaaataaaacttggaggaaccaagtagtgtcaattgctctgcggactattgttgatgtatgaaaaaaaagttgtctgcaagccaaaaaattgaggatgaacattaataccactttattcacctaaaacaacttgcttacaatgtttatcaagagaaggtaaaataaaacccttatctttaaacccaaagaaaccaaaacccaggttgtgaaacaaccagtagaaagaccttccttccctagctcgcagcttatgtgcaaccatgttcgccgaacgacgaacccaacaacggtattagttgcctagtggatgtggattaggagggttaattatgttctgaaacgaaactccaagtcagattaaatcatgtatgtgaaataaaatgataggagtatatacacataaatgcatgtaaaaacacattaacagtttaacaccactttttctacgcaaaacagtcagttctggatccagatacaacttacccggcccgtcccagttctcatggagtaggattcgaggagaccgtgttgatttgcttagagctaagagacgatgatggcctccatgatgcgtctccctgcccatcagtagctcgacagacttgcttccggtggcgagcgtacatggcagaaatggcataatctgcagtagtaagagggacatcactaggattgcctgcaacccaacactaaggcgagcagctgccattgaatttgcggacccaattcaccggcctctcttcgctgctgcagcatgaagcggcgtccaatttattgcgtgcaacaaattgtcttatgtgttgacctccacctaataagagtttcatcggggtttcagccgatgaggtatctagacgttgcatcggcctacaaggattggatataagttggatttagccgatgacaacaaagattttcattgtttatctaatcttgtggattttatgacatcggacttccagctgatgtatgctttaatcttcggatcagtgcttattctatcatatcattgttagccgattggtttctactggaaattattattgttatattgtattatcatcagccgatcgtctttatttatatcaagtgtcagattctacatcaaacatatagccaatagctcaaaaccctatcgctatcggctggtatcggcatcggctagaatcactccatcggcttgtcagccgatcggtagttttatctgctgtttacatatcttgtcagttgcaggatcaaactgactggcacgctcgcatctcatcaacaacttggatctgtactagagctaagcagatctcacaggccagtgtgtgtttttcgcatcaacaacgtgacaatccagacatcaattctttttttaaaaaatgatggggcccactgtcatatctctcccctcccacctctctccaccaccatgtgtcgtggccgccatcg

SEQ ID NO: 71778 - DNA, 1618 bp, Oryza sativa
tggggggggggtaattcgtactttttccgtaaaaaaaaaaagctaactggcttgaaagtccaattattattattttttcttttggaaaaagccaagccagtggttttgactagccaagtgatcagattgttcaattcccagctaactcccttctcattgacgcttctaccaagtcccttgaccagacctgcccaactaactctacaaaatgttgtttaatttatccaaaacagtattctccatgtgcaaaatttatctcccgtcatagtcgctgattactagagaggagagcaagcaggtaagaagcttcgaatacgcattaattaatttattgcaaaaggcattaatttgaacgcaaaatttctaaaacctgatctggagtagtaatattaaatatataaatatacaaagtaatgacgtggatagaagcacgtgcggaacacatgaaaaatttggtggttggatcagctgttcggttttaggaagaattggggaaacttcaaaaacaataatgatccctcggttcatgacatgtaaaagcttctagatattgatgtagatatatttgactaccaccactttatatgcatgtgtgtgcacgtggcgcttacgtgtattaaattattatataaaagattttacaatatctataacatgaaaactaagacataataatagtttggtgcatatcacaatcatcagtttcgtcattgagagacaatgacccccgtagttagagcaagatgtcgggaaggacagaaggagacaagataatccatatacacagcctctacagtcttaaaaaaaacaaatttgagtacgaatttaggtttaactagttgtagtttaatttatttttttcgttacgagatgtggaagttgaatttgaacttgtatatatatttatgagtaaaatacagtagcggcccttaaacttgcgggtggatgtcatccaggtccattaacttgcaaatcgtgtaattaggccactaaacttgctaaatgtaccatcgccggtccaaaatgccgtttgaccgcggtcgcgccgacgtggcatgccacgtgcacagctgagctggcccgcaccatgccttttctcacgcgcaccgtgtgtgacaccggccacacttgttttttttcatcgaggcccctctgtttttctcattttctttcgacatccactgctgcttcgtcttccccggagtgccctagcgcagagtgcagcggagatcgtgaggggagtgatcgccggagaaatagggttccagcgaaagcgcaaagaggcgagattggctgttgcggcctcccgccggccataatcgcggggaggcggcatgattttccgcctggaaggggaagggcctccgttgtacagtgagtgtaacttcaaaatttcatccattaatctgcaagattagcatgcactgattgatgttggtagatagatacaaaggaatatggcgtttgattatgcaaaaagatgttattttttcctgtaggatgattatcctgacattgttctcgagtaggctagaacatgagagtaataccgctaattaggattgcaatgcaggtcctgatgatggtaaattcaccgtgaggtacaccatggtggttt

SEQ ID NO: 71779 - DNA, 995 bp, Oryza sativa
gcctaatgctgcatcggttaggttcgatctattaagtaatatttagaaccataatttagcttgttctatgattatcggtagagataatattggagtttcagccgatcttacctggtttagttgtcttgttccttatatttaatcgatatgctaaatctgccctttatattaagatcttgctgcgttgaaacatattaagcttgttgtttagtatattttgtctgtattaacatcttagtataaagtagtatcggagtagccgatacatcttagatttacttcatcggctatgctatgaatatatataatctctatcttgaagtacttttaaacataagtgatttatactgtcttggcaaactgttcgatctatcccaatcactttggtttaaacatatttttagaaatagattatatatcattgatatctacagccgatcgggtagatttaattttatcctgcttcattcttcattgccgatctggttcacatcacatcggcctaatattgaacgatacgtcatcggcagtacaaccgatcggctatcgtttgaagacttaactgtgtttctgttatttcttgttggttgcaagatcaaaccaactggcacgatcagaaaccgaaagcaattctttagacctgcactagagtaaagcaaatctcttaggcctgtgtgtttttcgcatcaacagaccctttcctaggcaccagtggcgagggtgggcatgatggagttgggtcggccgagtgtccggttgtccagctgctggatttaccgcggtgcatggggggactgcccactctcggggtaggggtgggggtgaaacctcagcgtggtgtggatggttagaggagagttatgcgaagggtcttgtcacaatcactcgacatggtcacgtgtctacgcaggcatggtgacatgccggtggattgtgtcttgtgggtacagttgtgcacctctggccagagtaaaactattcgaatagccttgctc

SEQ ID NO: 71780 - DNA, 1144 bp, Oryza sativa
agaggggattggggtttttatgggggcttggcttggggataagccaggatggcgtggaggatgaggtcgatgacaggcgcactcgatggctgtctacggcctaggttagggaggttgacgcggctaagagcacccgcaatggtaaagtaaggtgctatctataaaacatgtacatctcagcaatagactagattaatagtaaaccactttaatggtatgtctacatgggtatctatagctctctaatgcattgcctcgtttttctctatagactatctccaggttagtagatagctttactctctctcttcatttaatctcttccaagtaggaaaatatgctgacatggatctcttgtagagagcctatagataaccattgtgggtgccctaaggtttccatcctcttctccattaagtctctgtggcttaatcatcaccctacagctcctagcctgtgaacctcggcgctagcttgagagggtgcgcatcgttttgtccagcgggtgcatggaggggcgacgggacgtcatgcgtctggataatttggcggacgtggcaatggcgacgcgcttatccaatcggcttcgttcctcatctcttggagtgacggctgaaggagatggcggcttgaccggggtcgagtcgcgggcccacctagcgtggcgctgacggatgccgggattcgcggcggaaggacggacttggcgcgacacggagttagggcgcggcacgatgcggtgcacgggggcgacgcgagatgcggaggtggcgcggtcgatcgcgtgcgcggcgtccgggcgcgagcgcggatgcggagggatgcggcgcatggcccacaagcggcgcacggcctggaagcggatggatgcgacgtgaggaaagggaggcgcggcgtgcggcatgcgggtaggacgcgggcgcggtcatgggaccggatcgaatagatgatggcccatgaacagtgacagacagaaaaagagagagaaggaagaaaaggaaaaagaggaagagggaggggctaaactgcaaaagtgaatgggattggaattgaattgaaatataatctatacattttgggctttgagaattcaaatgtttgatttgaatatttatgtatttctcacaattgaattgttttgatt

SEQ ID NO: 71781 - DNA, 867 bp, Oryza sativa
agcagttggttcagcccaaggagagggagggggagaggagagagggaggggtggccgggctgggctgagggaaggagggggagagatgggctagaagtggcccaagaggaggaagaggatttcttttagcttttcctttttataaaattctttaattgttttgttgccttataattatttagaatgctctgaaaattcaagtgaaaattggttaaacatttttaagcatggggaatttattaaaaatactcacaagccaatttgatataaatctttggtgaattttaattgttggaggctcttttaggcttttaaaatttctagaaatacattaaagcacgatttaaatttagggcgattttcagggcgttacatcttattcaccataatcacaccagtacaatatttggggtagcctatctaattgttgtcgacatagcggtctgaaggtctgacacgtagtcgacaacatggtagccttcttcctcgaatccgcatctggcgagatcagatacagcgctatatctctcctgacggtagccataggcaccatatgggactagtcatgcatatctctgaagtcgatatttgacgtcttatcttagcgtatgttggcttgtatgttgtggcttctgttgtcccgtgtcttctgtattgggtgtcctcttctcctagggggccttctatttatacccataggtgtcctctttccaagtagaactagggaaaccaatatggatacaatctgagtagtcattgtcgtttccatgtagaactctggttgtctttccttattcggatctccctccatatccgaggtcagtttccatatataacatggtatgtggtgggtcctgccgagatgta

SEQ ID NO: 71782 - DNA, 632 bp, Oryza sativa
catgtaggctgctatcgtatgcacatggcacatacacataaattgtttatctgtaaattcataggggcaatatggacttgtttaagtttactgtaaatgactcagatatatagatcattatgtttttttttttgacagttatagatcattatgttggcagtttatttctgtgttttttgagacagtttatttctgtgtgagattttattctgctgttgtagctcatgatgttttttccttggatttagatgcacatgttcaatagctgtttttgtagttgtaaaatgtgctgtaatgatttgcaacttgtccttttggtgcgttctggcgggagattggattcggcgtgacaattaataagacgtatagtactggttatgcccaatgatttattcaatgccatattttggcaggatgaggaacctgaccatcaatatggttctcgccgaatgccagcacgtagtcgttttggggatgaactggaggctgaagcactagctgagaggcgcatagttagtgcaaagaaggtgagcaactcatcagcatgtaacccttgttatttttatccaatatattgctgtttatacataatctgtattgtttgcacattttcagtcaagtatgggcagaaa

SEQ ID NO: 71783 - DNA, 668 bp, Oryza sativa
atcccccaatttttaaagatggccttcatgttttttgcttgttcaaaatcatgttcaagaaatattattgtatcatcggcatattggagaatggacaaaccatcatccactaagtgtggaattacccctctaatttggccatcggctttggctctttcaataagaatggctaacatgtcagccactatgttaaaaagaattgaggacattggatccccttgtcttaagcctttgcatgtccggaaattttttcctacattatcatcttgttcatattctaatggatgagaatgcaacacacaactcctacacagctctgattgtccatcctgtggagaatcatgccatcctcaatccgcaatcagcaatccacaatattcaaagcatacatactaatgtgaattgtctggatcttacaatctggatcggaggttctcacaatgcaaaagcatcagtggtccaggttccaactaaaggcattgcctcgttggtatgcatctcttgtttttaatctgtctgttgcaaggttattaaggcggtatggcgagctaaggcgctgcatacccgcctcaacgctattgcgatatggcggtaaggcgtggcgatgccctaagaaggtaccctgctagcgattagaggggaaataaggaataatttggtatggaaaa

SEQ ID NO: 71784 - DNA, 679 bp, Oryza sativa
atttaacagaaaacaaacatattatcaaattatattatatgttagttttagttagactaattttatattctagatgctgctaaattttttctctagactttcaaactcaaacaagtttaacaaggagagaaaaaaaatcaaaatgacttatactaatattttaaaaaaagagtaaaaaaaaatctagcaaggctagggtaggagtagcaataataccacacgtgggcagtgggctgggatgcttgtgttgtgtcttctgcttcctggaggaagcaaccggccagccagcggtttggtttggtttgacccaaccatgccacgctggactccgacccgaccccgacccgacccgacccttctcctcctcttcgtgttcatcgcgtcgggtcaaatccctcctcttcttcttcgtctccgtctccgtctccgtctcgtcgccgcctaatcccccaccacctcgaaacccagatcaaaccctccctcccctttcacccccgcacgatccacctaccccctccccccttcttctccctcgcgcgcgcacgcagctagctagctaccgcgaggaaccgaatccaatcgagctcaggacgaggcggaggaggagaaaccaccccggattctcttgatccggagtccaagaaaccacggggtagtgccgtagtggaagcaatcaatc

SEQ ID NO: 71785 - DNA, 638 bp, Oryza sativa
catattacccgtagttcaaaaaaaaaaaaacgattacccggttcacactccgcatacatgaatgatcgattaatttgtcgatctaggactaggagcagagggtaatcgcagacttggccactagctagtcaacgacgacgagactagtacgcttgtcggcttgtgtccattcttgcagctcctaccgccgtcaaacccggcgtgcggttggtgtcgatgaagggaaatttaactattcaccaccactcatgtgacatcacaattaacgatttgtcacaccctgttaatgatatgtgggcccttatatatctatgacatgtgggactagtggcaaatcgttaagcaacatccgtaagagtggcaaatagttaaaagccccgtgcatgaactgccaactgtcgctattaaccaccttctacgtccacaaaaataaaacatggcaaatatttcttaagcaaattaagattggtataaaattatttcactgcccatgttaataaatccctggttggcagaaatcatatataatggaaattaaaagatgaataattggctagcacgaagtaattaaaaatgtttataattaacttatatctataaatttccaatgctacagatgtttatactacctccgtttt

SEQ ID NO: 71786 - DNA, 8701 bp, Oryza sativa
aggcccgaacgtttagagttgttgagttgttctgctcgcaacacatgctttcaactcttcttttctcgctttttcaaaaagaacagaacagagaaagaaagaaaacggtaatccagtacattgcgcccttaagctatcatattcttggctattttcaacctagatatttgcaagggaataagcatcaaaacagcacgcactggtgatggtttaccagatcatctgtatttttttttagaaaataatactactatatcatctatattagtgtaggaaaactggtagcacagctaacatttgatttcaagacagcatcccgaatacattaacaattgacaacatttttttttgttatttctaaacaacaatcctcaagcaaatattggtgtttgcaacctttttcttctcatcattcgtcatcactgtcaaaaacgactgccttccgacgatgaactgcctgttgttttcttggaggagaatcatcatccgagtcgatctccttgcgcctttggctggcactggcacccccagattctctcctccgttttggttcctgcagcagaggcttcagtttcagtttcgatttatatacagctaacctcatcatgtttttctttcaagtttgctatatattaactacaacaaaaaaccaatcatagattcctttcagctatatgctaactaagtatgcacaagtagtcaaacataaaccgaatacatttttttctgtttccttttgtttcacttcaacatttacaaggcagcaagcctgcccgctgacctgttagttactcttttgcagaactactgaacttaaacttacctatctacataatgccagcattgtaaactaaaatatcaaatttaatcatatattcctagtggttactgtcaagattcttgaacatcttgccctcacatatgctgcaaaagtatttaattcattaatctctttactgggcatatccaagaaagaacctgacttgcaaatttggaaccttacgacaatgttcattcgtatcacatattcacattgctaacttgtgaaaaagaaaaccaagagttttcaggccatgccatcggtcttacctcgatttcttcatctgacatagctgcttcttcttccacatcttcctcatattcatcctcttcatcaagctcatcttccctcccctgggttggtgagtgctcaatatcctctccttcagtttcatactctgactcctccctttcactctcagaatattcattttcctgtcgtctaggcggacgagcaggaaaggatggtttgcgaggaatgtttctgcccatacttgactgaaaatgtgcaaacaatacagattatgtataaacagcaatatattggataaaaataacaagggttacatgctgatgagttgctcaccttctttgcactaactatgcgcctctcagctagtgcttcagcctccagttcatccccaaaacgactacgtgctggcattcggcgagaaccatattgatggtcaggttcctcatcctgccaaaatatggcattgaataaatcattgggcataaccagtactatacgtcttattaattgtcacgccgaatccaatctcccgccagaacgcaccaaaaggacaagttgcaaatcattacagcacattttacaactacaaaaacagctattgaacatgtgcatctaaatccaaggaaaaaacatcatgagctacaacagcagaataaaatctcacacagaaataaactgtctcaaaaaacacagaaataaactgccaacataatgatctataactgtcaaaaaaaaaaacataatgatctatatatctgagtcatttacagtaaacttaaacaagtccatattgcccctatgaatttacagataaacaatttatgtgtatgtgccatgtgcatacgatagcagcctacatggtttcaaaaaaggaaataaaattaaccagacaagaaaattttggatatcatcgcgtaaataacatgtagggctgaagaggatttcagttttcactgaacaaagtttttaccatgcaacagctttaggtcggagagtgaaattgaactcaaatcagttgctaaaatcaaataaggagtgggcagtgatgcagtgttaataagatgtggagggaaatttggaagcatagaacgactgtttgtggcactgtgcaactctactctgtatgtggcagcggtgatccaatcagtagcaaatgaaggtgaactttggtgtttggctggggtttcaaagcttcgaaaactgtttgctaggtcgatagcccttgcggcttaactaggtcattcggtttgtttggttcttttgtaagacatgacggtgtttacagagtgggtttttttctaaactcccctgtgctgcgccgcccctacgcagatctcctgcgtgttcgagaaaagaaaaaggtgtggagggtcttgcacttgaccagcattatattgcagccaaaagtggccccaaagactggcaaacattcaaatggcatttactagtgagatttaataggatgcgtctggactaaatatcatttatcactaatactataacagtatgaacaacaataactaattgtatcaatgaccttaagcggaagaaataagagaaatgacaagaaacccacctcatctaatgcatcttccaaaaatccgggagaaagctgccttctttgcctggcgggctgtgtgtacttgcggctaaccttttctcttttgcgttgaagaattgaatgggctcgaatattttggcccaaggcctgcatagtgaaaagggacaaacttcattcaaaatgcatatataacaagtttagaacagaaaggaaatacagcaaagcacgaacaggattaaatgcatttattaaatcagtatgtcaactatttggttattgcaccttcataaaaggaaacttcaccctatgtgatttattttttgtgaaaagttcactggagcaagccacaataaatgttatacagcgtagcactaagaacaaatcatgttacaataacttttagacccgcagatcaaagctgaaattcacgggatctagaatgtgtgtttaactgccacaaaaattaagtttaaaatccataaacaacatgctaattaatgcttgcttatgcactggagaaaaacatgcaggataaacagaaaacacacaaacaagagaattttctgaatacaaattgcagtcttgttggataatgggacctctgatatcacattgatatttgttggtttgacaacataaatttcttaatcttagaactcatactctcatcatgaaaggaaaaaaaaaacagagaaagcagcaagatcgtgtaactcatacaaatgacttcataatgattacatctttatttttaggataaatatggtgaaaatcttgcactttaccgttcaagagatttacaatcaacatgccaagatttgcacataatgtttttagagaatcatctatttacccccactatatagctaaaaatgttattacatgtttgtactccaagaaaaacaatttgtttgctgattgccatgctctaaatttgcttgctgattatcatgctctaaaagcatcaactgtcctctcaatcattttaaatagtgatcctgactagctatgcgcccaagaataaccaaatttgaagctcatatttccatgaagaagaccattcttgtagtttgcaacattagaactttagtagcatttccttaatggtactagcttaccagttatgctcctatttacttatttgtcagttatctggtgcaaattcagtgtctgctcaaatctctcatggtcagatacgaaattatatttacttaatttgaagtttgcattctgactattttactgattactctactctattaagtattacatgcatccaactcctataatctaaagaaataggtgaaaaaaaatataaatgtacatattttgtcaagcccaatggcccctatagaaacaaaatggaaagtgagaatataacacaacagaaatcatgttgtttttgagaagcagcattggggcaaatgtaagtcatgcacatgtcattcagtgttgcatatacatccaatgtattaagaaatggagtttttcgttaccctttctttttcctgcttcactctctctggatccttagattcgatccatttttgcatcttaaccgttttcttattctgagaatcaacaagagcagttaataaacgatgtgatttcgaagacaaggaagatggcatgaatctcattttccgtaagagccttccttgtgattgaaggactccctgcattataattcaaaattatatcaggttagtgacacctatgcagtaagagcatgaatgaacagaggtggtagcaaacattgttgaattgcagataagaagtactttaccttcccattcctcagaaacagatgggactgatcatgatgtgcttcatgaacagatatatcaagaacttcattgccaatcagcagctgcatggtcccatctttccattttacaatgcgcgcattactttcacactgcaacaatgctcatatatcatatggatagccacatagtgcaccaaccacctgttgtcacaaactacttaaaagacaatgacagaaaaaaaggaggaagaagaaacggagcaagcatcttatggtatatataatggcattttttttgcagggaaatacataacagttgggcaagttgactagtatgagagaagactcagtgcaagcatcaccaagggctagtttacaaactagattatagtaagaaagttaagaagcttcccacagcatcttcagggaggggaatttagaagatggcaacgtagcataactgagtctgcaatgctaaagaatttcaaaatgctacttgaaaaacattccacttacagatgtagtgccattagcattcttaacggttctccaccgcacaatattgtcctccagtcgtatcctttttttggtcccagattcatctgtaacaaatacatcctcctccacatatgttttaggatcaaaaggctttgggtcaatccccataatatttgataccttgatcacattcatctacaagttaagaaattagtcagtaacaaataaccatatgaatagctgcaaaagcacaaaaacatttaagcatcgatcataacattcctagtaaagcctacagaacaagacagcaaaattctcttcaataataccatggcataaaaagaaatttcaactaccaaagtgccaatgtcacataagagttaatagcaacacaggttctttatttcttacattgtgctgtaccagtcaattgtgcagttctgcacaacaacatttacgcacaagcacagaacatcagcaattaaacagtaacagatacaaagaattaataataaaaaatctggtgcatatgcagcaacgcaataaatatccatcaaagataactgatgtctgccaatatataatcatcttggcagaaaagataacagtgctgtatggtcaaagactgaaagatagatggttaaaaaggggtagtcaactcactctctcgggttgagctggtggctgcttaagtggaaccaccaggttcagcggtggaccaactggtttctcttttggtttcagttcacgattttcatctgattcatatctcatatcttcatcagccactacatcgtcgggctgcaaatccttctcatagtgaccttcatcttccatgggtgatctctgaaaaagaaaaggagggaaatttgagtacctattgcatccagaaaaagttaacaggtaataggtgtgaaagttgatcaatactgactggagcacaaatcaatattcatgcagggtacatacaagaaatgaatagggagaaagatttttagataaatacacaattagcaaagagccaaagatgctacctgcattaataaatttgttacatagttaagcatcaaatggtaactctgaatttaaaagaagatgaaacacaaaattatctaagtattgaattacatgaatacttgtgctgatattcagtttaaacaacatgccaccaagtcatcgatagcatactgtacttgctcagtgcagaatgtattaaaaaaatggctctgtttagaacttccgtgaaaatctttgctggttttctttaagcctgacgaaagatattcctactttaaacctagaatggtaggtaatttgagcataaaaatctcacatgggaatcttcatcaatttcttgttgatcacgatatggagcaggttcatcttcatcgctttcaccaaatacatcacggacaacttcctgatctctctcctcctcaactggcgagctgcataagattatggttcttacgagttactacttactacaaaggtagggaggatatacataggcaaagaatgcatattgagtcactagcaaaatactaagacagtcaatcaatcagtggatagattgttatgtcgtaatgtcagatctggaaagcatataatgcacagataataaataggatcctggttttatttcccccttaaccttgatgctttccttgtttgacgaggttcctcatcttcatgagctcgaccagcataatagtcatcttcagacccctcagattcagaggcaacaactcctcttcttctgctagctactggccgctgttgataggcttcatcttcactatccatgcctgctgcatcattttgcatcacccggtcactaagttctcctggggagctctggaccttttccccatcactttctccttgatcaagatcagcacgatgagcttcagcttcactttcttcttccatcccaacttgcccctcactttcaccttctccttccgcttcaccttcccctccattatcagcctcaccttccacttcttcctggacaagcaaatcaagcagcaagcatcacatcagacagctgcagcagaagtatacagcatgcattggcgaagaactcgggcacaagaaaaacctacaagagctaaactctatggcaaggaatggttggatttttacaccgtgataggtccaaaatgtctccaaatcacttgctacagctgcccactaaaaacttcaatactacttttggtctacaaagtagaattttctactagcaaggttatctctcagaaatttcaaacaggtgattggggatcaacgaagcacaaatctactggttcatcaaactgctgtatcccaatcgcgagattaaacctaagccctagccagccccaggaagcaggggaggggagattgaggttcggattgtatattgtttaccgagtggtagccggagcgggcgtgggcgtcgtcgtcgtcgtcgtcatccaccacctggtggcgaagctgctgctgctgctgatgcggatgcgggtggtcgtcctcgtcgacgaaatcgacggcctcgtcgtcgtcctcctcctcctcctccgactggtcgccgaagagattctgcatcatctggttcctcgtctcctcctcgacatccctctccctgtcgccgcccgccatcgccgctggttgagcgagctcggagcaccgaacggcgacggaccggaccggaccggcgcgtggagaggagcggcggcgcggcctgtctcagcgtcggcggcgagaagacggccgcggcgcggtggcgcaaggggagccgccgggaaccctagcctcccagcagttcgtgagactaaaatcggatgaataggattccagcggtaattttgtcaagtctactgaaaaatatgactaaaattcttctaatttagtgaaaaatgatgtgggtgaattagagagggttggttggttctagttgagagtagtatttgggtgaatccaaattgtataatggtattatagcgaagcttcattttgacgatggcataatgtccattttctcctattctacggtgagggatcgatggtggtggatcgtgttgtaatatgtgaaatttaagggtcctttttgcaaaagtgcctagtccctaccgccctgtccgatgtcgtcccttcctcgtcgtcgctggatggggacaaggagctcggtggtggcgacgatctcagacggcggtgcaaatccagcccaccgccctttccgtcgacttcctccggcgattctcaagccacctcttcgtcggccacaacccgtctgcttccgtgcctcccctctccaatccatccacctccctccatgccgatgcgctcgacccgatgggctgtcggtcaagcttggcacaaagtggaaggaccgggcaccagctggaagcctcttgagtcttgattgtttgatggcggacgaccactacgacatagccccgcagctattacacctcaaccaacctctttccgccgaatccgccgtctcaaggtgctctggatgatgatgcacgtttcgtcgccgcgatggtagcccggagcctgctgttctacaagtttcgtgcaggggctcatggacagggggagtcagggaccccgctcgtcttcgtgcagaatctttaggctgctgctcggtcatgccatgtagccgaggtgctcgaagaattgcctatacggagaagccgcacacgcccacggctgtggtcgctcctctatgtttcggctggagattatcgaccactgctccgatgtatcggagtatctcgacttctgtggatcaaccgtgctgcatactgctgaa

SEQ ID NO: 71787 - DNA, 722 bp, Oryza sativa
tgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcgtgctgctccttgccaccatcccgctcctgttcttcaccatcaagcgctcggcgcagcgtcgtggcggcggcggcggcggcgaggggaggctcccgccggggccgtgggcgctgcctgtcatcggccacctgcaccacctcgccggcgacctcccgcaccgcgccctgagcgccctggcgcggcgccacggcgcgctcatgctgctccgcctcggcgaggtccaggccgtggtcgcctcctccccggacgccgcccgcgatatcatgaggacccacgacgccgcgttcgcgtcacggccgctg

SEQ ID NO: 71788 - DNA, 822 bp, Oryza sativa
aaaattaagtgtataagcttttactccagttgatgataagtaattattaagagtaagaaatagttaattaaacatttaaagaagcagttaagcggatggatcggtataggttagtgatcgaatgatccaacgggtagaattaatcgaagaaaggaaggcgatgaatcggccaactaactgatatctgcccgtcatcctcccaactaacaacggccgcagcccgcaggcaggttgatcgatgagagtcgagagtcgtcgtacgtcttgttgattagtactccctccgtttcgaaatgcttgacgccgttgacttttttaaacatgtttgaccgttcgtcttattcaaaaaatttaagtaattattaattctttttctattatttgattcattattaaatatatttttatgtaggcatataattttacatattttataaaagtttttgaataagacgaacggtcaaacatgtgctagaaagtcaatggtgtcaaacatttcgaaatggagggagtatttttttctctttcaattcttctcttgtatggatggtttggtttgttggcggccacagcacagcgcagcttagcttagctacacaacacaccctttgaatgaagcaacaagctagtagaattgaagacacctccgaatccggccggctccaattccgattccaacccccacatccccatccgtgctctctctttgtttctttctagatactctctctcagagaggcagagtacaagtgtatatataaggttgctggagttggatgggtagtgcaataggccgctttatcatcatctatctcttcttcc

SEQ ID NO: 71789 - DNA, 1543 bp, Oryza sativa
ccaccttcttgagtttgcctttacctctgggtttacccttgctcttgcccttgaatatgatacttcccttacctttccctttcttttcaccatggcctcttttacggccatgtgagtttccaacaacattggcgtgtgcttcaggcactgccatagatgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcacaccgaaacaaaagcggcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacagctattcgaatagttttactctgatcagaggtgtacaactgtacccacaagacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttg

SEQ ID NO: 71790 - DNA, 1676 bp, Oryza sativa
tcctccgctccgtggccgaagccacctcgtcttcctcctccgcctcgctggtcaacctcaccgagctgatctccgccttcgtcgccgactccacggtgcgcgccatcatcggcagccggttcgagcaccgcgacgcatacctgcggatgctccaggacgggctcaagatcgtccccgggatgacgctgccggacctcttcccgtcctcccgcctcgcgctgttcctcagccgcgttcccggccggatcgagcaccaccgccaagggatgcaacggttcatcgacgccatcatcgtcgagcaccaggagaagcgcgccgccgccgccgccaacgacgacgacgacgaagacgaagacttcctcgacgtgctcttgaagctccaaaaggagatgggctcccaacacccgctcaccacggctaacatcaaaaccgtcatgctggtaatcaagctctccctctctctatctcaaaaaccttcgtgttacttgcagagtccctgatcatggatcacttcccatgtttcatgatcctaggacatgttcggcgccggcagcgagtcgtcggcgacggtgctgcagtggacgatggcggagctgatgcgaaacccaagggtcatgcagaaggcacaagatgaggtccggcgagcactcgccgggcatgacaaggtgacagagccaaacttgaccaacctaccctacctacgactagtcatcaaggagacactccggctacacccacccgcgccattgctactgccacgcaaatgcggaagcacgtgcaagatacttggatttgacgtacctgagggggtcatggtgatcgtgaacgcgtgggcgattggtagggacctgacgtattgggataagcctgaggagttcgtgcctgagaggtttgaacacaacgggagggatttcaagggaatggacttcgagttcataccgtttggagctggacgaaggatatgccctggcatcacattcgggatggcgcatgttgagcttgttctctctgcacttctgtaccactttgactgggagcttccacaagggatggcggcaaaggatctagacatgacagaggattttggagtcacaacacaacggcggtctaacctcttggtgcgtccaatccatcgtgtatcggttccagtagagtaaacatacttgtaagatatatttataataaatgtaattgccaatgtacgtatattagtttcagtttaattttgtttttttataattggtaaaagtcgagtttgacattatatgtttgtggagtgatatatatatcatattaatttatttttattttttttataattatttaggtgacatgaaaaaagatataagaagatgtatcctcaagtgatgaaaatctctctccagatatacaatttctatgtatgtcattacttgttcaatcttctataactagggggcagataacttggttcatttgggctcattatcctctaattttcctcttgggtggtgcatcagtatattctccaatgttaatgttctctctgaaacctataaaacgttttgcactaatcagtaatcaagtataatcagttcggtttccgcattttgaaagaggcatgaataagttgtgtccagtgtggttttgacgtgagatgcacggacacagcgcacgcagaacatgtgcacatccgt

SEQ ID NO: 71791 - DNA, 1366 bp, Oryza sativa
cctttttggtttcaattgtagcctctgttatgttgcaagcttgctgagaaaggttcagacatgtggtctgtcttaccacttgttcaagctctgcttccaggtattaagtggaacatatacacttgtgctttatattttttactttttgatccaaatggccaaaaaaaatgtgaatagatagaacatttgttaccaaataatgtacatattcccccatgctcattcatatcttatcctatatataccaagtgatgacaggcctctgccaactggtgtaacataatgacacctttgtttttgtggattttctgggatttatcctttggcctctccgttggcatgggcctaaggctttgggatgattgtgattaactgcctgacttcacccattcgttgagttagagaaggggaattcctgcagttgcataagcgtacaacacagatggctttgttgactggtgtcactgatagtatgctttttctctctcgtgttcctgtagcacttcgtcctccacttagccctggttctactgaacagattgatggttgtcttagccaatggaatcatccaaatgttcataaagctctctctcaggtacctgaattggcactattttattagctttgtcatgcatcacggacatcacttaatattcctcaagttaactgtttctgcagattgctacaatgtcaatgtcatcatcagttcttcatcctcttctcagagcctgtgctggttatctttcatcctacctgtcatcacatgtttgttacataactctctcctacaaaaatatcccatttcttctgaaaattagtgatgtctcttattttcattgttaggcaaaagcagcctgtgttttgcttgacttatgcaggggaccattatcaccgtgggtacccatgatcacggcaaaggtctctttttatgatttttccccacacttatttctacaatccatatctttttcacaaccttgtatactctttaaacaggtagaccttgccattgaacttctggaggatctcctgggtattatccaggtatgtacaagttaaagaaaaaaaacttagcatggcataatttatgttaacctttgatgcatgtaatctggcatatttctatattgagtaagttgcccacgcattataagaacacttggctggctggagttttattttgcatgtcgctgaagatatgtgtggtatgtaatctggatcctcttggacaaaagtacacagcgaagtcagatctggatgcaccaccgtactctgctattggaatatcaatcaagtgatcaatcaactacctgtagtgctcttccctaagctcagcaattctattcctgttgtgtgtttctagtaa

SEQ ID NO: 71792 - DNA, 704 bp, Oryza sativa
ctaagtcaaacctcttttgtgaccaagcttataagaaaatatagcaacatttccacaaaataaatatactacaaaaatatatttaatggtgaatttaatgaaactaatttggtgctttagatgttagtacacttcactataaacttggtcaaacttgaagaggtttgactggacaaaactgaagtgacatataatatgaaaccgagggagtatttaggatttatgcgtttttcatatgggcatttatcttaattgctcctttcagtttctgaattctttgattccctccagacacaacctaggagatcacggagtccatcttctgttcagcctgcttgttttctggcatttcgatctgaaacagccgtactgctcttaaggaaagcacacagagacagagcccttggaattgtttgcctgaaagtaggttctttgatgtccttttcctttcttattgattacaaactcttcccctcagagggttttcatgacatgtatttattttgaaattaggcatcaaaggtcctgcaagaacttctggagcccgatccattgttagatgatgcttctgaccaagtactttgtacagactactctagtttgtttggagatgaatttaacttatcggagaattgctttgatgcctctattctgaacattttggatattgctgctgttgaagaaggcattcttatatactatat

SEQ ID NO: 71793 - DNA, 1796 bp, Oryza sativa
ggcatacaatggattatctctttttttatgtaggaatatcgtatctagtaaccaaaggagtaggtgattataataatgaagagaagcagaaaaagggtgggctgggatacgtgtgatcgttttccgtaggtgtcctaatcccaacagctcaagagtcgcactcattcattcgacgtgcatgcgtatgcgtatgcgtgtccatcctcttctcttcttcttcttggcgcagccacacactctcagctggtttgggaatgaaagaggaccttttgttgcggtcaagacttgccaattcttctcttggacacctggattgtactccacttatcaggcgaagcaagagttgacatattcagaagccacccacactagctagtagtagcagcttgttgttgcttttactctcaagggtttggtttggtttggtttgttgttgaacctgctgctttgcatgcttgcttctagataggctttgctattagtgtttgcgatacaaagagggagggaggttggtaagagggaaagccttgatgtttaagatgaccctatttatatcggtgatctttgtgtgagcgaaattgaattgcttgcacacttttgtactactaatacaagcactaggaggattggtggcgaaaagggaagtgattaaatattaaggtgtagtcactcatgtactagtggctctggtgatggcgaaaggtaccggccgccagccacccagccaggccatatatggttgagctgagtagaattgaccggccatatggtatagtacaagtatgtactatctccgttctaaaatccgtgcccaacatttgaccgtccgtcttatttgaaaaatttatgaaaaatttaaaaatatttagtcacacataaagtactagtcatgttttatcatctaatagcaataaaaatactaatcatataaaattttcaaataagacgaacggtcaaacgttaaacgtgaatagtgtaaaactgcacttattttgggacggagggagtagtgtagtactccctctgtcccatgatataaggaattttaagtttttacttgtattatttgaccacttgtcttattcaaaaaaaattgtgcaaatataaaaaacgaaaagttgtgcttaaaatactttggataataaagtaagtcacaaaaaaataaataataattccaaattttttttgaataagacgagtgatcagagagtgcaaacaaaaactcaaaatttcttatattatgggacggagggagtatattgatgagtagagtaacctccgtacttgtaaaggaaaatcgtttttgacagcgacatggtctccaaaacacaactttgacttcttatttctataaaaatatttattgaaagtgatatatgtatactttgatgaaagtatttttcaagacaaatctattcatataatttttatattttcaacctcaacaaactgagagttattcatgatttatatttgtaaggtttgacttaaattttgttctaaacgattttttttatgagtatagtgtagtactcggtaacatttgttgttgttgggtggtgcatgcaataactagtttgttcagctacttggaccagcgctactgccgtaccaatattactaatttgccattgcgttatcaatgagcggtgtactgctgtgccactagttgatcgaatcgatcagtgacgacacgcatatatgatagaatataataataaaaggatcggcatgatgcgaatcaagtgaattgcagattttgagtggaataataatacagtaatactaataaagaa

SEQ ID NO: 71794 - DNA, 2277 bp, Oryza sativa
gtttctccctttcccctctccatttcctgcaatatagcagcggaggtggtctggagcgaagaaggccgtggcagggagggccaccacctttgcgcgagcgctatctgctgctaggagcagtggtcgtcgctgcagggaggaagaatggacgagaaggcagctcagtcgtgtcgtcagccgtttgctcccccttctcttccgctaggtccgccttctcctccgccaccggccgccaggtctgccttcgcctctgccactagccgcctgggcgcctagtccgcctctacgtccacccatcaccgcctcgagatcccccttcgcctcacctcagcggatgggtggatgggccaccatgctgccgccgcgtgacgacaccacacgccgccacccggagtacgagctggtgccgaacgccggcagggacatggtcacaggtctcccccacgacgcactcgtccaccgtcccttagcctctgcgctcgccgccacactcgtccaccgtccctcagccaccgcgccgccgccgccgcctcgcctcctcagccaccgcttgcatagttgacagtgagagaagagagagaggaagaatgagagaagagagagaggaagagtgagaggagtatgacaggtgggtcccacaactattttataaatagtattgctgactggactaccacatagaccaaaaccaccgcagattgggtcgaggggggtaattcgtccggtttgcatagttgggggtgaagaatatccggttttatggttcaggaggtaattcggacgaccgcgatagttcggacgggggagggaggggggtaatccgtactttttcctttttaaaattccgttgtaacgcacggtgcaaaggagaaggccggcacgaacatgtagccatgattggtgattctgatgagtcatgagcgaggagtccccgtcatgtgtagtctcactacatcttgactggtcagtggtcactacataaccttaacaaatgccttgtccttacttaggggtacctaataggccatgcgtgcctcttcaataagatgcaggttttctaaccttgttggctgtgcttttgatgtttctatatccttaattctctgtagcacataggatcggtattgttgttgtagtagctagctggcatgatcatatatctgtaggctccaaattatgcatccaacagtgaacaatgaaaacttatcccagaaattatggtttgctactcctgataatggtgtgatcatgccgtcaacatgtaatctgattcgtatacataaatgttgtacactctagctaggcagctgctagaaatgttgttcctccgcttccaatgcaaaacatggaatcagatagaatttgaatttggaccggaatgtgatatttaatttccttcttatatatcttaatctagtgatatgaaaacagggttttgtgtggactgaaatctccaaaatcagtaagatttggagaatttcagtaccctgacagagtgcattctcaataacaccaactactcccttcattccataataaaatcatttccagatacattttattctgtaactgaaggagattgaattttgccttttttttccactgaaatttctcgaaattcttcacatacctgtatgaaaaattaagacatctatatatattacagggaaaacataagatctatttagtaggagcaaaaataaaaagaaatcccttggaattcccaagatctattatatgtcactggtggacaaaccctttttaatcccggttcacaacccccctatagtcccggttatgcaaccgggactacgaatccgggactaaaaatacctatttttagtcccggttgaaataaccgggactaaaaaaggatctttagtcccggttggagttaccaaccgggactaaagatttagtcccggttggagttccgaaccgggactaatgctcttttttctttttttttttggtttcctgctgcttgcatgatttcgagccccacgaatctccacaaatctttcgaacaccacgtatcattcaaaaaatccctaaatacatcaagctgcattttctatccccaaatacatcacaaatcattcacaaaatcacaaaatcatctccacaaattcattcacacatcacatatcacacagatcagaaaaagaaatccacatcgcacagatcggccgcacagatcagaaaaagaaaccacatcacacagatcgaccgcacacatcacatagatcaggaaaaaaccacatcgcagagatcggg

SEQ ID NO: 71795 - DNA, 1264 bp, Oryza sativa
acatgagggttacaaaatagacttattcccaatccggttgatccacaggcaaaacgacgccatcaggcccaaaactggggccttctccggcccgattagctaggctggccgtagtgctgtaagtaggcctattaagccaggcccagttactcctactcgcctcgacgccgcctgctcgcttcggcgcggcggcgccccacctcccctcctccgacacgacggcgcggcgcccttctgcggtcgacgcctccgtcctccaccctccctctcctccatcttcccgccatcctcaactacaagacgacactgcggtggcgatcgcatcgatccctctacctcatcacgacccggcgggggcgaccgagcggcggcggcggcagcggcgacggcggccggatcatgggactaggaagggaggtgtggggggtggttccgccccggcgaccgaggtcgaagcggcgctgttctgagcaggtgacccaagaacgtacgcccattttcttgaactcggtcaaaagaaaggtgccgattatattggttaaatctagccttgatttctttaattcgaactccgttgtggcacgcaagatgtgtggtctgaatgtgtatgtaatgcggctcagttacttgttttgtttggacgatgcttaatgagcttaaggattacgctagctgtttactggtaataattaccttgccaggttcttttagtatattttaatttcgctttcatgcatataggtcattaactgcgcaaataattaggttcatggatgatacctttgtggacgcaagtagttcaaggacaatggacatataagctctgggactgggagttggagccattgtctaagtgatgcttttagaagatctactcaagcagatatatggctatcacgtcacgtgcagagattcttccaaatgtgctaatgaattagcatttcacttcatagaagcactgacaaagaatctttaactctttcacaagatagactggtacaacatggatgtatttactttcaagaagagcaaattactgaatgttaacagttcatatcctagatatgatgcatgctttgacataacagggataatatggcgacatgataaaattgattaatttcaagctgaagcttttgcagtgtgctttcatggatcatgctctactttaaataatggaacgctttgctccagccagtacaagatagcacaacccatctttggttgtttcacttgtacatatagctctttgctatcttgcaaa

SEQ ID NO: 71796 - DNA, 1555 bp, Oryza sativa
tgatattgcccatggtgaggggcacttggaggctcccttcctctgaatcctgagaagcacgtcgacgatgtcctcatcgtcttccacagcgccggcggcggcagctgcagcagctgccctcttctcctcatgctgcttgagagcgcattccatcagctcgaagttcttgcggtggttcgcctctgcccgccgcgtcgtgccgccgatgaagctggccagcctcgacgatgggaacaggtcgccgaggctgaacccggatgtgatcttgatcccctcggcaaggccctccaggaattcgtcccgcctctcgaaccggtcaccaatgatggtgcgcaccgcggcgtcggagacgagcgccgcgatccgctcgctgacgttcacggcctcgccgggctgcgccgccgcgacggcggcgacgaggcggccgacctcgtcctcccggatgcggcggaacgactggacgcggcgggcgctgaggagctccaccatggcgatcttgcggagctgccgccacagcgcgccgtagggcgcgaacaccagcccgacgccgtcgctcatcatgacccggatggtggagctccacggccgcgtcgcgaacgcgacgtcgtgcgtcttggtgatctccctggcggcgtcggcggacgaggcgacgacgacggggacctcgccgagcctgagcgacatgagcggcgcgtcgagccggcgcgccaggtcggccatggtgcggtgcacgagcgggccgcgcgccatgacctggtggaggttgccgacgagcggcagccgccacggcccaggcggcaacttcaccccgccattattgtcgccacgccgcttcgtcctcaacctaaccaccataagagccaggaagaggaagcaagcgcaccacgccaccttctccatgccatccatggccatggcacacacagcacgcagatgcagatacatatatgcagaggtgttactgtttactactaggtggcaagtgacagaagcagctttgtcatggtgagttggattttgtcgccatgggagtaattgctagggatgaacttccaaagagagctgatgcatgcatggctgcaagagatagatggatgcatgatgattatcagattatgtaataacgtctattttgagttcagcggtggccactggctttgcttgacttttttagaattttggtgtcgggaaaatcaatgaaaaagatactctctccggttctataataattgatgttttagacaaggttaggttaaacttttataactttgaccattaataactttaaaaatatttactttaaacaaactagaacaacatatatagatttgtctttcaaagcactataataaaagtaaacatgcatttatttattgtatatattatagtagaaaaataagatcaaagatatattttgtaatccgtgtcattgtccaaaatgtcaattaaaatgaaaccgaatggagtaaatgagtgatctcaaactgtgaaaacgatgaattgagcccagctggcagagtggagttatgagagaggcaattgattttaggctgga

SEQ ID NO: 71797 - DNA, 4382 bp, Oryza sativa
ggtcaggaaagaacacccagcattgaaaaaaaaaatcaataacttgatagcctcaccttgatcgaacctggagggatcacaatgtaaatctgctcaacgatttcaagacagtgctcaacctaaggcacttcaccctcccactagacttcacactctgatacaagaacgttcgtataatgattaaattaaataaaatgagcaatactccaatataggatccaatacttcctactctctgccagttatcacacaattattttttacagttactaggggaccaattaattaataccaccaagaggcagctgtaagttattacttttttttagaatggacaactgtaagttacttttatactactatatagaatgttcatttgtattagccatagcttgtttctacgattgtaacaataggaacggctatatatttattttaattgaatgtttacaggagtaagatattgttgttggtatatgttcctcaaattaacaagagttggctgtgggttttgctgttgcaaatcacgatcgatgaaggaagagtatataacgagtaacaatactattaccattattcaagaaaaaacaatactattaccatgtgcaatcaaattgccctaacaagcatgacgaagcactgtttttctgaggcacatcagtacactaccaccatgcacaaccagcagcacttgctttggcatacttttcagtgacactacatctgagaatatcaaattgtaagccaaagaaaactaaaaggggagcccttctcggagcaagaggtgcatagggccattaaggagatgcccaccgacaaagccccaaggctagatggcttcactgggatcttcttcaaagtctgctgggaaatcatcaaagaagacattcttctggtcttagactcaatctataatctcatatgtgcacatctaaatctgctcaactccgcgaacatcgtcctaatacctaagaaagaaggggctgagggggtcgcggactacaggccaattagcctcattcacagtatcgccaagattttctccaagatgcttgcgctgcggctaaggccacacatgcatacgttgatttcggtcaatcaaagtgccttcataaaaggaagaagcattcatgacaacttccttttcgtaagaaacatagctagaagataccaccgcttgaagcgagcaatgttgctattcaagctagacataactaaggccttcgattccgttcgctgggactaccttcttgccttgctacagcgaaggggtttcccaacaagatggagagattggttgggggctattttctcaacgtcaacttcgcaagtactcctcaatggttcgccagggcagcgaattaagcatggcagaggcctcagacaaggggaccccctttcaccactgatattcatacttgcaattgaccccctgcaacgaatcctctcaaaggcaacagagctcagtgcaatctcaaagttgcgagggagaacgacccgtctgaggacctcgatgtatgcggacgacgcaatcatcttcattaaccccactcgaggcgatgtcacggcttttgcagacatcctacatcgctttggcactgccactggactcgtcaccaaccttcaaaaatcccaagtggcggccatcagatgtgacaccattgagttgacggaggttcttgagggcgttccggtggtaagagcaaacttccccataaagtacttgggcctccccttggtactgggtagactacgaaaggcggatttgcaacctatctttgacaaaatctcaggaaggataacaaactggacagggaagaacatggcagcagctgggagaaccacgctcgtcaaatctgtgcttacgacacaacctatctatctcctgactgccttgaaaaccatgaaggaatcccttgagcaaatagacaagcagcgccatcgctttctctaggccagaacgggagatatcaccggaggaaaatgtaaagtcaactggaaaaagacgtgcttgccaaccagtcagggaggattgggagtcctagatctagagaaattcacgagggccttgaggctgcgacggttatggcacgagtggaaggatccgaccaagccttgggtgggactggaaacgccctgcgatgaaattgacaggagtcttttcgccgcctcaacaaagataacaattggagatgagaacacgacgcacttatgggattttgcctggatcgagggacaaagacccagagacctcatgccactggtctatgtgatctctaaaaacagagggaggtctcttcgaaatggaaaggaggaggatgcctgggttcaggacctagctctggaatcacactcgcctattatagtagaactagttgaacaactggttgtcctgtgggaagcggtccggaatgtccacttaggcattggagaaccggaccagattacctggaaattcacaagtagcggacgctacacgacctccttggcctaccatgcgtaatgtcaaggaacaccgagcacaagtttcaactccttaatctggaaagcctaggcgccggggaaatgcaaatttcatgcttggctcatcattcaaaatggagtatggacttcagatcgacttgcgacaaggggatggcaaaacaatgggtgtttgtcctctgtgccgctgcgaggctgagacggcgctgcatctcattgccacttgatatactaaaaggatatggggcctcgttgctggatgggtgggctaccagcagattgagccggctcaatgggaggaggcactgtcagtgcaacagtggtgggagaaccttgcaaacacgccaaatgctccgaaaaaagggctccgatcactcataatgctaattgtataggaaatctggaaagagagaaatcggcgaatctttgaccataaagaggtggcaacaagtttcctcatgtcgagaatcaaagaagaggctaacctttgggctttagcaggggtaaagtggctgcgcgagttaatcccgcattttgtatagtgtatagctacaggctccagattttttttttcttttgtccctaggggttgtattttctcctgctctattcaataaaaaggcactctagtactgttttccgttaaaaaaaagagctaacagattgttttgtgtgtggattagagtacatgatctgcaatttgaaaagcacagctgtctcaaaagaagtctagaactctatatcagttcagtaattaaacttgataattctttggttttttagataatggaaatggtatataatgattctttgttcaccaagagatgaatttttttgaaagtattcaccaagagatgaattaatctgcttttgacaaaatcaatgaattgggagcgaaaataaaagtaaaaaaataacagaagcacgttggctatgttttcaagcttcatgtaaagttttaatttaatctagggatgatgtcttaaaaaaatgagcctttgggcttgtaagtcaagaaaggtgttttatttggtcgctacataaaaatggctatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttacacgttttgcttggcaatgtgtcttctttgccttcaacatccccctccccacaatgcaaaagatatttttggtgactggctaaggggagtgcctagacccacaaaaaaatgattttatttggagctagtgctttatgttggtcaatttggtgttgccgtaacgatatagtttttaaccataaaaaaatgcctaacatcatgcaggttatcttcatgtgttccaattggctccactcttggtgtatgatgctttcacaggaacaacaggatactatgcgcaatggtgctacacgcttggaattagtagccaaggaacttttattccattttggatggcgtagtacctacagaatttcgtgatagaatctacgtgattttgaaaaaaaatattattttagtagattatatcatcggcagaagttgggggtttgtcccatctcgccttttttaacttttctgttcacgtctgaattttttggctgtgtgcctacgggcagaggccggagatgtaacacatttccattattaaaaaaaaagtcaagaaaggtgcagtcaatgcagctatggaacttataggtacatctgtaagcaaggtgggtactcaacaaagtc

SEQ ID NO: 71798 - DNA, 1052 bp, Oryza sativa
cacacccactaaagttcaggaaagaaaatgtgtgtcagctagctagtagatatagacggttatgatcgagtgcatgaaatgatttcttaattaattaatataatttcaatttccctttgaaataaaccctctgattaatttccagcttcttcaggattacactcattatattgtataataagttcttctcccattcggaaaattgcattcaagcaggttggccaaatatatattctgcagaatataaaaggagtaggccggctcggcgtacaaacaaattgtatcagtcaccccggccgttgttgtaacatttgcatggaaagccccaaaagagaacagcaaaaggggaaacactgtgccaaaaccaagggaaggaatgtcccccaggccaagctgcaagagctactagcatgcatgaacataattatattattatatattcggattaattgcacactcccccaactcggtcactcactgccacctggggcccacaccaccatagtctcccttatgggcccactgccatagtctccaaaggctctctggtcactggtctcctctccatctgtgcaaagtgcctttggagtttggagtgctcacatacattcataggacattgttcttgctacattctctctctctctgatattctctctgtgagatattctcatgtgcagagaggatgcagctgctagctgtgatggatagctagggaggcagtgcaaactcgggagaacggaaagaaagataaacaaggtgatcgaggtagctagcaagctagagagagaggatatatagaatgcattgcgatgctcaaaagccataacacgctcgccacaaaacgcaatgatgcggttctctgctctccatgctccctctgatggtgtagattaatgtatataaacctctaatctttatttatctagttaaatcctttcttgatcaatgcatgcatagtgtaaagcccaatgcatgtatgggacatgcagatcaaatgtcgaatgtttaaattgatcttcatatatatcttatcaagattttagctgtaa

SEQ ID NO: 71799 - DNA, 692 bp, Oryza sativa
tatggactctatactctacttctaatattccttatttttaattccgaatttcagttatttcctaattgtatttctatatggactctattctctacttctaatattccttatttttaattccgaatttcagttatttcctaattgtatttctatattgactctatactctacttctaatattccttatttttaattctgaatttcagttatttcataattgtatttctatatggactctagtctcctcttctaatattccttattttttaattccgaatttcaactatttctaaattgtatttctatatggactctgtattttctttttctctaattaatgtgagaaattctagaccatgagagcgaacgtggaggctcttttttctattcctttaataatataataaataaatgcttcatgtatatatctaaagattcgatgtgatatttttagaaaactaaaccaggcctgactttgcattgactgcaaacttggatcgacgactcgatctcacaatcacgcctgcagcatgacggtaacatgtttttagccctgtgctgcagttaaaaaaagaagggcacgcgagagccatgagctgcaccgagcgtgcaaaagcatgtggaagtgtacgcgttgcacggcgtccatcagtttccacgcagcctgaaattctgtggtggttgttccgttc

SEQ ID NO: 71800 - DNA, 1513 bp, Oryza sativa
taaaacatgtgctaaaaaatcaacggtgtcaaatatttcgaaacggagggagtatgatgtagtatgtcgcccttgcttgataaacgaaatgaaaaatataaaatcatatgcagactccaattaataaacataaatttgtcagatacgtgtattattgtttcacgtagtacaaaaatcgcaagctcatcgaatggggcttgtcactcacctcatccttccagttgtgttgcatcgcagcaccagcacacaggcagcagtagcacctcgatccatctaccattttatttgctgaaaagttgaattttttttttcttagatttgtacactactttatgtctcacactaggctctatctctctccctggcatgaatgccccaggttgcaggcctcttctttccccaggatttcgttagaaaagccccagtagcacacggattaacaatctccgatttaaagtcagaagagacttggtcactgatatgcgagcccactacttctagacccacatgtcaatgaccacgttagaggtacgtaaaatgacacatgtgcctcttcatacgctctcttctctcctctttctctcgcattgttttgttttgtttttaattttgaagcgaaaagagggagggaggtgcaaagaaaggttaggaaaagggacaggaaaagagggtcactgatttctttatgccccagctgctggagccctgccggcctctaccatctccatatataccacctcactcctccccttagcttaacacaccacacacacccacactggcagcagctcatacacatagctagctcagctgagacacacacacacacagtgagtagttcagctcaaagctagcatcagcagcagagctaattaacaaacatggcgtccgggagcagcggcggcggctacgcggacgagaaggggccgggggcggcgacgatgcaggcgctggggctgcagcagcagcacggcggcggcggagaggtggaagaggagtcgtcggagatgggggagaagacggcggcgaggacgcggctgtcggggctgctgtggcacggggggtcggcgtacgacgcgtggttcagctgcgcgtcgaaccaggtggcgcaggtgctgctgacgctgccctactcgttcgcgcagctgggcatggccagcggcctcctcttccagctcttctacggcctcctcggcagctggaccgcctacctcatcagcatcctctacctcgagtaccgcacccgcaaggagcgcgacaaggtcgacttccgcaaccacgtcatccaggtacctacttaccttctcaaggactataaaatcgatctctcacatatataaatcaatatgtgatatgatgatacatgtctctctttttttttatcttcttaaagtatgtttatggctggctttatatagcctactattatacctgctctaatatcgttaacgatatataaatcagtacgtgatatggtgatacatgtttttgtaccaaaaagtttgggggatcc

SEQ ID NO: 71801 - DNA, 984 bp, Oryza sativa
agatcaggaaatagcgaacccagaatgaatatgagaaagggcacctggttcttattgccaggtgtatcctctgattgtttaccaaactggattgtttcaaataactcttcaaaacaaagtaactcaaaatcactgcattcagtaatatcacctgatacatttccattatcagtactcttccttaagaagtgtgagatcattggcttcattaggcacagcacagaatcaaggaaagctacatcagtgtaagaagctctacaaagtgacacaagaatgtgcaccatccgtggcatttcaggaacaataacttccaagtgctcagcgacaattgactcaagtaggtagaaaacaacagcctttgccttagctgcaatgtttccttttaaactattaactccgtttgcaaatgcaagatgctccctaatatttccaagataaggccacaggcacatttctgaaaaccaacaaagaacatcatgcactgcactttttgggagacattttaattgtaacccaacagcttccaaaatgctttggccaaatgcatcaaactttttgctcatactcggaaagaagaaatgcagttcaggaagtaaaatctgaaacaatctcatgcttggttggtctgacagcaaaggttccttcttaagaagcacatagttattgcaaccagattgttcaattttagcagacttggccttctgagtagtaacaccacccatcaaagaaagttcatcggtgaaaattgacagcaaagatgtaagctgtgagaagtcagaggcaagaaatagctgctcatttaaatattccttggcataacgggacactgccatccatccaaaaaatcgaggtagtggactagaagacctggaaaaatctgatatcttatgtatccatgctgatggaggaaccagacttttaaaacggaaaccatctcttttaatgctgacaagttctctagtattatcactgccagacgaagca

SEQ ID NO: 71802 - DNA, 1584 bp, Oryza sativa
agttggacacggaaaccagggtttgtcttttttttttttttgacggagggagtagatgcacgcgtcgcatcatatccgccgcggtagcgtgcgatgcctccaacctgcacacgtcccgtacgtctcgatctgcatctacctgattcttcggatgattctctacagtagttcagaacaattcttgtaacgatgaggaatatggtaagagcctgaggtgagactggagtcggaggggttaggagtaaagacgaaaagaagattgagcaggaagtgattgatcagacggtgcgcaaacgcagaaactttctgtactatatattggttgtgttgtctctatttgtttatgtggctacaactagatatggtggaagagatgtcctttaaatatttttaaaaagaaattataaatttgttagagattaaaaacgatacattggggttgaaaccatacgtcctttactattgtgctatcaattacatctctttattttttagctgttgcttgtaatttcatctggttttgcactgtcatgtatcaatctaattgggcatacaatctattatatattaaaagtccatcaaacattttcaggaatgctcttaaatcatcacattatgctaataaattagagaaaatcttaagaattttaagaaaaaaaaattcaaccgttaattttcacttagggctcattcgaaaggtagaatttgaaaaaaaaagtaggaccaaaaaatacatataaatgggataagaatgtttgtgtaaaatagatgattgaaaatcataaaaaagtgatgttcggaacaaaggaattgctaataagcataaaatctttttaaagcaatcacattagttgcttgcattgttctcaaattataaatcgttagattagattgatcctaagaatagaacgcccaactaaacccagctacagatcggttggctgtgcacggctgcgatggaggcctggagaaggcgcccgatcgaggcacggaagagactccgggatactatcactctctccgtttctataatataagagattttggataatgtaacacatcttagtacaatgaatctaaatatacggtacgtctaaatttattgtattagaatgtgtgacatccatctaaaatactttatattatgggatggggaatagtagctagctgtacgttgcctatatgcaaatcaaagactcgtccttccagtgaaacatgccactctatacatcaactgccctacagctttgcaaagtgcatgcaaacagtgtcctacagcttaatttgcgaagcgtaagaacagtcagcgacgatcatctggcctgccatacaaagctcgatcacccgtaaaccacggcctaatataaccacatcctggtaaaacaaaccacacaaacacaatgatcgatgaacaatgcgggcacatgatctcacctaacaactactgagattaaaaacgaataaattgatgaggaatagatatctaaggctcatgttgactacggtttttttttaaaaaaacattatagatcacatatatcatacaaaatgaggtctagaatatgtatatctcctccatcttta

SEQ ID NO: 71803 - DNA, 1281 bp, Oryza sativa
gaatgcccttactttttacttgcatgaatgtccccatatcgtgcgacaccattcctagatggtcgtaaaagaactactacctgcttaaaacactagtaattcttttactagtgttataaatattgtttagatttcgtggtctgcgagtaaaacaattaccaccttcctctcgatatagcccatgatctcgtagctactatgtagtaatatgtttactgatatgttcagtacactgtataagagtaaaagctgagacttcgtggtctgcgagtaaaacaattactacttttctctcgatatagctcatgatctcgtagcaaccatatagtaatatgtttactgatgtattcaatacacggtataagagtaaaaaatgatactaaaagtattgttaatctatatcacaaaatgaccgtacgaataaaaaaaattacaggctcaatcacatacaaatgataaaaattactcacaagtgaatcaaactagaaaagaaaaaaaatgattcaaccaaaaatccatcgtgaaactaggattctggtggctttcttggatcttgctataaggatggagatgccggtctgtgtcttgtgacaggtagtggagagggcaaccagatggcgagcggtagtcgatgatggaataatagaagggtgtagcggcatggtatagagatgggctcgacattgcgcagtagcagccatccatcatctagcaagcacgaaaaaaatgcaagaacattctcgttcatgttatagagacgacgagcaaaagaaaaatagcaaaaaacctccatcatcggcaaactccaccctatcctctgcggcgaaccacatggagcatgatgtgcaaatgtaggacctatgcagcccatcaattcagatcaagtaatattggagattgcacgttaatctgatttgcaaaaaaaaattggggcttcatgcgtgaaggtaaactagagtatgcagatgcaaatcggagtgctatttccttacgtgcttgttctgtcaatgtcgccgacgtggagcagccgccgattgttgctcttgacctaggtgaacgcctctttactagttaaggtgttgctcgacgtacggcagcgaggcccgaagcagcgccttcgcatcaaccgccaccggccaccgctcgccggccatcgcctgtcgtcgtcctcctccatggtgcgtcaccgatctgtgggctgggatgatggatcgatgcatatcccaaaaaaaaagaggaaaaaataaagtgggggcgagagtggttggttgggtacgggaa

SEQ ID NO: 71804 - DNA, 3185 bp, Oryza sativa
aaattttggggtgtaaaataactggttttagagtctaagagggtaattcgaacgacccaaatagttcaggggggtaaaacgtacttttccttaaggaagataaataagtagagagaaggacagtgggctatagatttatagccagctgtagcacggactccaagacgcagtgtgtgtatgataggtgggaccaggtattaatagtgtagtatataactattgtataaatgagctattaaattggctatagataaattggagctagcgattggctatactattaaacttgctctaacgtaggagtttctttcgccatcatcgttatcgaaatccaactgcccaacacacatcgcgaggaggcgatcccacgattcctttggcggcatgaggcagcccctgaccaaggtaattattatactccctccgtactcgaattagatgacatttcggacaggattatactccctccgtttcgaaatgtttgacgccgttgacttttttaaatatgtttgaccgttcgtcttattcaaaaaatttaagtaattattaattttttcccatcatttgattcattgttaaatatatttttatgtaggcatataattttacatattttacaaaagtttttgaataagacgaacggtcaaacatgtgctaaaaagtcaacggtgtcgaacatttcgaaacggagggagtaattactaaggagtcattaattaaggggtaatcttccgtgtaagagcaaggtcaatagagagcccactgccatctccaattttctgtccaactcaggaagagctagcttatagcttaccaagtacaatagattagctgtaaaatgtcagagattaatacattgaactatttaatgcatgcatgccaatagcagttgttgggatcagtcctgacatccatatttgtggccattttgttgcaccacatatacacaatcacatcagagctagttaaatagaggattaataatccaaacagtgaaacagatacgatgattcacaaatctcctggcaacatgccatcaaacaaaaggaccacaaaaactagacaataataagctacacaaggcaactttttagggataacaaaataacagttaacgaaaacatagatataaactgagatagttcttgatctccatatggaccatcatcagccatcttgatttgttgcagaatataaattatgttatcagcagaacaatcacagtacaaatgcaatattaatcccagaaatctaactacttagtgatggtcaaatttctgccaattacagtaaacttttcctaaaactataaaattaggtgtgtctcattccaataaattttcttgaaaggatgtcacagtccctacactatagttacatggattcatgaatcatatttttgaactgagatgtaaaaaagatcaatgatgaagctagcagttcatgtatacaacatatatagcatatggaggaacaaaatcggttcatgtacacaaaaatttcgatgttcattacagctgaaagtactcacacgataaatataccatatgatggaaatatacctgtaagaggtgtgttgcagaggtgcaacacagtagacatcaaagcttaattgttcctgaaataaaacatatagaagggtaaattaaaaggctctatatatgacaaaaaagggggaaattatatgctaattaccctaccatggttatgtacgctgcgtattcctgaaccggttccaaatgtgctaaattaaatcagttttaagctgggtatgcattgaacgagcacaaatagtagctttcctacttagcacatcacgaaaacattggttaccaccactggttacttctggaggcagtactattgatgtcctaggaattctattgaggtctaggtcacatattgcatcctcgccctcgtcttcaacaatcatattgtggagaatcacgcaagttagcatgatatttccaacactctttctcttccatttctttgccggacgacgtacgatgttgaaacgagcttacaataccccgaaagcccgctccacatctttccttgccccctcttgatgtgtagcatataacttatgcttctcagtttgtggaagtggtatagtcttctggaatacagcccattctggatatataccatcagctaggtaatacccatggttgtactcttccccgttgacataataatggacccgagaagcctcacctctcactgtgtcaaggaaaagaggggactgattcagcacgttgatgtcgttgttagaaccagcgacaccaaagaaggcatgccaaatccataggtcgtgtgaagcaactgcttcaaggataattgttgggactttgtaatcaccacgggtgaattgacccttccaagccctcagacaactttcccacctccagtgcatacaatcaatactacctagcatacccggaaacccacgagactcgttaacatgtaatatatgctctacatcctcccttgtggggcgtctcaagtacgtcccaccaaatacctcaatcaccccttgtgaaaacatttctaagcattctaaggctgtgctcttgccaatttttaaatattcatctagtgcatcagcaggtgtgccatatgctaacatacgaagtgctgctgtgcacttttgaggtggagagagacttgtgcggctagagcaatcttccctttgagtaaagtatggtgaccactgacctaaggcttcaacaatacgtagaaagagtggcttgtgcatgcggaaccttgtgcgaaacatccactctgggtacaatggatgctctgcaaaataatcagccaccaaacggctgtgggcatctacatgatccctatgaattgtcttccttgttccaccttggcgcttcgaacgcccagctcctaacctacccttcatcttctctatgattcgagaagcaaatgagtctagtacattctgctcagaaatgtacttgtctagaactttagatgggtctaggtcatctgagttagaggatgaataggaggatgagtccgacatggttggaggaggaggaggaggatagattgggttggcagtttcaagttatgagaggtaatatatagatgctgcaaaggactagctgtaataaccatacaaattttaatatggctggactatgactgcattttaattaggaccagct

SEQ ID NO: 71805 - DNA, 761 bp, Oryza sativa
cagtatatactacttccaccgtttcatattataaaactttctagcgttgtccatgttcatatatatatatatatagtaaatttgtttggtgctccatggtgcccgggcaccattgttgaaattgagtatataaccaattcaaatgagtatgaaactttttcaattatttaggtattaacattaactactttactaactagttcaaagcaagtttgaactgaatttgaacttgtttttgttagattttgattctaggtatatagcatccatacatataattagttaggtatgtaaacatgaattgtgaaataaagttaaatttgagttgttttgttgatagatatatgtatgaatcgaattcttataactaggtatatactcacaatttaaaaattttgaaaaatttgagtaattttgtgcatttgaaaccatggtgcccgggcaccatggtgccccatatgagtgtcatatatatatatatatatatatatatatatatatatatatatatatatatatatatatatatatatatatatatatatatatgttaatgaatctagacatatatgcgtgtctatatttattaacatttatatcaatgttggtaatgctagaaagtcttctaatctgaaacggagcagtagtagtagcaacactactctagcacgcacgcatacacacctcatccccgcctccggcgactacgactcagctgctgtggcgccgccgggagtgacgacgatgttgagctgctgctg

SEQ ID NO: 71806 - DNA, 4105 bp, Oryza sativa
aacactcctccagtatcaccttgtttggtttgtagggacctcttggagtataatttattcttcatgtcaacacgagtaaacccgagattctcaaatccacaagcttgttttgccatcaaatcaatagctgctttagtagaaatccctacggattttgcgacttcaacgcttgcaacttgagcttcattaatcttcctttgtgatcgtaactgatgagcctgacttctagtggcaagattatggttatgttcaggcacaaagtgatagatagaatagaatccatctatgagacttatcttcatacatgcttgacacttgcatcgagtttctggcctactataactatcgccatagcctgaagcttctgctcttttgtcagtacctctacttcctgttaatacagtgcactaattgaaacaaaatgtctctaattgaaagttaatgtaactataaaaagaaacaaagaatttaccttgacgagaacaacaaaatgtcatgttttttataattttagtatttcccatgtaatgatagctgcttcttctaatgctgaaacctttcttaagataatcattgtagaagtcgataagctttttgttcagagctaaatttcatgccaatctttggcaccaagtcttccagatattttattgtatgagaagcttcatttgttccttcatcctagttttatctgtggtaatagtttccatcaaaaaattgcaaaaaaaaaaaaaggaacgatgaatatagttgttcatatgcacgtgcacatgtccggatcttacagtttagatgcaactaatttaacaaaatgtaaaggagaatatatagggatcttacagcttctaattgatttcttcccaggccatcagagggatatgtggactcagcaggatttgatgatgatgatgatggggcagaagtatcatccaagaatgcgaacgtaccgcatgttactgtattctgcaattgtgatggcattggtctaggaatcgggagttcatctagcatggtgccaagatttgggagagttcttgttagtgtggagacgcaatctgtgtagatgaaaataaaataactgtgtatttgtacttatgtaccgctctaatcctttttcccgccactaattttatttgcttggcgccatatttttgttagcgcttaaattgcgttgtttccaaattaattgtgatagtataacacgggacgttgacgccgtttaagtgaaagaggagcgcatgcgtactggcccaccagaaaagacccagcgaataagaagatgacacgtcgccaggaacagggtatcgggacagggaagacgcatcctgatacgaaaaccttcttatcaacatttttgatatgttagattccgaaacttctattttcaaatagaaataagcttaaattgtaaactccatctacttgaaattatatatgaatcatcataaactttgcatgtaaataaaaatttatattcataaaatttctacatatataaaatattttcattaataaactttatacataaaagaaaacatttatgttgatatactttataaataaacaaaaaaaatagattcataaattttctatgtagataaaatattttcatttataaactttatatgtaaaaaaatgattgataaactttatacataaataaaaaattatattgagaaacttttacaataatagtaaaaaaattactatccaactttttactagaatgaaaaaagtatacctaaaataataagtggcatattttggcaacgtatttaggtgacaaaattttaggattaaaatttccgatttttttaagataaaagaattataacgaatcgccctatatatttgggattaaaatcaaaagtttaattaattagatagttggatgttttctaaatacattgcctaattaatcctggacgctaccgctaattacgtttgcacgcgtgaggatcgcagatgcacggtcgaatggaccttaggagcaagtttaatagtatagccatctgctgccttcaaatcatccgtagttaacttaatgaccaattcatacaatagttacatataaacatatactacataattaatatctggtcccacctgttatacacacatgtaccttagagtccgtgctgcagctggctacaaatatgtagcccactgcccttctctcttctcttttatctcttcgaaatgtgtttatagctggtttatagcctgctattattgtacatgctctaatctgaaatagagggagtatgtatcgacgggatcaatcctataagagtaggtacaatagctaaggctataagccaactataaccacatatcaagaagaaaaaagaagagagagaaagcggattacagatttgtcgccagttgtaacatgaactccaagatattatatgtgtatgagaggtgggactgagtattaatgggtagtatatttttatagtcaactattgtatgaatggactattagattagctataaatattttggagctagtagttggctataccattaaacttgctctaatgtaggaatttctttcgtcgtcatcattatcgaaatccaactgcccaacacacttagtaaggactaaggaggcgatcccccgattccgcttcggcaattccttcggcggtgtggaggcggcccccgacaaggtaattagtatagatacttagctaatactccctccatctactttttaatagtcatatttctaaatttgaaaattttatttttgataggcatatttcaatccaacaacttataatcttaatggctttcttggatttaatgcgtgactctccattcttacacacaagattggctacatgggcatcgggaaatgtaaatattaatgaatcgcttgtttacgaggaatgactagtagcatgtttaaatggatgacaagtacaatcacttatcattggtctgtgtgccaagatgaaatattactatcaaaagtagatggagggagtatcgttttccgatttgtagtatttactctattttgtattataagtcatttgattttttttcatagttaaagtttgttatatctgatcaagtttataaaaaaattagcaatatccataacacaaaattaatttccatacattttacattaaatatattttgataatatgtttgttttgtatggaaaatattttatatttttttataatgttgattaaatttaaagatatttaacttaaaaaaagtcaaacgacttataatatgaaatgaaaagagggagtatcattgtctcaactggatgaatcctataagagcaggtataatagcaggctataagccagctgcaaccataatttaagaagaggaaaaagtacgttttaccccctgaactatcgcggtcgaccgaattacacccttaaactcaaaaaccagacattctataccctcaactattgaaaccggacaaataaggccccttaacactgttttgagtggttttgacttaaccttgcacacgtggcgccaacgtggcaatctaaccagcaaaaaaaataaaaaaaaacatggcccacctgtcatacctatcctcaaaccaatctggcaatctctcaaccattccatctctctcacgcacgcgctcgggcaaggcagcgggtgaccggcggcggagatggagctcctcgggcggccgggtgtctgaggcagagcgggcgaccggcgacggagacggagctccccgagcagcgggcggcggaggcggagctccctgggcggtgggcggtgggcagctgaggtggaagcagagcgggcggtcgacggtggaggcggaggtccctgtgcggcgggcgtcgtgccactgaggctgaggcggaggcggagcgggcggctggcagcggaagcggagcttcccgggctgcgctgctgcgggtggcgagcggctgaagcggaggcggagtgggcgaccgacgacgccgtggtgaagggcggcggcggcggcggcgatgcgggagcaggtgtgtgtggcgtgcgggggatgacggcgcgcggggccgggcggttggcggcggcagagggggagctggagccgacgacggctcggcgggcagcgggc

SEQ ID NO: 71807 - DNA, 1582 bp, Oryza sativa
ttttgtgtggagctgcttttgagaaagaaagaagagagatcacaatttaaaaaaaaatggaaaaggaatgttactgctgagtcatcaggagatgctacacctacaaccaaactcctagctagtacactatctttctcttactctcatgtatgttcctctcttttttttagtgcagggttgattcgtccctgtgactttttatttactccactgaacttgtgacgcagtcaatccggcacattttactttggtgactgaggagtgacaggtaaatactcccgcatgaaacagagtaaaaaccttgtctgtttataagcagtaggagtaggtactacgagcgtttgcagagtactctgattttccagtgcccaaatgcttttgctgcagtggatttctgcacattttgttgcttggagaatggcttggcaggtgattcaaccaaccagcctttcatcagttcttcagtttagggcagagaggagaggaagtgccacatcgattgatcacatcagggtcatctctttgaccacttgactgaggtttcttaccatgatttgacagttttgacgacatgttaattacctctaaagcattgaacccgaactccacattattggctaatagtaatttgttcatcaggatgcacctttagtaatatcacaacatacctattctctccatccgtaaataggtaccacctccgttctaaaataagtgcagccgtaagtattcatgttcaatgtttcaccgcccatcttatttaaaaaaattatatattttttttaaaaaaatagttacacataaaatattattcatattttattatctaataacaataaagatactaagtataaaaaaatttcaaataaaatgacggtcaaacgttggatataaacggtgtaaaactgtacttattttgtgacggagggagtatagttttagctaagcaaaacaaattaaggaaaatgttgaaaaaaaattatatcttttagtaatatggagagaaaatgatgaggagagagtactattggtttcaaagaggtgtagtggaccactctgaaactattttttttctgataaattcttatgttaaaactagggacgaaagaaatactcactatgtctagaagtacaggggattttgccccattgatatatccagaaatatagtggatttatcttctcccaaaacaaacaaggactgcaagccctccatcaatcgatttctgtgagaaactaaaaaatacagagaacgtctagtagtaccactactccacaccatccgtgtcaaaaaccaaaaagattacagagaacgtactggtactactactactttgtcaaggatgttttttcaagctacacagatatactattttctctttcttaatttgtgctattttagaaataataccctatattcttggatgaagggagtagttgtgaagtacatgtatttgcggtgtttacgagtcacttttaagggtgtgttcggatgccccttttcccaacccccctcactcgtttttttcatgcacgcttttcaaactgctaaacggtacgttttttaaagggctgcaggaat

SEQ ID NO: 71808 - DNA, 871 bp, Oryza sativa
cgttgttttggcatccctagggggcgatcttgtatgtgttcatttgttggtctaacggcggtcggtcacgcttagcggcggccggttcggtgctagccttcttccggattgtgtgttggcgctatcggtgtgtgggtggtggtattcagggttgtaatcttgtactccctccgtttcaaaatgtttgacaccgttaactttttagcacatgtttaaccgttcgtcttattaaaaaattttgtgaaatatgtaaaactatatgtgtacatgaaagtatatttaacaatgagggcctcatcgtttggcatattcatatgcttatgagccaaaatttgaattttcaacgttaaatttgaagctaattttggggttttttcatcgaagtttatttttcagcctttgcttttagatcgctaagaacacatatataaaagttttattcacaaattgattttcgtttgcaaaatatgtcatttgacatattcagaaaatatgccaaacgatgaggctttaaatcaaatgatatgaataaataattgttttttttaataagacgaatgggcaaacacgtactaaaaggtcaacggtgccaaatattttgaaacggagggagtaattttttcctgctcaatagaacttcgcaccattaaaaaaaacaagcgagaacgtgtttcaaaaccgttcaccgggcgccaggcggtcacagctggtgatggcgcgacgtacgtactcctgtataacggacttgcggagttcacaccacacgcacggctcctggagcggtccccccagaaaacgacacaaaactagccgttacgccgcgttgccgacggcgagacggaaatcccgaccgtcgaagccgaaacgagcc

SEQ ID NO: 71809 - DNA, 570 bp, Oryza sativa
taaaggatataccagtaatatccctgcatgaattttgtgggatggagttttgggctgcacaggcatgtgatcctggatttgatccacacctacgcccgtgtaagggtgaaagttgaaacacctttttctaaaacaaagaggcaacagtagatgcttacaaaacatggctttatagtttcaatagaacggacaatactctgaagttttcctataagattccctaaagttgatgcttagagatttgtttttatgtaagaaatttcaagtttatcatcttatgtactcatgtgcattattatttaatactgaaactttgttgcttttatattttctgaacaggtgaatatcatgcaaataatcctgagatgtcaaagctgctgcacaaagcagttcgtgaaaaaagtgacaatgcatacaccgtctaccaacaacatcttgcaagccgtcctgtcaatgttagtgatgcttactccttactttgcagttggccaatccacagatccttttggtgttgcatttggttcaccactatatcttttacactgcaggttcttcgagatcttctagagt

SEQ ID NO: 71810 - DNA, 2291 bp, Oryza sativa
ggtggaggagcgacgacggcggggtctcgtcgcgggcgcgcgcgcagtaggcgagcgcctcggcgcgcacggccggggaggcggcggccgcggcgggggaatccgaggcgagcaggatggcctgctcgaggtcgtccatggcggtggcggtggtggcggaggaatctggggcggggcggaggggggaaaggaagaggggcgaaggggaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgctcgacgtcgggctcggcatccaattcaacatgtgtctcttggagctccggtcaccatgtttgtgaatttcacatagagaagatcacgggaggctgaggctagaggctcttagtagtgcttgcttgacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactc

SEQ ID NO: 71811 - DNA, 1385 bp, Oryza sativa
tggagagatcgttgatcaacatagtgaatcatataagcaatcacgtaagtgccttatagcttctaccttgtttataacctgatgtatgtaaaatcgaagcagctgtcttctgcaattacattctcagggttactctgattaacgttgggtacaaaaccttcgtgtatatcttgatctttaaaagatagtgtaaataattgtggtgtttgcaggtatggcaatgaggttgtggaactatgtggcaaacttttcaagtatgtccggggagcaattgcacgacctctatttaaaacttagtcaggaccaaatggaagctggagtaggtccgtcacatggtgggaattttgcatcagtccctcccaacagggggcctaaatcaaatcagctccatccttccagaaaccaaaggtcaacaaggtctgtccagtacgtctctgagtctttcaacaatggtgaaaacactgggaattctgaagcctggaagcgacggagaagatctgagcctgataatcaatttgataaccaacctttgtatcaggctcctccaatcatgacaaatggaaacaggttacaggaatctagcagttctgctggtattcttggttgggctccggttgaaatgagacgatacggcaatgaaagaccaaaaagaggtgttcatcccagtcgttttccacccgggcatgggcctttgctgtagttgttcaagtgaacaatgttgtcacttaaagcagcatcgctccaaggaaatatcagcttctagcatgccgcacatgtaaaaatgggggaagaccgttcaattgaaattctttttgaagaaaaaaaaataatgaagtgctggaacctgatgtggaccacagttttgaatccgagtctaaaagaaatgccaggggttgctgaggagatgctggcacctttagcagatgtacacacacaagattcttctgacattgaaaaaaaaacttgaggcaagaggaagagtctagaaaattttgtcggtcagttttgtgatctaatagaagaatatttcagttgggatgttttaagaaagttcatctcagcaatgatctatatagttcaacatcaatacatgtatgatctttttaagttgcaatataatgaattatggtttagttgcccatttttactacccgcctctctcatctgtgcaacatatattgtcttgatgtaacaaagcaaatgaaatgtaactcagcagcaggatgccgtgggcataggacagtattgaaacacttgtttgacatgatttttctgtaaatagaggtggaatcataacttggcgattgggccacagatgggtgatggttgtgtgcttgtgtggtaaccttcccccccccccccccccctagtgctttttggtgagt

SEQ ID NO: 71812 - DNA, 1815 bp, Oryza sativa
atatactagtcccaatagttcacttgccctttcactttgacccgtgaaaggtgcctttgtcattttgccaagtaaacaagattcgcatgtctcaaatgattcaaaatcaaaagagtgtagaagtccatctctatgaagcttctccatgcgtttctcatttatatgacccaagtgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacagatctaaatccataacactctgcttgcaaacaagaagcagagataacgttcttacacaaagctggaacgcaataacaattatttaactccaaaactaatcctgacggtaaagataatggcatagtgctgactgcaacaacaacaactcttgctctattgcccacgcgaatgtccacttcgcctcttgctaagctcctacttcttttcagcccctgcaatgatttgcatttgtgagcaactgacccggtatcaaatacccaagaatcagtagaggaagtagcatgattaatttctataacattaatacctgaggtggaactctttccatcctgctgcttctgcttgagctgctctaggtatttcttacagtttctcttccaatgatctgcctccttgcaaaagaagcactctgcatccttagcgggccctgtcttttgaaccttggtcttagagttgctagtactcgtgatttcatcagagtttagctttctcttttgaccactcttcttgttgttgggcttgcgcttatgcataaccatcacatggttggagaatcaaatcaatagccaactctcggctaaaggaaaaaccaagcttatccagactctcggtgtaaccaatcattttgatcacatgtgggttcactggattaccttctacaagcctgcacgcaaacaaggactttgaggtattaaacctctcagctcttgcttggtcctcaaacatgttacgtagtcccgtgattatcgtatgagcatccaatgcctcatattgactttgaagctcaggggacatagtagcaagcatgagacagcttatatcaagataatcattgcatcgcttttcatgctccctacgttgagcagcagaagcattgttgggcaagtcagctggaaaaggctgtgtaagtacaaactctttgtgctcttgcctgagaacaattctcaggttgcgataccaatccatgaagtttgttccagtcaacttctctttctccagaatagaccgcaagttaaaactggatggtgcaggagctgccatgatctacaatagaaatatatgtatgcaaaatcagcaccatgtctacagttaacttttcattaaacaatttaacaaaatactcccactatgtattgtaaaacaaaattccttctagtaacatagtgagtcaagatcctcattttattagtgtctagtgagctttggcatcacaactagacaactatcaaaataggtaagcaaccacccttgccttaattccacaatccataatggtggacttcctttgttgcttgtttggggggtggaacattcttctcattgtcccaaaccccaaaccttatgcccccaaaggtcaaaaaacggttttgataccccttgccaagtcacccaataatctccgcatatagatgtgtgacatctatcctattttatcatgataaaaagtgactctgtgctatggcaaacccatcacttat

SEQ ID NO: 71813 - DNA, 20458 bp, Oryza sativa
aagtcaagctttaaagaatatttctctctttgactgatgacattgaagcagagactcaaaattccaagctaaacaatcttgaatcgtcctgcccttaataaagccatactggttctggtgtattatagaaaggatcactttttgaattctatttgccataagtttgtcaaaattttcaaggatattcccattaaagaaataggcctgtaatcatttataatctctggatttagtttctttggcactaagataataaacgaatgatttaaaggatcaagagacaaagaaccagaatggaaatcatcacatagcttataatagtcatgacagattatgggccaacatttcttaataaaaagaccactaaacccatcaggaccaggagccctgtcagtaggtaaatccttgatgagctgatcaatctcttttttgaggaatggggtatgcagaatatccaaaccttcatgggcatcaataagtgaatttaaatcaaaaggcatatcctcaaacatggaaacccccattcttgatttataagccctccaagcaaccacagctttgtcatcatggctagttagaaatgtaccatccacatccagtaaagaagatatagtattctttctaaaagattcagtggccatagcatgaaaaaacttggtgttctctcctccgaatttggcccaacggatagttcatctcttttgccaatataattgcttatatttcaagtataagagaagcttagaacgaataaacactctgaaattccactcaagaagggacagatccctaagctcctctatactatccagaaagagaatgatagcattacagtttgctataagcttctgcaagttagacagattcttactccacttcttaagaccattcctcaaagcattgagctttgcagagatattcctagccgaatccgccagaacaccatgattagaccatatagaatggacaagatcaaaaaaatcctcatgctcaatccaaaagttttcaaatctgaaaatattggctcttgggatattggaacctatctaaaccacacagggggggtatggtccgaaattgatctaacaagaggcttaaccaaagtgtttaggaaagtgatagtccaactagttgaagtaaagaaccaatcaagttgctctaacaaaggctgttgctgcatgttgctctaagtataggccctgcccttaatagataattcaactagacccaggtcgctaatgacatcattaaaaagaaaaatatcattcatatcttaccctggcctatttctattcaacactgacctataaaaattgaaatctccaaggagaagccaaatgtcatcatctgcaatttgcaagctatggagccagattacaaaattttctctttcaacaccagcacagggtccatacaccgacagtaaagtccaggataacccagaatgactagaggaaaagcaaattttaacagcaaaactctaaatttcaatctgagaagcagtaacgacagagctattccaacagacaagaatactgtcagggttacgggtaaggtataccctctacccttcgatatacgtcacgtatcgatatggtatgtttgcgcgtatacggacattctcagcataggttaaggaagtccatcatggagtctacagatggaaagagtcctactcagatagaactgggtcgtcattatatcgtgtcgggtccgatgtctccgagtcctacttggagaccagttgacctacggtataaaagggaccacccgggtagacctaaggcatcgaatttcagagccaacacatccaccacaacctacgaagctagagcttatcgaagccaagtcgccgggagatctagtcggatcaactcgactacgatcttgtcggtatcgtcgagcttcactattccctttgtaatctgtggtttccatcatataatcccatatcaactggattagggctattacctaccaaggggcctgaaccagtataatccctgtttcctgtttgcttgatgtcgtactacgtagatcctcataccagcgtaccccaataccctctatatccggtctacgggtatcccccgtcgacagtggcgcgccaggtagggggacttggcgctcaaggttctactactatgacatccagcttcgtcgacaacagcgtcaacaccaacctcaaccaaggagttccaacttcaacaacactggtgtggactcaagtcgacgaaatcgtctttctggtttacaccacaatgccgatctcagctggtccgccaatggccggaaacgagaacgcagcggctacaacccggggtgactccatgttgaaggttcctcccgccaaagcggagatcggaacgtcgacgacatccgaacccgagaaggatcctagtgcggccaagccttgtctttctgacaggaatcacgagccgacgaggattacttctgaggtgacaaagtcttggtgtcctatccacaaaaccaggaaacataccctgcaagcctgctgggtctttctcaacgtccattctgaaattcgtgcctgcaaagagcgtggaattcagcgtacctctccaactcgtgatgtctattgtcctattcacaagacaaagaatcacgacctctcgagctgcaaggtctttctcagcgccatgaagacgccacctcctaaggtccagcagtcacgcatccccatcagggatgaggacaaggaacaaggagcgacgccaatttcagatcgatttgttggggtaatcgacatcgatccccatgaaccatcagtcttgcacctactcgaagactatggatcatcgacgagtacgccgcgtgaggtattgtctatcgacgatgtcggcacgtcagcgcgcaccaaagcgaaagcggagaatcaagtgactactccgacccagcacatcagagccgtcaacgcaatactgagggaaaccccctacgatcccattctcaatgacgatctcacacattggacagaatgactacgggaatcagtgaccaacctcagcaacgcgttcgaagaggccgctgctgcagcgcacccggaacagccaccaactggcgatgcaaatggtgaagaccctgaacggcgggaatcacctcatcgagcgacccctccacctcgcggcaccagtgatctccgcgatcacctgaatggccgccgagaggcacgacacacacaagacaacgagaaccattcccggcgtcatatctcttcacggcgtcacgataacgaagatcgaggaggccgttcaagcgaagaccgagaccgtgataaccgccacaaccgccacgatcacgacgatcgtgaacggcgggtgttgggcgatactagtcgaggacgtcgcaataatgacgacgatgatggagatcggcgccgagacaacagcgggagacgacgacaggattctcgagaacccagccgacgtccccgtaatcgtatgccggaaccaagcgacccatcgtcatcgtcatcatcctcgtcatcttcatcatcggatagacatccacgaaggacgcatgatcgccgacaacccaccgcccccagcgctgggtgtagagctttcggtcgttcacttcaggatgtccgatggcccgaaagattccgacttggagcaatagagaaatacgatgggagcaccgagtcggaagagttccttcaggtttactccacggtactctacgttgccggagcggatgacaacgcgttggtgaattacttgccaaccgcattgaaaggctctgcacgttcatggctaatgcttcttcccccctactcgatctcttcgtgggcaaacttatggcagcagttcgtagccaacttccaaggaacttacaagcgccacgcgatcgaagacgacctacatgcgttgacatagaacccgggcgaatccttgagggattatgttccgcgctttaacgagtgcagaaacacaatccccgagatcaccgatgcttctgtaattcgcgctttcaaatccggtgtcagagatcgctatactactcaggagttggcaacgaggcgcatcacgactactcggagattattcgaaattgtcgaccgatgcgctcatgtggatgacgcactgaaacgcaagaacgacaaaccgaagaccggaggagagaagaaaccagccaaggacgcacctgagtcaagcaaaaagaaaaatcgcaagagtgggaaaaggaaagctcaatcagaagttctcgcaacagaatacgtggaccctccctagcgcccagacccacaaggcagcgacatgaagaaagcatggtgccctatacacaagacggacagacattctcttgatgattgcctcgtcttcaaaaagtcgctcgcaaaacacatggcatcggaaaaagacaagcgagtacgcgtggttgagaaggacgctgacgcgcctactcaggaatcggactcagcatacccagattccgatctccatgtctcacacatctttggaggttccacggcatactcctcaaagcgagaatacaagaaagtggaacgtaaagtctgttcgacgtggcagggggctgtcacgcccggaatttctatccaaaattccaaacgcttacatgtgtataaaccctcgtccaggaatcagccgaggcacaaaataacaaattgataatagagtacaattattactctaattaataagcgaatataaagtcattacagaggtagatagttcctctcaaacaaataaggtctaagcagcggaaaataaaataaacagcgcaggcgactccatcccacaagcagcttgaccagggctacgcctaatcctccacaccatcagcatcactgtagaactcctcctctgatgaatgattgcaaggtgagtatatgacatactcaacaagccacgcagcaaatatgcaaatgcaggggataacaaaggatggcataatatagtctcatttgcataaatggcattcaataaatacttcagaatttagaaaaacagtaaagtatttaattaaacaatattaatccaacgctatacaacatacccgttgcataggcccaaccattctgaacaaccattcccggctgcacagttctatctccaaaccaggaatataccattccaaaccaggagctaaacaagttattaacaattacagcatcatttattatggtgagaggtatgagactaatcacaaaagacattgttagacccgcccataaccgcgggcacggctattcgaatagttttactctggctagaggtgtaccactgtacccacaagacacaacctcaacatcatgtcaaccatgcgtcgcaatacttaacaagtacctgaatagagattgtgacaatacccttcgcataacataattcaaagcagtgcaccgttcctggatcataatcacccccattataaacaaggcatggactccccagcgacccccgtgggcttatctccgccacttcacagtctggtgctctacaatgaaccacactatacaaaaggtaaagccgttgcccacgctggcttgtggttggcacggttaatgtttcacaaccgaaaatcgtgaaccggtccttaattgtcatgagcacaaccatcaaaaccatgtgctcacaacccaccattatcatattttaattggcatcttaattaatcaacctatcatgattaaccatcatgagctaccattaagccatcattaagtaatagtgaatcattaattatgccattcatatgagctagtgtctctaagcatggctaagcatcctaattacttcagctaaaaccatataatgttctagctaatcaaattattaaccaggggacaaagtataggtaatcaataacaaaaggctataacaaaggcaataggttattcccacccaatgacattcaaaaataaatgcaatagttgaatagaaacaatagctttaaacgggatcaacatgctcaaaggattgtttgggatttgtgtgacttgccttgctggccttggaactcctcaaagtcttctcctgcaaaatcggactctccgggaacgtcggaatctaagcagaaaagaccaaaatcaccaaaacagtacataaacaatcataaacagcacatgtggatatttttaacatgtagatctcaattttagaaaaatttagagacttgaaccaactaaatctgagctaagatgaattagtaatgaatttttaaagattaaactggattaaattatttatttagattttaattggattatgacgcaataaagaattatatttgaaaggaaaaaggatttattgtgtcagcgggctcgggttcacggtggaccgagtgcacggaaacggtctacggatcgaacggctaggatctaatctaatccaaacgaacggccgagatcgatctaatccaccacgggtctacggctgacgtggcgctgatgtcgacgatgacgtcatcaccggcggcggctcggcacctcgtgctagccagcgaatgatggcgcggcgacgcaaacggagggcacctacgcgtagagggcgacgcggcgaactcaccgagggctcggacgacggcggacgacaacggacggcgacggcggcgaggtcgaagcggcagagacgttcgggtcgacgatgacggcgatgctccggcggtcttcgacagaaacaaaggacgggacgaggacggtgacgacttggcgatcccgacggcggccttcccgagggacgacgacgaccggagcggtggcggcgcacggctggactcgcggcggcgacggcggcgcacgggctaacacggaggcggcgctacaagcggcggcaagctaaggcaaaggtggccttttataggggctagggggcggcgatggaggcccacggcggccggcggcgagaaggaaggtttagggttaggagggaaaaacgaatccgaatcgagatcaaatccaccggtttccaaacaaaattagccgaagattccaaaagagaaaaggaagaggagatctcgaggatcatttcccctccattgatttgatcggatcgttaaagggtcgacggaattttggaagggggcggcgacggcttgcgcgctcttgggcgcggctacggcgggaggtagacgacggccctgacaggtgggccatcattgggagaactgcactcgcgaagttcatggccgcatctcactatgcgtatcaagtgttcaagatgccaggactgaagggaacaatcactattcaagggaacgctaagctggcagtacaatgcgacaagcggagcctcgacatggtcgagcacatgcccagcctgcctgccacagcagagccacccaagaaagtgagcaagacaaacaagacgccgaaaccagacggcgcaatcaagatcattccactctccaatgccaaccccgacaagaccatcaagatcggggcatcactaggcgagaaataggaagtcgcgctcatcaccttcctccgcgacaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaacccatacgagaagagctcgacaagcttctcaaagccggtttcatcatagaggtactccatccaaagtggctagccaacccagtcatggtacggaaggccaatgggaagtggagaatgtgtgtcgatttcaccgacctcaacaaggcgtgtcccaaggatcacttttctcttcctcgaatagaccaactgatggactcaacagctggttgcaagttgttgagcttcctcgatgcttactccggttaccaccaaataagcatggcaaaagaggataaggagaagacagcattcatcacgtcgttcggggtattctgctacgttaagatgctattcggactaataaccgcaggaaacactttccagcgcacggtccaaggtgcacttagcgaccagctcggaaacaatgtcgaggccttcgtcgatgacattgttgtcaagaacaagataagcgactcattgattgacgatctgcgggaaacgttcgacaacctccgacgatatcgcctcatgctcaatccagagaagtgcacgttcggagtaccatcgggcaagctactcggcttcctcgtctctagcagaggaatagaagcaaatcccgagaagatcaaggcaatcgagaacatgaagtcgcctacaagactcaaggaagtacagaagctaaccggatgcatggcagcactaagcaggttcgtcgctaggatgggagagcgaggacaacctttctttgctctgctgaaaaagcaagacaaatttgtatggacacaggaggccgaagaggcattcattgcactcaagcgctacctataaaatccacctgtacttgttgccccctaacctaatgaagaattatttctctatattgttgccacgccatattccgttagcactgtcattgttgtcgagagagagaaggtgcaacgaccagtctactatgtcagcgaagctctccacgacgcaaagacaagatatccacagatccaaaaactgctctacgcagtaatcatgacatcaagaaagctacgccactactttcaagcccacaaggtcacagttgtctcctccttccctctcggcgaagtcgtgagaaacaaagacgttgtcggccgcattgcgaaatgggtagttgagctaagccaatttgatatccacttcgtgccacgaacagccatcaagtcccaggtacttgccgatttcgtagccgattggaccatgcctgataacaagttagacaaccaaatcgacaatgaaatatggacaatggcgttcgacggcgcactcaacagccagggagcaggggcaggattcatcttgacatcaccttcagaagatcaattcaagcatgcaattcacctcaacttcagggcaaccaataacacagccgaatacgaaggactactcgctaggataagagctgcagctgcactcggagtcaggcgactgatcgtgaaaggggattccgaactagtcgcgaactaggtgcataaagattacaagtgctctagccctgagttatccaagtatctcgcagaagtcaggaagctggaaaaaagttcgatgggatcgaggtccgacatgtataccgtaaagacaacatcgaaccggatgatctagcacgacgtgcgtccagacgagaaccacttaaacctagcaccattctggacgtcctgacgaggccatcagtgaaagaggcaagcggcgaagatagcccggtcgcccccgacaccagctcgggggctacagaggcagagcgtgccgttgccgatatcgagaccacggacgactggcgcaccccactcattaaattcaagcagccacgaagagttgcccgaggacgacgcagaagccgagaaaatatcccgtaaagcaaaagtctactgtatgatcggcaacgatctatacaagaaggcactaaacggggtactcctaaaatgcgtctcgtccaacgacggcagacacctcctgctcgacatacatgaaggggtctgtgggtcacatgccgtcggtcggacattagttggaaaagctttccgacaaaggtttttctggccaaccgccctcaaagacgcttgcaacatggttcagcagtgtgaagcctgtcaattcaacagtaaacacacaaagctgccagcacaagcactccagactatccctctcacttggccgttctcgtgctgcgggctagatatactcgggccattcccacgaggacaaggcggctacaggttcctattcgtagcgatcgacaaattcaccaagtggattgaagcgacacccacgggggaaaacaaggccgacaacgccatcaaattcatcaaagggatattctgcagattcggattgccccaccgtatcataacagacaacggctcctagttcatcagtgccgatttctaggattactgcattaggttgggagtcaagatctgctttgcctcggtttctcaccctcagagcaatggacaagtcgagagggcaaacggcatagtactacaaggaatcaagacccgcgtctacgacaggctcatgtcacacgacaagaagtgggtcgaggaacttccatcagtactatgggccatgcgtaccacaccgacaacgtccaacaaggacacacccttcttcctcgtgtacggctaagaggccatgctccccaccgagctacgacatcaaagtacacgagtacagaagtactccgatgaggatcaggaggagcagcgatacgacgatgtgaatctactcgaggaacatcgcgaacgagttgccgttcgagcagtcaactaccaacaagcccttcgccgttaccatgagaagcgcatccgagcacgcacgctttcgatcggcgacaacgtcctccgacgggttcaaaaccaagcagggcacaacaagctctcacccaagttctgcggccaggcgcattcaaaatcgcagacggcgatggccgcgagttggcaaattcctggaacattgatcaattacgtaaattctatgtataagtcaatagtatccatacttgtaagacatcttacagcctcaataaagcctattattcaggtacagacgacaatcaaagtgttccttcccgatgatcccttacccagatgacacctagcattgaaacctatcctcatgtccctttacgccgtcttgacaatgcctccgaggaacccaagggaacttcggctagggacgcccagagccgataaggccttgtcagatcctgtagagacgaaagaccatgtaagatctggtcgcgtaagagttctcgccgtgcgtattaaccaagccatgtaatcggaaataaactttccaacttcatggctgggggctaggatcagtgcttgttcaaccgaggcaggtcaaaggtccaagagccttatcttccgagaagaattctccgatgacaaggctgggggctagggagagtgtataactcaaacgactgatcgaagtcgcgaagtgagaagacactcatacacactacgtctagagtaagaaagcttagtgtcgacgtttgatgtcgcaattctggtatttgcatagtatggggattgtcggtgctaggatatatgtgagactgaggtaaaagagatggagacgaggatttttatataggttcgggcccctgaattgtcaggtaatgaccctacatcctgttggccggagccggtattgctcttattcatgataatcacaccagtacaatgtttggggtagcctatctaactactgtcgacatagcggactgacgatctgactcgtagtcgacaacagggtagccttcctcctcaaatccgtgtccggcgagatcagagatagcgctttcgtttctcctgacagtatccgaagacaccgtagggtactagccatgcctatccttgaagtcgatatccgacgtcttgtcttgaagtatgttggattgtatgttgtggcttctgttgttccgtatattgtggtggttgttgattgaggtggtcgtctgttgattgtctatccgtattgatcgtctcatggtgggtgtccccctgtcctcctaggggggcttgtatttatacccataggtgtccccttgtccaagtagaactagggaaaccaatatggatacaatccgagtagtccttgttgtttccatgtagaactctggttgtctttccttatccagaactccctcgaggtcagttttcatataagacatggtatgtggtgggttctgccgagatttagtcaactactattaggtatgtggtatccataacgctgccagtagcccccgacttcaataaaaatgaacgagttcatattctcaaccgcagatcttggaggaactgttatcgagctaacgtgatcgttcttggtgagttcagagataacgttagacttcctttgtcagccttgtgcaggcaccgaaagggtttgtctaagtcaatctctgatgtcgaccgagaaagtacagagcatacaacttagtctcccgccttgctgtaatcgaggatttggattgaagtcaagaaattttatctcggtgggtacaccatctcttcattccgtattccttgtcgagatccagcaaccgttctcgagtgatcgagaaggcgtagagtctatgacggagccttgtcgacatttgtcgtactcgccttagtcgatcttggtgtagaaccatagagacatggagccttcgtcaatgtcgaatagaattttcctgaaatcaatactcagaaaagaatattagatagaaatagccccccgagcgaacgctcaaagggtaacatgttataatataacagactagtgaattgaatgtacagaccagtgttttgtatatgagcgtcttctctcttaccgactccgaacagtcagtttatagagtcatacactctccctagcccccagccttgtcgtcggagaatcgttctcggatgacaaggctcttggacctttgacctgcctcggtcgaacaagcactgatcctagcccccagccatgaagttggaaaactcaatttccgattacacggcttggttaatacgcacggcgagaactcttacacaaccagatcttacatggtctttcgtctctgaaggatccgacaaggccttatcggctctgggagtccccagccgaagttccctcaggttcctcggaggccttgtcaagacggcgtaaagggacagtaggataggtttcaacgctgggtgtcttttgtggtaagggatctctggctaagacacttggcgatcttgtgcacctgatatcaactttgttgaagcaggggtaatgggagaatcgctacatcgctggtcgaggaccaggcagtagtcgtaactcgaccacttgaagtggaagtagtgggagaaacgctacatcgctggtcgaggaccaggcagtagtcgtaacttgaccacttaaagtggaagtagtgggagaaacgctacatcgctggtcgaggaccaggcagtagtcgtaactcgaccacttaaagtgaaagtagtgggagaaacgctacatcgctggtcgaggactaggcagtagtcgtaactcgaccacttaaagtgaggcgttagagatcactgcgtcttactgattcgagaaccaggagtaggagtctcttaatcacctataggggcgctaaagttggtttattacatgtgcatatcatgtggccagcatgactcacacacccaacttgtagcatatccggatgtccgttcgcaatcatgtcgggtgatcaagccgacggcgttcgtgaggaattatccgttaacaaccttttctcgagtagtccagcgatggccggcgctatgagataggtcgtcggtcttctttggtaggttgggcgcgacgactctgcatttgtcgagatcgttctcgataatgcggtgtactcgaccacgagctactcgagtgctcaattgttcctgaaaaatattttctaggagacaagatgtatagcagataaaatcgagtatgtactcaaaaactgcatggatcttctagtattatcaggatataacgagcagatgtaaatatcaggcattatgtaaaccgtaaacaagcatgatttatacagaagaaaatagagcgagcccccaacgttagaccgtagtcgatttaacatcggggatactcgcgcaacagatattattgtataaagaacatgctctgggtaaacataataaatcatggatctgataatgatgtatgatctgaatatgtatgataaattgcatatgaaattagtagatcaatttgaaaaaccaatctaccaattaccttattgcgtactcgttggacatcatacgatctgacatcttttggtacgccgcgaagcttgaggcttggttgatctcgatagaccaagttgttgatgacgatgatggttccgatctaatcggaagatgtacttggacaggttggatctccccacagccgaagtcgtcgagtagcttgttgtcggagagtccatctcttaaacccatctcatcgaaatcctgaagcaccaaaattcccctacctggcacgccactgtcgacgtttgatgtcgccattatggtatttacatagtatggggatcgtcggtgctaggatttatgcgagattgaggtaaaagagatggagacgaggatttttatacaggttcgggcccctgaattgtcaggtaatgaccctacatcctgttggccagagccggtatagctcttattcatgataatcacaccagtataatgtttggggtagcctatctaactgttgtcgacatggcggtctgacgatctgactcatagtcgacaacagggtagccttcctcctcgaatccgtgtccggcgagatcagagatagcgctttcgtttctcctgacagtatccggagacaccgtagggtactagccatgcctatccatgaagtcgatatccgacgtcttgtcttgaagtatgttggcttgtatgttgtggcttctgttgttctgtatattgtggtggttgttgattgaggtggtcgtctgttgattgtccgtccgtattgatcgtctcatggtgggtgtcccatggtgggtgtccccctgtcctcctaggggtgcttgtatttatacccataggtgtccccttgtccaagtagaactagagaaaccaatatggatacaatccaagtagtccttgtcgtttccatgtagaactttggttttctttccttatccagaactccctcgagatcagtttccgtataagacatggtatgtggtgggtcctaccgagatttagtctactactattaggtatgtggtatccataactctgacacttagttagatttcttttctattccacaagtatttcttacaattccatcaaaatccaaaactatattacactttttccaaagacatttgtcacaggacacggagactaccaggaaggccaacgccagtccatcgacttcgccaggccatctatctccgtaggagttctccaagaacgagaaaacccttcgcggaggaactcgaggtgcagctgcggacgatgatctcgtatacaggccagcacgtaccccccagcatatcggcttgagcgacgacactcctgcttcaaggtctcgtcgatacgttgaccgatgccttcgagctgggcacagaccccattcagccacgagatgtatccggccgccgattcctcgggatccgcacggggtactcagagctctctacagactctcaacatggatgtgcagcaactcttcagatacgagttgaaccacacctcacgaccccggagtgtctctacggcctggtcctttctcacctccagtatagtcctctcgagttccgcgacctcaaacttcgtcctccaatactggatgcgacgatccaggtcaacaagcgcactctcgagatctgctcagcatggaaacgactaagtcaagctgctcttctatcatgagaacacaacaaatcaagtcgatccagacggaagggcaaaggaaatggtaacaaagacaaccaatctaagggagtcgccgccatgcttttccacaggtgaacttcgatctacatcgccttctggcacatatggttcggacgcaagtaacgaaatgactactggcaactcaggttgcccacgctgctggacatcctcgacatcaacatctctacaaaggacaacaaagtactcgagatcaaaatgcctaacaaagctaaggcaatgaccgcacacactagggcggttgggaccaataaaagttttacaaggcatgactaaagagtacaagagagctaagaccctactcctcaaaaagcaggaggacggactcccccagatcgccgacctcctccatcacatccttgcgcgtgtcgctagccgccccctgatccaagatcttccgcagatcgagttcaggatgcaccagcctcacacacgcaaggacgtggcacgccctggtgtagatcccgttagacgtctcctctccgatcctggccgcatgcttggaggggatctcctccatcgccgtcaccagctccgcaagagaagacgtcagcaagaactcatcgggattcgccgggatggtggacttgataccgcacttcccggcgagctggtgcagaccagtataggtgacccgcaacgagccatggatttccgacaagttgttctcaagctccgacatgcagtgctcgagcccctgccgttgtcactcgttgtcggccaccagttccctcatcttctggaggtcctcgcgaacctccgccagatcgcgcgccagccgatcggcgcgctcattcgccgatgacgcagccgccgccctcgcctccacgatctcgcggctaacaccgcgagcaccagcctcgaggaggcgccccatctcagcctggagctcctcctaggtaaggacggcagccggcgaaccacgaccagccacgagatcgctggctgggccgctaggtgtcgcctcacggctcctgggcacgaccacgacatccgtcgaggccacggcaggagatgtgctggaggtccctccagacccatcttgcgtcgccttcgcccgcgccagaatagtgctacgtcataagcagaaataccacaagccataaatgggttacctagccacataattacagacagggacccaactcttaggcctgcgaaaggctgcgattgagacaaagttcgacgaaatcacgaaacctcaaatttattcacttacttctcgctgagcgtcacaagccgctgccctcgcggaggcgggggagacgcgtccgaggcctggagtacaatcaatatgatgtgaggtggaagttttccgactacgtgatcaaaaaacgagagaacttactgagggagtgggtgtcttccgacgatgtccgactacagagaagaatttcctcccctttttcggaacgtcgccaccactcgtcgtggcagcggcaacagcagcgtcagacgcctccttggcgaccttctccttcagcgacgccgccacctgatggtccacgactggcccgatgatatcagtcagagggagagcctacgtttcatgaagtcataatgcgatcccggaagaaaaatgcaaaaggacagctaagtacacttacattgatggcagcgtcgcgctcggctgccccggggacgggggtgttgctcgccgttgtcgggccgctgatcatcagttggccgatgcggcgctccacagttgcgctattcaagcctgtagatcgagaacagaatccgataagccgggaagaacacgcgcataagggagtcaatttaactaaaaaggaaataccccgaggagaaacctgggtcgcgtcctctagcctagaataatcaaaggcagaatgggctcgagcctgaagaggctggatccgcctaccaatgaagtcggcagcaacttcataccctgacaacccctgttctcggaggtcatcaacgatatcgatgaaaattggagggacggggtcaaagcgggtttggtggtccaagatggaatcttgtctggctgttcctaaggtacaacgaagacaggatccaaatcctctatctgaatatagaaccacctcccccgccatttgctgtgacatgaggggcactgaaaggggatgtatcgcgacttcaggccatcccgaagtcggaaaccaacacacctggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaagaaaagaccatagaaattcaagaccaaaaggagaaattcagaaggcggaggaagaaaaccacagagaataaagtcctcaaccgcaaccatgcgacccaggacaggttggggttcagtacctcctacttccctctccgcggtcccgcgaccgggaagggcgccatcctcctgcagtttcttcagtgacgcactggtggaggtagtcttgtcgagatccatggccaccggagatcgccggagaaaagaccgagacgagttggctagggttttttgcgggagcgaagaagacgagggacgcttggaagctggagagttttttcaacaggcggacctcaaatgggatccccaaaactcccttaaatagacgcacctccgccggtgcgaattccaaggaaaggagagagatggccgccggaaatttctaggtccgttacacacggcagtttttcggacttcaatttacattcactcatgaccgttgaacttcactcgacgttgtcgatcactccttgtctcttggtccccacaccgagaacaacgacaatttcgacatcagaagtcgcaatcgatttcacgtgttcatttaagcaaaagtcgggggctactgtcagggttacgggtaaggtataccctctacccttcgatatacgtcacgtatcgatatggtatgtttgcgcgtatacggacgttctcagcataggttaaggaagtccatcatggaatctatagatggaaagagtcctactcggataaaactgggtcgtcattatatcgtgtcgggtccaatgtctccgagtcctacttggagaccagttaacctacggtataaaagggaccccccgagaggacctaaggcatcgaatttcagagccaacacatccaccacagcctacgaagccggagctaatcgaagccaagtcgccgggagatctagtcggatcaactcgactacgatcttgtcggtttcgtcgagcttcactattccctttgtaatctttggtttccatcatataatcccatatcaactggattagggctattacctaccaaggggcctgaaccagtataatccctgtttcctgtttgcttgatgtcgtactatgtagatcctcgtaccagcgtaccccaataccctctatatctggtctacgggtatcccccatcgacaaataccaccagaagcaccccttgagggagaataagcaaacttgtcaaaatgtctaggagcaaacttcctgatgtaagaatgatcaaaaagagatcttttagtttcttgtaaacaaaagactgcacaaccactttcctccaccttattatgaatagccaaccacttatcgtcggaatttatgcctcttacattccaacacaacaccttccaattcctgaaacttgcattcatttaaacttaagataaaggagagtcacacacaaaccaggcataacctagtctacaacagcaaaagaccaaccagaagcaccccttcagggggaacatatctgcaaactcaccatctaagataaagacagaaattgtccaagactctccaacaccagctgttggatcttgaagaactattttgctaggaaccgaatcaagatccctgtacataaatctaacaaagacacgtccctgaataggatcttgctcccaccaaacgtcaagctgaccaaaagtagaaaccaccaggcaaatatattgcatagtaatgatgtagtccaagggaaagtcaagcaatagaaaccaaccctttctattaaaaggagcagcgcgccaattagggccttggtcgtgacgaacaaatttgacttggtagattccatcatacacaaaaaggaggagacaacactaacaggtctcggattacagcagacgcaaacttgaacaggccaaccgcagttgcatgaggaaagctacgtcgaacagtaaaatgttgagcttgttcaagaaaatcagtaatcaatacctgatgatcatcccagagctcttccggaagaataggctcaaccaaagccaaagcaaactcctcatgatatcggggggggctcgtagcagtagtgagatcaactctcgaaatgcgcaaatcacttccttgatgcaccacttggcccgcacgaagaaaacgaaggggattcggatttgtgttcgccataggcacaatctcgggagaaataatcagattcggttgcggaagaacagcggaagaggaagggacgtcctgcttcggagaagaagaactcctctttttctttttaacccaaacaaatttattccgagattgagagacattattaacaacaaccacctgttttttcgcattattacgggccaaacttttagcttttcctgttccaacagacttgtgggccgaggacttaactataggcttattagaagatttatcatgggctttgggacaaaaacgttcaacatgacccaaggaagaacaaccgaaacatctaacaggcaactttacagaaccgagcaatatggccatgattcaaacatcgaaagcaaatcaaagagcccaatttggaattcaaattacaatccggaaaaggaggatcatcatgcatacctt

SEQ ID NO: 71814 - DNA, 3456 bp, Oryza sativa
atctccgcatatagatgtctgacatctatcctattttatcatgataaaaagtgacactttgctatggcaaacccatcacttatgatcacaaccgtaataggtgcaattattggaagagcataaattacacttaatttttctgagggaatctatcctaccatgtcatatcaaatatacaacagcaataaagtaagacacatataaaaccccaagcgaaatctcaggggcaatgcacacggcggtcccgcgggtttcagggcagcgccctgaaaagttcacagggtacatagatctcatctatgattcgccatgtgaaaaccttaacggcgtaatcaaattatgccgaaaccaagtcaatctcattggctcctttttgtcattggcgtgcggttccagtggacattggactatccgatgaacacaatcacgctcggccttggtgagtactagacattccagtgaagtcaccaacacacttaccgattgatctcatcaacccatgcagctatcggttcatctcatgctccgatcacctaaaaacttatatacaacataatagatctcatctactacacccgcatatcaactatatgcaatgatctagatcataaactatacaagggggctctgataccactgttgggatacacgtaggctacgatagcataaatcaaaattttctatcgcgtaaaccaggaaccatgcaagtattagatcatagatcgttaccactcgacgcgctgcgcagcgaaacaaggtgctaagaagtcgaaggaattctcgcgaagtagagcgcgtcgatgtagagaaagtagtcgatcgcaccggctcgaccttcccctcctcgtgcgttctcctcgccgtactcccccgccgatcagcaccgcaaaccagtggcgcctctaccggtatccacacgtacagggatggaacgccacaggcagatgtgctagtacccgtgcgcggctagggttttgctcggggagggaagtgatggctagggtttctcacgtgatgcaatccctccgccggtcacacccctcacgaatatataggatccatcactcgggcctccaaggcccgtaggactcctattcagatccctatccgaattaagcttatattggacctccattcaatctccttattccggcctattaagcgtgcgaccctgtaggttcatgtacactcggctgtaacccgaaaactccttttcggtccacgcgtcaatagcggcccctagcagaacgtattgacccaccgggcatacatagagatcatatcggctgaacctctagtgtatacttgtatgaacccctttgcctcacgatatcaattaagctcaaggctagatatgtgccatcctctaatagctcaatcattcactcgaacctgttgatagattatataacttgtgattgactcctcagtcacctttggcatggctatgcacttccataatctacaacatcgagagacccagagatatctctccataggaggggcaaatcccatcttgattattcatatcccactacatgtttcatagcatacccgaaaagtacttttataactacccaattacggagttgcgtttagtagttcttaagtaagctactacatattttgggaaccatgacaatctcaggtctaaggattcaacaccaacactaaatgagatcactgatgacacaatacatatggctcttgcagtgtctcatgttgggtctatccaacaacatgttcgccaacatgtgtccacattattaatttagtatctctataccatgatccatgagacatgatcatcaattaatacatgtgctgattatctaaatatatttgttccacatatgatatttgatcagggatcctttagaaataacagcatataacataaagagtctcatgaaagaatcacatattcattaactaataatgagttatctatttcaaggaacaaagtcggataaatatgtaaatatagtatgtgatacaatcatctctatgattgcctgtagggcatatcactaacactagcttggtgaagctgtatcaaattaggatgatgcctgctgctaggatgccacaggttgtcttggccgaccggtgtgatcggcctacatgagtgcattgcttgtagagattttgagccgtttccacattctagtaccataacagacaaaaactagttattcggtcatcctctaatctgtgagagatccgccttccaaactctgttatgaaggagcagtattattttgatcaaaagtacacgcaatactgttagtcatataacatcatggtgtttcgatctagttttttttactgcacatagtagtatttttaaaccatccgcttgcaggagatggcgagtttgtgataggggcagagtgagcccaatggggaggaggactcagagttcagcattgtcggagatgcaagacggtgaccaggattggaggaggcgatgcatggacgaagctgactcggtgaaacctgacatccgacgggccaacgatatgggctgcacagcccaatttggatcacgctcaggacgtgtagtgtaggctgctcaatgttgcagtcccattctcattcatccaatatagtcgcgtgttgtaatctattacagtctactcccttgctaaggaaaaaacccgcttatttcatacacgaatatggacatagatatcttatgttcatatatattcgtgtataaatgttatggttttttagagagggtatcttgtgtattagtgtctatactatataggcaccatctatgttatgatatacttttttttagggtgggatttaagatatactctttgttggctcaaattttatatttatagcaagctgaaattgaattgggatcatgccgactacttgtaacctacctgttcgtactaatacaaatgtatgtgtacaatctcctctggatataaaagaagagctgaaagagtgaagtaggaataggggaattgtgtagtgcaaactcatatgtaggattaggaagcatcgtgaagcaaagtatggcatagctagttggccaaccatcgaacctacaaaacgtatccgccgtatgtatatgaaaacctgatgatatatagtctccatcatgtatgcatgacacaactagtgtgggagtacataatgaaagtaaatcagtcatcagtggtagcctacacttggacctgtttgttaacatgccaccgatttgagagtttgagacatggtggtaaagatactgccactaggaagaaacatgataccaattctacttgaaggagtgctaaactcagctatatatggtagacattaattatttggtgtgactattagtttttccctatgctccatgtgttcaagaagttttgaaatacaattcaatgtatattattgaattgcatatgtggaaaaaaagagaagaaactgagttcttggactgaa

SEQ ID NO: 71815 - DNA, 4181 bp, Oryza sativa
cgtgctcaccgcctagggtttggtcctggccctgccttttgttctgcttcttggtttttgagatctattaatctgaagtagtagtcgtttcttgtctcaagctatttgcgttaagaagacttgattagtttgttttctactgtacttcttgcatgttaagacagtacgttatgagaatttttgcactaagcgatgccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgccacatgacaaacttctcagtgatttactgatttgcattttttttctctctatgaaaatttttggtccatttaggcattccatggttgtctgaattattctagaccagtaacttgagcactgattaattatgttattcattcacaaattattggataggatcaatcatgtagctgtcctttctggaaaattcatgtctgctagatactggatgattaaaatgtcatggttgtttgtcagaattattctattgttatttggggatttgttctactaggttgtctactgtctaggggcaggggctggatgatgatcatgttggtcattttgttgtctagtgtcttgtcattcaaccctgctcgcagttcaaatttctgtgggtgctggagtacatggttccgcacttgcactatagatgttgaaatgaaccagcgcgaagtgcagtcatgatgtttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccatacaatcggggataggccgagagggtggattgaggaggtgatgagtccgctttttatgaactgtgatcgatcctgtcgttgttgctttgtactagtagtaaatggtaatgcttgacgtaatgacatgtgtcctagtggacaatgtttcaatctaagctttcaaacttagcgtgcctaacttcaaacaaacttggggtgtgtttagttcacgccaaaattggaagtttgattgaaattggaatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaatttcatagtattccataggtttcattcctttgattcaaagggctttgtaggaaaaatttctataggaataaaatcctctaagggcccctttgaatcgcaggattaagaaaacgtaggaataggaaaaacgtcagattttgataggaatgcaaatataaaacagagaattgcaaaacacaggaatgaccgtttgattaaaccacatgaaaaacacaggaattggatgagagagatagactcaaagaaaagttagaagctcttgctaaattttctccaaaatctctataggattatccattccataggaatttcaaagaattggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcaggaggcggacagataccagtatccagtacatcgcatgccattcgcatgtaccgttccaaactcctccatctcacacacttttttttttcccttcaaaacgcagtagagacgtacaaattcgttttttttatgggagggaggagtagatgttaatcgtgcgtgcatatttattcatataatacacatgcacaatctacatccctataatcatctcatctcagatgattaggtcattatatcttcatatcgatgaaatcaccataggtttctcgctctcaatggtctacggtttatcacagaaaaaataattagtataaatacgaatatccttatcaagcctagaacttaaactcgaatggacatgtttcactatgagagacctaaccagttgaggtacgtttactttgttcatctcacacatttttgtgcttgagaaaaacacacactagtacatactacatactacagttctcatcccctgaagcaatatttatatacacatcacggtcgttttctggagtcgtcatcgaagaaacacggcgcaacgatctgatcctgacagtgaacggaagaggtaaaggaaagagcaaagggaaattagccaagccaggccaaagccgcccgtttcatctccggcttctgctgatgcttttgccgaaccggcaagcaacacctcgtccgcacgcacaagcaaccgagacgacgccgtccgtctctcgtccgtccgtttcccccggcgaaacggccgccgtcctctttcctcctatcggtccatgatgcgcgggccccaccgtgccgcgggacccacgtgacagagaggagcgggcacgtttcgccgtttctgcacgccgcttgtggacgaggaggggagggagtttccactgaaaccgtgtcgtcgttctaatccttttcccagtgttttgctttgctgatcctcttgcgccatatctttgcccaagacaccctcaactttacattaaatcatgtatggtcacactgctgacggatacttacgattgtttaat

SEQ ID NO: 71816 - DNA, 3707 bp, Oryza sativa
tgatcaaatttaaagcagtcaaaacgtcttataacctgaaatggaggtagtatcatggtgtaattgaggatttcggcacaacaatgacatgtatgctgagattcagacgagattccctgtgatgtttttatacacgtgttcttatgaccagttcagaattcgttgtagaattatctgatctaatctaattctgaaatcgaagcaatcacatcaatactaccagcgataaaaacgaaaactagagggctttacgtttgacttcaacatatggcagagatacaaaaactcgtaaaggataagaattcagaagtgccaaattccttgatggttaacgttataatcacattaaaacagcacggaactcggcgagatatttttgctcactgattgaaaggtgaaagggatgtatgatgtttgataggtttataactttgtacctttgctacaactatcttcaacccctgcaattccttatccccccttctgcttagagctatgtgagatccaaatttccaggtactccataaaaatggccaaagttctacactactaaagcaacaagagcaagggcacttcccaattatccccaacgtaaggctctctaccctgttgaattctctgctttattttgcttagtctgttagtttttctgtttcattttgctgcaaaataaattttttttaaaaaaactctcgcttagaatttggagcactgtatatcagcttctcctagcttgtgctggtatcagatggaaatgatcataagctaacgattttctgttcttccctagttcgtttctagctctttttggtgtgatttgatggtgctttggagggtggaggtgttcgtgttggagatggtgtgggtgatgctcagcggctggctctcctcctgcctcgccgtcgccgactacgtcgccacggcgctcaggcagagtggtgacgacgtctccggctagaatttctttggacgaactggatataaatcatcttccatgcctgcatttgttgtttggtttctttgtgtgtttgtgagcatttatacacattgcaattgtgtatatatccgaatgttattttaatttttttttgtacgacatgatttgaggcaaattaaaatagattgcaatggatatttctcaaattatctcaactggtcggtcagtagaagactagattacttccaaagagctaagaatatagatatgtcatcgtcttcttgatttcttcaaggaccttgatctactggaaacaggagcctcctccacctcttcctcatcatcttccatccttctacgcatcctcttgtggtaaccactctcgttcattgtctaacagaatcaaagattcaaaaaatgatactccagttaatatcaatccagggaagaaaaacataatataaacaaatgagagttgtcgattaaaacaaggaaactgatactgttgaacggtgaacatccgtacagaattttatatcaccaaaagtgatcagaagcctaacaaagtagcagctacaatttggggtgaggtagaaaattagtacttcctccgtctcataatataagactttctagcattgtccatattcatatataatatgagcaatgctagaaagtcttatattataaaacggaggaagtatgtaccttcaatgcgattctctttgagtcgtatatgcgctcatgaagtatcattatttcatctgcatcaaccttgcgagccgggatttcttcacctgcccaaatacagaaagtatgtttcgaaatggccttatttacgtgctggcactggcagtatgcagtaaaagtactcaaaaagaaaaattgttacccccaaggaactgctcggttagcttgaaaaattcgccctcaaattgattcaccaaagacacagcatatcctgattgccctgcacgtgcagtcctgcccacccgatgaatgtaatcctgcattttggtgcagcattaggatttaaaccacaacaagtatgaaaaaggaaatcctaaatgcatcatctcggtgcagcatatgggaaaaatattcgcgttttgcaatgatcaggtaagaacactgaaattataaagttggaaccttagagttcagtgggaaatcgtaattgatgaccacatcaactccttgaatatcgagaccacggcttgctacatccgtgcaaacaaggatattgcaatctctggtcctaaacctgtttaaagcacctagtctcttatcctggccacaaagttatgacttagaaaaataaatttaagggatcatttctgcctcctaaaccaactaaaatgaaagaatcaagcacttttgaatatctgagtgagtaaacctgactcatttggccgctgatagaaatagctttaaatcgaaggtttctgagcataagagcaaggagccttgttgactcgcaggtccggacaaagaccatgatcatgctccctggcatcttgttcagaacatgaataagataacaatcctgaaatttgcatacaacagaaaaggtgaaacagcaatgaaagataaaatgatttgaacaatgaaacataatttgtgacattatttattaaagttgcatggactgtaaaatcatgtatgcagcatgtaatagcaacatcaaacatataggcacagtatagatcaaataagaggtgcaagtgaccttgtactttgcaggaacaacatataagtcctgtctaagtgtgtccaccaaggaatatttggaggctacttcaacctgattaaaaaaaaagctcaaggcccattaataaataataagatagcactttcctttaatattatttcaaataaatgctcttgagacaaagaaggaaccaccttaacaggattctttaggcaagcacgtcgcagttttttcacctgcaggaccgaaaaaaatttgtcacacgaccagtagtagctaaaagggttatatagatatgacatttaagtagtcctagaaaatttataagagcacaaaatcaatccaatatggtattctcactatctcaggaatgtctaagtacgtgtgattaataatcactccaagcagtgacccacgtcattctgataaatgatggacaaccagcaatgtttaatcttttggttcacattcagaggaagcataaaatcagtatttccatcacaaacgtccataacttttttatatggtcttaacagaaaagcagagctcctgctaataacataaataaataaagctcctatctgccaaccttttcagtcatcgtggctgaaaagaggaaagttctccgttctttaggaataacattaaggatatcatcgacggctttctgaaagtccactttaagtaaatcatcagcttcatccagtacctagcaaaaccaaaagatatgcataaaggtgataaaaaatagtgggttatattgcgatggcccaacaggcatatgtgttacatatatagtacaaggattggacacatccaaatcctcgattacaaatattaataccaggaatactactgcaccgtctcaacaaaatattcctaactataaatatccaacagaaaagaccaaattctgaaaaatacttaccaagtacttcaatttattaaaactgaaaccttttgtattggtcaaatggtccaaaaggcgcccaggagttccaacctaggaaacataatcaagcttagttgagatgaagaaatattacatgatatcagatt

SEQ ID NO: 71817 - DNA, 4843 bp, Oryza sativa
ttatttcttcttaattattatttgtgctctgaaaattcaagtaaaattggaggtctccttttagaccaaggagaatttaacaaaaattctccggaccacattcgaattcttctggcacgtattttagtgtttgccaatttcttttcgaattttaattaattctattattccttttagagaatgatttttatttcgggatgaatttatcaggacgtgacaataccttgcaatgattagtcgtatgagaccatgaattatgccatttgcaataacttttcttgcccaattcttcagccgatggaattgtatgaccagcagaaagttgaatctgcttctctcggagtagcaagtcgaaaatcttgtcagccttagtgatatcaaagtcatacctctccttttttcctgagttctttacccattgccattttacaacctttttactccttacccactcgtctgtagctatctcaaaatcatcatcctcatcgtccgacccatatatataaggacatacatgattaacctttctagaatttttcctagcctctgcattcctttgttcatgcaaggctaccttctgtgtaaggtgtgacaagctttcaaagtcttccgatgagaacttctccctaattggagggatcataccctgaaaagccaaatcggcaaactgggcatcagtcaaactcaagctgtaacatttatttctcatctccctgaatctctgaacatactcatgcattggctcatcatgcttttgcttgattgacattagatcggacaatttcatctcatgaatcccactatagaaatagctatgaaactgcttttagaaaatcagcccaattgttaattgatccatatggtaaagaagaaaaccaagtaaaggccgatccagccaaagacaaccggaataacctaaccctcatggcatccacagccaatgcttcaccgcactgagctaaaaatcggctaatgtgctcataagtcgatgtactatcttgccctgagaactttgaaaaatctagaactttgaacctgttaggtagaggaactttgaaccattcaggatacggctgtcgatataggtttccaacatctttcggcctaagcccaaactgctccttcgtgacatctgcaatcaaatcggcccatggtcgttgttaaggtgttccttgaggttgttgtggcatgggctcgaattggttgtattgaggaacaaattggggttgagccgatcctgcatgctggtactgaacattaggtgatggtggctgatactgatagttcaaattgccccctggtaattttggaggtctggctgaatattgcgcaacaaatgttcaggaataacttgaggaacaagtgtgccatctggttgtacatgatgaactaagtgttctgtgacaacctgatttgcggtatgctgcacaggttgaccaccaggtgttgcaaacccagccaatgcattcattggactttgttgctgaattggctgaacaacctgttgcctcaacggtgtctgctgaattggctgcaagacctgccgtcttggtggcgtctgctgaactggttgcacaacctattggattggcggtgtttgctgaattggttgcacaacctgctggattggcggtgtttgctggattggttgcacaacctgctgccttggcggtgtttgctgaatcggctgctgctgggctggatcaatggtgtgttgaggatgtaagaacatagacgcaacctggtcttgtgttagccgactcacattctgtcctgcgtgctgtggttgttccctcactaacaaccggggattgattaattggcctggagccgaaggcggtgtagtaggtgctggagccgatgctggtgccatcggctgagccgacggtgcattaagagggactgactggacgactggtagattatcggtgactaatggccgataattcgggaacactcctccttgtaggtaaaccagtcctgtagcttgatattcagccatcgaaccatcaatcattgactttaccttgtttgccaaggtgttggtcagtatgccagattggttgatcaaagcatggtgtacggcatagtcaatctgatcttgaaagttgttgaactgcacctgtgccacattgccatcttgattgaaacctccaccttggactccccgagaaccatcaccttgaatcccttgagaaccatcaccttgaaccccgtggactccttgagagttgtcacctagatttgctagggaaccatctgtagcacctttgtcactcggttgagccgagccatctggagcttgtttcccttttccatccttagaggaaccagtcccgggatcgtcagcaaccacctttattttatacttctaaacaagcgttcccttgcgagtctgcatcaatgagtacaagaactgatctcgtgcttgctgcatcatcgcgtcaaaatctttcttttgatcaggtgtgaacttttctggatcgatggtcacaaggttcccttcatcaacgtctgtgaaacctaacttctggaatctgcttaactccagtgcaggtccaaaactcgccttcgggtatgcaagtgtgccagttgatttgatcctgcaatcaacaagaaataaagatgaagaaaccgcggttaaacctataaacgatagccgatcggctaggtgccgatgacatatcatttatctttgagccgatgtcatatgtaaatcgatcggtagttataaataaataacaaagaactaaatctactcgatcggctgtagatatcaacaatatatagttcttatatcgatatatacttaaatcaagtgattgggatagatcggtcgccatgccgagacagtgtaaatcacttaggtcgaagtatatattaataacgagacaatatgtgtttataaaatagccgatcagatagatctagcatgtatcggctaatacaccgatacaactctatgttaagatattaaaacaagcagaatatacccaacgaaagcttaatatgcttagatgcgataatatctttacataaagggcagatttaacatgtcaacgaagtatatagagcaaatatagttaaatcagataagattggctgaaactccgacactaccctaattggcaaccaggaagcaggatagagattgatattctaagcacgacttaatagataaaactcaactgatgcagcattaagtatgaaaagaagaacaatatctagacaatcaagccactggaagtttcatagagtggtagatatcctatataatctaaatcaacgtcattgtctaacctaaccggctaccctcttccaacagatgttagccgattgtaggttagatagcgatattgccaaagattatgtaagttatatgataactcgatggattacataaacaagattagagtatcataaagatggaagcactaatcccgagaacacaagccgtcataacaagttttacctctgtcgaagatcgaaaccgatgcagctcaacccgaaagcaagaactcgtcgaaataaaactaaagcaaaagggtggcgatgcgccgaaattgtattgaacgtgtgcgttaattgattacatggggttcggggtctatttatacccgaaaattacaaactatgtccataccggatacgactcttatctctaacaaactctaagataccataagtctttgcggcaaacttttgcccaaacatatcactaaggaaattacataaaatatcctaattaatagatacagttgccttctcaggactctatccatgtacagtaatcatcttgaagtacctcaattcaacccgatgtcaaacaccaagtcgtattgtcggaatcggctgcatcggcttccctagtccgactcagactcagccgatcctaatcgtaggcgatctggactccagcggactcttgctctgttcttgaatcgttctccgccttcgaatccacttcgatctaatcttcttttccgatgccgatattaccaaatttggttattaacagtattaccgacctttccagccgtcacaaccgtcatcgggaagctataaaaggagctctcatcctcacttcactcacacacctcaagcaatagctgtctcatttctctcaagtttagttttgtagtatctagctggtggaataggaatagagtagaaatcaggagtctagaagcctttggaagagttcgggtatggctctagtagcttttcttttcccttttgtaagctttgtactttatttagaatactcttctatatatatttatggtattgaaatactttctaagtatatgaatgcctactttacattatgttcatgttatactgaatatatggctagcttatctgggagatgctttggtgcgggtataatgtttgcatatgcaattactctatgtcatgatgatgatattagagtagtatctggtagtttagacgtggtgtctagattacgggatatcattatttggggttatatattgcggatgagaggtgggccgctgatggagacagctcagtacgggtattcctccgcgccggtatataatcctaagttaattccctggggagggtattactccgtatttagccccggttgtatggtcatgacgggctgtcgtaaggaactcggcagtcagggatggcttctcgaagtaccaggagagcatcggatagagggtattagctagtatatcggttaactagaacgtatatatactatgtatattagaagtataggaatagattttctttctcctttctttccatttagcttagataatatattatgagaataagaagctaaagcttgagtattctatagtgt

SEQ ID NO: 71818 - DNA, 2892 bp, Oryza sativa
ggaccaaggggaaaaaaaaaggaaacaaactaaaactaaaatgaaacgttactcctatattgaaggagggtggtggcggagtccccactacactcccaacaggcccccaaaaagcgccgcgctagcggctgactacatacagccttccagcaaaatgggctacagaaccactgaaaccgacaagagagagtaatcgaacaccctcgagttccgctccttccagagctgccaagagtcgaagcccttgcgaagatgctcaggcaggcaggccctagaagaccgccaccaaacctgaagtgattggtaaatttgttaaactatactcaccacaacatgtggacgttttgcaagggatatggtttggcttgtccgaggaattccaccaatcagctgaggaaagaaaaatcatcaatagaaaagtgattatagcaagaagtaatagatactctctttgaagagagtaagagactctctttgatcagcactagcatgtctgttgatcaccaaaggaacatcatataatgcatctaataactgaaattctttgaacttttactgagcaagacaacctgctgctgcgctaagtgttttttttccacaacatttaaacacgttgtcaaaaaaacactagtaagtcagagaagcaagagcatccataaatttacaatgctgggttagctacgggaactaaaaattagtagtgattagacgatacggcaatataccactgaacattgcaagctgatcgctgatccgagcgcctcaaactgcttcgcaatctgaatcgccagctccctgaagaaccaccaaagccgcagtccagaatcacacacacattcacaataacagagcaatcaaatcgtcccaggaaagggaaaaaaaaaagaagcagagatagaaaaatttagcaaacctcgtgggcgcaagcacgcaggcgaagaagcacgggcggtgctcgtgctcgagcagcgcctggatgatcggcagcgcgaacgccgccgtcttccccgaccccgtctgccccacgccgatcacgtccctccctacacatccaatcaatcaaccagtaaggatttagccagcaaactagtactcaccgtcgatctccattgcccaattcgctgcaaaccttggagggcgaaggggatgacctccgcctggatcctcgtgggcgccttccaccccatggcgtcgcacgcctcaccagcaccgggcaaaccccgagctccgcgaacgtcgtcggcgcctccgactccacctccacctcctctcccatggcttcacgacgctcctccacctcttcccccatggcttcgcgcgaggcaatctccacctccacgcgcgcgcgggcggcgaagcggctgggtttagggcgagaaaaaaaaaagagaaaaaaagaagaagaagaaagtagtaattgagaaagatctcgctgcagcctgcagggttgcatgatgaacttggaagatggaggcccacttcacaggaaggctcatcaagtaatgggcctcaagagaaacaaagctgataatttttttagattgttttacagatttttaattttttttctaatataaaaagagtgttaattggatccataccattacaaatttgcccatctaaaaaaataccattactatttgttgctctactattttaaaattggaactgtgtcattctgtcacagtttctgtcaacacatgacggagtggtacagttccaattttataagagtagagtggcatccgactgatttgacgaatagaaatattatttttctaaataagtgaatttgtaatggcatgtgtctaattaaccctaaaaagaaataagccaatcttgagatatattttaatgtttaaataactaccaatgattatgttggggttttttttagaaaatacaaaaaattatcaaattatgatttccctattttagaatttttgtgttgaaatgtttttatatgccatgctcatgagctaatcatgttattatcggagatggatatctggtatctacctcaacttcacatatcacaagtacaatggaccataatctcttcaagatccagcttatccaagtcctaatccttcttgtatcattgctgctgtctacttgccttccatgaatgatcctttgttgctgtgaacgagctagatagctacataccatctttctggttagttatcgtctacttgtcttagaatatcgcaacaccaatcatacctctgctcctgttgcttacttcttggatcatcatgttgtccccgtttaaaatctccatctcacaattgcagtaatgaaaaccgagagtagtttacggatcagaacaaggagaagtgtatggattaagggtcgctgaagcagcatcaagcagagaaatcggtatcaggtaacataatgacactgatgacagatgagctgaatgaagttcatgttgctactaaacgaataatgagaaggcatggaacaccatgatgttgtgtacagtttgatgagagctatgtgaaaattagcctagttcagttgattgattgatcatttgatgcgcctggctaattaacattcagaaagttggactgaactgaactctgaacaagctggctgacttcagccatgcatgcatttcttggcaaattttctctgcaatttatccccgttatgtgagctgtaattagatcatggccagagaccggacaatgataacagatagctcatctttctctgaagaaccagcagcagattggatctccttatcagactgtctttcagaattggttagccttgcagatgtactaaatgacttgctgggacatgttgaattgtttatgagcagcatatttatatgcatgattgcattgcatcagagacctcacatcacttggtagttgg

SEQ ID NO: 71819 - DNA, 2147 bp, Oryza sativa
tttctcctttctgctatcaaataggatcaatgaattgttccgtgaatgctaattatattatgagaatttttccccgccaaaaaataaacgaatgaaatctgtagaaatatgctatatattaatcttgaatttgtgagaatgtcaacattcaacctttcgactatgaccctatgtcacactgattcattgtcatatctgttgatttccaaatttgcttaatcgatacatgttaaaatgcaattccaatatatatgaaaaataacaaaattgataaaatgtttgattatgctctggaaattatacaaaatgaaaagctcaatctatatgtaaatcattgattctgggtacttattcaactacaaaaggcattgccccagatcccaactttcataactttattagtttgtcatttttgtttttgatccttgcacatgatgacagtacctctgaggtattgtttcactttcaccctaaatttacatgaaaaatcctaaatgcaatttgttttacctatgtaaatgatgcaagatgcaagtgtaggagctgaaaatttctctttcagggaccaagaagaatacaaacttaacagttagttataatcataagattatatattgtgtttcattttattatcattaaactgatccacatgatgttcaagtgattacagaaatgcatagatttttttaaaagttgggtttgatagatgtgtagaattccatgccgccatcagtgatgcctcgcaagcaagccacaatgtctgcacctaggccttcagcggctccagctactgcgtgctgcagatggtacccttccattacagtgagggggtcttccagattagctatcacggtggttccttggtgtgcccatgggcatctcaccaactgtttgatgaaatgcatggtcgaggtgcactcctgttactgtttgaatccttattattatctcatatttactctattttgcactgtatgttgtgattgaaagctctgcctatgtaaactaaaactgaattgttccttggtctccaatacttcatatgttgcaggcaaatatttcatttctgcagggtagaacaccatattattttagtgtatagattttactatgagatccttgactttttaatgactattggagtcatgtcagtatgttaatagtgatatagatatgttaacctgtccaattttaccttatattcccaacacaatagctttgtttcttgactgagatttatttgtctcatgtttctactgcattcaaaagtttgcagatcaattcatatttcataatcaatcagcaaacctggacattgtttcaagggacatgtggacttggctacagtatatctatttgcttgatctttagttgcatgtagactccttttgagatttatttattttaacccacaaaaaaggagattatttattttaagatatgtccctttattgttcaactgcaactaatttggaagttcatagataatgagatgtaacagatgggccattaaaaactctctgagtccgttctatgaaatgtaaagtaagatgccatgcccttcccagtattaccttattactgttatctgccttcttttattgataaaaaaaagtcatgtgaatcttggagtggaatattaaaaaaccactgcatacaacattgcattatctggatgagttatcatcaagcatcatactgctatttctaatcagtgttgcacatgtatttcatcaagctcctttgttactttctggctacatgaagtggagttactaatatattgctctatgaagtgaaagtttcttcttgctcaaaaaactactcctataataaaatggctaaatatgccaattttctaccactactgaatctgaagttcaactgatgtgcttcattcccatgttagccttgatatggtcagccaccagtattaatattaacaaatttcctgtcatatttgagagaactgaaaccgcttctttgaaatgggatctaattgttgaaatatgttttttttttcatgtttgtgcatgattggagtatctcttttttttcggctgtactgaaatttggtttgtgattaacctgtgaaagtatctgtttgcactgctcgatatcctttattttgaaagcgacatcccgag

SEQ ID NO: 71820 - DNA, 4474 bp, Oryza sativa
cttagctgcatctttcggttcctgtggctttacttacaaggcatgactctggtttgttccaaacctgtggcttactcttttcacaagtcaaaatgtttttccccctgtaagatgtatgttttgccttcttacattgatcacttctgggttagatggatatgttatattcagagaaaacatgtgctccctctggtttttaattttgacaatgtttacttttaaacatatgtttgacaattcgtcttattcaaaaatattgtgcaagtatataaatcatgcttaaaatactttcaataataacataaatgataattacatatttttttaataagatgaatgtaactatgtatgtccaaaaatcaacgacgtcaaacatttaaaaccagagggagtacaaggtttccacaaaagtatctaagggattttcctttcttattgacaaatatgtttgtgctatacgttgttcaacatagtacttttagtcttttagataagggtaattttattatcttgaagaaggtaccaagatgtaccacattttctagtgtaaaaatttgataacttcaggtactaaagttttagcgtaaaatttaggtaattcaaggtactttctcaagaactataaaatttctctttagataatggaagagttgttctttctagtgtttttgagcttggtaaaatggatcattttttaacgacttctattctatctctataatttataagaaattgccaataaagatcacaatgttaaatatatttgatgtttccaatctaaaaatgaattgttctaatctccagggagataatactaagataatggttgaagaatactctcaactctcaacgccacaaaacctgaaacggacagttaacattagcttacgtcatgggatataatatgctcttgttccggcttttggaaaaaagtctaacgaacgcaaccgcgtgaaatgaccaaataaacttgttcaacagaaacaacaaaacagcaggcgaggcatttgctgcagtttttctcttgtttttattttaggtgtagtagtatcagtttggtaggcatcgttgacgcctttagatcttccagctatttctgaatcatcacaccctgcacgttaaaagttcagatattttctttctccctttcatatattctttggagctcctgcaactgaactcaacgaatttcaaaaaccataaattcagtttggatcaaactctagtaattaaacgaaataccaaatcagaaagttgtccggcgaaaaaaaaacaaatcaagaaagttctctgaatttgaatttgcccgaagaacaaagagtaccattctcaaattatatccgtactccagctgccatgtgccaactattcaccatcgatcttaatacaaaagatacgcgctttgcaaattcgcgaaaaaaactattcaccgttaaatctataaaatgataaaattagcaactcatcaattcgatcgatctatcatcattcagtagcatttataaagaccagctcagatgccagtaagataaggggcccaaaaagaagaattatgggagtttgatgctatccttctttggtccatgtccatagttcagtaaaccaaactgcatgatttgcattcagttcttcagctttccatgtcccctacttgagctcattttcctccattctttgccactgtgtgggatctcatgttcctcaaactgcagacatgaagtacttcgaaactttatgcacgtgatctgaacagtgttctgccatggataattcagggtttcagaacatagatttccatgccctgtctgtacaattctacagtctttcagtgaagttataattgtccttgattggaaatggaacagtttttttttcgcgaagaaatggagcagtagtcgtgctatgcttttactccctccgtcctataatataacaatctagaaccggatgagagatatgtccagattcgttgtactataaaatgtcttatccgattctagattaccatattatgggtcagagggagtatgttgtttaacaaagattatggataaaaagaaagaatcattttcagtcatctattggtcaaatattaaattgcttggattctccttcgaagcatctgattggttgaaaatactaaaattctcaagcataaaattagtgtctagaaatgcttatattgcgtataaaatttgaatcctaaatgtttgagagtggagatagcaccgtttgcttagcaacctatgaatagaatatggttcacataaaaaagaaagataaaaagcggaggaaatatggtagaggaggaaaatgacagcctctcgttcaggttgaccatgacacgttcaggaaccttctttccggttgtacaaaccagtctattcacagccaacaaaactaacaaaatgaacaaacaaattcttcagaattaagaaaagaaacggcaaaaatgttactattccagctcaaaacaggctaaacagaattgagtacctactccctctgaacctgtaataactgattaactgagaattgttaattaccaagaattaccagtcctaaagctactatacaactcaacatcaagcaggaaaaaaaataacaacctctgaaaaaggaaaaaagaaacaagaacaagaaaactgtcaaaagttcagcttaatcagaagaaaatatatatacgcatccactaaacccccacgttcacggctaattccattctcgctttcccccaattcgctttcttttccccctttcctcgcctctccgcaaccgccattgccaagaacctcacctcgtcttctcctccttcttcttcttcggcggcggcgatggaggacggctgcagcaaggttgtgagcggtggtgggagcgggagctgcggcggcggcgccaagaagccgttccacttcgcgcggtcgctgacataccaccaccaccaggggcaccgggtgctgccgccggcggcgaagtggaggcggcaccagctcgccgacgagccgcgagcgcggcccaaggacgtggtgctgtacacgacgtcgctgcgcggggtgcggcgcacgttcgcggactgctcctcggtgcgcgccatcctgcgggggttccgcgtcgccgtcgacgagcgcgacgtgtccatggacgccgcgttccgccgcgagctgcggtccctgctcgacgcgcgcggccgcgccttctcgctcccgcagctgctggtcggcggccggctcgtgggcggcgccgacgaggtcaagcagctccacgagagcggccagctgcggcgcctcctcgacggcgccgccggccaggacccggcctacgtctgcgacggctgcggcggcgtccgcttcgtcccctgcaccgcctgcggcggcggccgcaaggtgttcgtcgaggaggaggatcgcgtgcagcgctgcggcgattgcaacgagaacggattggtacgctgccctaattgctgttcttgatcgccaaaaaacacatgatctttccaattcaattcgagctgctaattactaaaggattagaggctttagaatcaagaacagaggcgcctttcggtttctgggtgtgatttgtgttcatccgattcatttggggaatctggatttgctgctcatggatgagagaacgaatcgttcttgactccttgatgcaaaaattgccatgaggtgtggcgattgaaaaaaaattaataagagccgatggctgcatgtatgtattgtatgtaatatatatgggagattgtcactgatattaacatgtaaatacatgagtttgggttgtgtatagttcttgattatcctcatctttttccttgcctgaactcatcctatgacctgtgagttgtgacttgttcttattgaatttcttactgaatagatgactctacaattcaaaacaatgcgttatggaaatgatccaactgtactaacttaaagctccttagttgtaatcatgttctcctttggctattctctaaattggagtttaacttttcgactttttgtttctttattgaagtgcactgtatttgaatttggctttgaaccagtagaccccactcccatccccacatagtttttgagaagttttggggagttcttttatctattcatcgattgcattcagaagaactttttagtgatgcaactagaagctctttggggtcaatacattggtgttactcgccaattgaaatcttaagcctaattgtagagcagataatgcttggactacagaattaggtagtagcaagatgcatacatgttggtttgtttctgtttctgcactcgcacatggatggaagaaggatcaaagccaaaaataaatgcacgaagagatacttcttgtttttctcactgcataaaatttcctcttttttgtccattcatttattgatgaagtgtattacctgagtagttcttgggtcaagttatttgactagcaaggatgttttatgttggagcat

SEQ ID NO: 71821 - DNA, 2428 bp, Oryza sativa
catgttgagctggtttcagcatctcccctcctatttcgcccccttggggctgattctttcccgcactaaccatctccttctcaatggaaaacaatgctttcttagcctgttcaggtttgtgcatctgaaccgatttctttacaggactcgtcacttcctcctcctccccatttctggcctctcttccagtaactactgccccagaatccttcctcctccaagatggtgcatcactccccctactactgctatccccagatcttctctgcgctccccccccttccacccaattgtctcatgttacttccctcctcccacctcctcttttctgggatgaaccgcagttttttgctataacgttgctcttctccctcctttagctgcacactacacactttatcagtatgctatatgatcccacatgtatagcagaagtacggtaggaactcatacaccaggggacaccatatctccttcttccccttcgccaaactcagagttacaccacgcatcaggggtttacgaatatccagacgaacctttatacgaaggaactgccccacagcagtgccatccttttccgactccattcgcatgaattcacccacctctcccccgatcgctctccctatggccttgttcatcatgcataaaggcatctttgaagccctgatccaaataggaacaaaggcaaacaccatctcctccaaaacctttgattcatcataatccacgacgatcaccagatctttaccaaacatccagggtccatcctccagagcatgccgcttcccggatgctgatgaaaggtaaacaggaaatggttctcgcctagatctctgcacgttattcccctaatcagacaccagatcttccccagtgcttgcgccaaaccctccgcgttcaccactttctccgccaggaccttcccgatcgccttcggatcccctgatcccatacttccagactccgcctcgcagatccggatccccttcttctctgcctccgacaattgcatgcgcttcatcagtgcctgcatcgcctccatggtgccctccgaaccctaaaactacccctccccggctagcaaggtttggctcggctccaaaacagagaatctaaccgtggacacagaggaaggatgggatgtggactcaggatctagaccgaagagatcgatccgactcaggatctagaccgaagagatcgatccgatcaggcatgagaccgatggggttgagagaagattgaaaccctacccacgcagaacccaccttgagtcgcctaggaaccctaggcgccgaggacatggttggctaaaataaatttaatatcaaagtgaacacatggtacacatatcagatattaaactgataagaacagatactacacttgatcttagccaaaaggccgagaaaggtatgatttggttacaaaccctgggtcatctcatatacccatgtctcctctccaatcaggtctagggcgcgaggtgggactaatataaaaccacgcagcatatatgccatgttcgagcctgattgggcctcagattgacggcccaaaagaatcagtatatgtgggcttctcccgtgcgtaaaagcccagggcttcgtatgccgtgagcaacgaggccgagaccgagacgcggtcgcgcgctgccacgccgaccaacttcgcccacgcacgacgcgacgcgacgcgcccaccgcccaccacgccgtccgctggtcggcgccgtcgcccccgcccgcgccgcgccgcgccgcctcgcctgtccgccgtgtcatgtctacgtcgaacacgcacgtgtggccctgcgctttgcgcgtggaagctatagcgatctctccttctcccttgcgtacgtgttgctcgtgcgcacggcgcgcgtcgcgtcggcggcgtggcgtgtcgcccagcgtgcgtgcgcgcgcgcgccaccgcggcggcggcggcgaaagtcaatggcgacgcatgtcagcgtgcgtgtgaaacgaacgcgacgccgcctcgcgctcctccttccttgcaagtaaacgcttcatctgtagtgtaatagtagtggatagattaatagggataaacaaaatctccttactacctactagctgcctttgcttctagtactgattgttctttataatcttttagtacgtttcatcaaagtttcttacttcaagaaatgcatttcattgctccacgagaaaccgtgcaggtgcgtgcttaaattttatcaacagctgtaatggaagtctttcctcaaagtcaatttgattatttcgaatacactcatatatatacataaacaacaaagcaatcataacaccatgcgtctaccatgtaataatgtatagtatataatacctgtatttgtcattatttagtggactctgcttagttctcctaaaataatatcaaccagtgc

SEQ ID NO: 71822 - DNA, 1584 bp, Oryza sativa
ccatctggtcctggccccttcaggtctccaattgaatctattgatgtctttatttcttcgacaataaactcagccattaagcattcattcatctcttctgttactttcttcttcactttgcttaagaggcgctccgggtgctgacatccattggactggaacatatttttgaaatactgcatgatgaaacttttcttctcctcttcactctccacccagcttccatcttcctttttcagtcggccgatcctattgcttcgttttctctctgaacacgttgcatggaaaaaggatgtattgcggtctcctttttgcaaccatgccacatgcgcccgttgcctccagtaggtatcaacctgctcctccagtttctccagtttgtatttcagcaccccttctttcaccaccttctccttgcagatatttcccctgcggcacgcttccagttcctttttcagcttctttattctcttttccagatcacccaggacgtttgtactctagtttgacaaacctgaagctaccaccttcaccgcattcatcacatccttctgccaaagttgaggccatctcccaattctcgctcaccacttccctgcacttctcttcagccagccacgcagcttcaaacctgaagcttgatgatcccctctgcattacccccttccttcccccacatgtagtaatgatcactggccgatggtcagagtgcctcggatccccattgacaacccgaaagctcggaaacttcaccctccattcctgatttgccaccgcccggtccagatgctccctaatatagccctcttctgtgtggctattattccgccaggtaaacatgtctccctcaaaaccgatgtcaatgaggccacaatcaggtaaagtgtcccggaacttgtccatctgaggttggcacttcggcctacctccctgtttttctgcagctacgagtatctcattaaaatctcccgccatcagccatggctgagctggattcatcgccaagcttcgcaaagtgtcccatgtctgaatctaagatcactttgtgcctctccatacacccctataaatctccaacttccaccacccccctcttcaatatccacatcaatgtggtactttgacatgcttctaagagacacatcaatcctcctcctccataacactgcaattcccccccttccttgtccttcacaatctttcaccaccatattaaccaaacccaacatccacctcagacactgcattcttctcttgtctaattttttttctgacaagaaaagaatatcgatcttttccgacttctgaagatccagaagtccccgaactgccgggcggtttcccaacccccgacagttccaagccactagcttcatttcttcccgcaggactggatcgcaagtcccgcttccattgggttttgttcctcactattctttagctctccctccttccttcgctttccgaaacttcctcccctccctccatctatcttctctttcccgggatcaccgtccccgagcctgctggcaaaatcttacctctagtctcccatgtcattcttttgaaagttttctgtttgct

SEQ ID NO: 71823 - DNA, 667 bp, Oryza sativa
aatccagcccaaagctctcccttcctccttcagcccgctgccaaagtctccttttgtatcatacccttcctcctctccctctctttctccaccaacctcttgggccatcctttcccgctgacccaacctcctcttccctgctccttcccacgccctgcctctcgcgccttgtcgatcgccctcgtgctctagcaggtggggcccacgtgccaagcgcgtaccctagctgcgccatttcactctaccggccaaaacccttgtgccgcccacgccgatctgcctcctcccagtttgtttgctcttccaattgattgcaaaaattggttctcctcctcctcctcctcctatcatttcccagtgtttctccctcttaatttagcctttattacccgaatttactctccgacgaactgttgccattgatggcaggctggagagctcccccggcctttcctctcctccccttggcttacaaagggtaggcaacctcctctccccctcctttggcattccggaggtctgttgctctcttttcgtctcctcacatctatacctcgccagcgaactacagctgccattcctcatcgagccgagctgggcaggaacccggtgccaccaccctcggagtcgcagccaccttctcttccccagtctcacgtctggttcg

SEQ ID NO: 71824 - DNA, 2534 bp, Oryza sativa
caagcacgccaaacacatgtttaactttgttggcaggatgctccttgagtggtgattctattgaactgttgtgaacaaactaattattggatgctgaattgatgagtacatacgtatacgtatacgtatataccaacaacctacctcagtacctctaattggcccgttggcttttgtttcagaaatcagaacaacattttctctacatttcaaatctaattcatcagtaaggatcatcaaaatcataatttgtgctaattagtaattttcatttgttttgcatagtagtgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctgtctatttataccatttccatgaagtgctcgacaactcacacccatggccatggtgcaatacgtcaccggctacctgtgcctctccttggctctcctcttgctcactctcgtcctccacaaggtggcgaggaaggcgaccggtaatggcgccggcaagccgaggcttccgccggggccgtggcggctgccggtcatcggcaacctccaccaggtcgcgatgggcggcccgctcgtccaccgcaccatggccgacctggcgcgccggcacgacgcgccgctcatgtcgctcaggctcggcgagcttcgcgtcgtcgtcgcctcgtccgccgacgctgccagggagatcaccaagacgcacgacgtcgcgttcgcgacgcggccgtggagctccaccatccgcgtcctgatgagcgacggcgtcgggctggtgttcgcgccctacggcgcgctgtggcggcagctccgcaagatcgccgtggtggagctcctcagcgcgcgccgcgtccagtcgttccgccgcatccgggaggacgaggtctgccgcctcgtcgccgccgtcgccgcggcgcacgccggcgcagcccgtgaacgtcagcgagcggatcacggcgctcatctccgactcggcggtgcgcaccatcatgggcgacaggttcgagaagcgggacgaattcctggagggtctcgccgagggggacaggatagcctccgggttcagcctcggcgacctgttcccgtcgtcgaggctggccagcttcgtcggcggcacgacgcggcgggcggaggcgaaccaccgcaagaacttcgggctgatagagtgcgctctcaggcagcacgaggagcggagggccgccggcgccgtggacgacgacgaggacctcgtcgatgtgcttctcagggttcagaaggaagggagcctccaagtgcccctcaccatgggcaatatcaaagccgttatccttgtaagttgacaagtacttgttcttcacctcttccccttttcccctgcgaaatcactaatacgcgatcggtcgctgaaatctcggcgaggccatcggttttttttcttgccgttacctttccatttttgccagactcctgtgctcgagatctttgttttttccgtcgcttttttggctgttttttttctgttaccgaatggtgacgcgcggcgatcagcccgttccccatgatcctttttttttttcactcgcattacttttctgtttttagtaagtttatataactaaaggtggtacacatcaaatttacacaactaaaatttatatacccaaagtttatacattccaaagtttataggttaaaagtttatatacccggttcaaatttgaattcaaatttggattcaaatatatttatatatatatatatatataatatttctatacataaagtctatatgtacggaatttcatcaagtttatacatctaaagtttgtatacccaaagtttataagttaaaagtttaaatagcctgttcaaattaatttggattcaaatatttttttatatagaatatttctatacataaagtttatatgtatgaaatttcatcaggtttacacatctaaagtttgtatacccaaagtttataggttaaaagtttatatacccggttcaaattcgaattcgaatttgtaagtataaagtttattcacatgaatatatttttcaagtgtattagatttctttttatattttttaaatggtttaaaattgatagtgtggtagaaaggggagacgtgtgcggggagggacgcgggtgctgatagtttttttttatcgcttaaccctccctccagcgagcgatcgcg

SEQ ID NO: 71825 - DNA, 15694 bp, Oryza sativa
aatctaaaaatggagtctttgtgggacggaggaaatattaattaaactgtcagataagtcaaaattttatgtggcaccaaaattaaatttctgttcgtactagtcacaaggctaagcatgagagtttgagaggagaggaaaagagaaaattgagaagatatgcaaaacgagttcgcatgatttgttgagtattaactattttaaattgtaaaaatggattaatatggttttttaaaagcaactttcccatagatttttttaaaaaaaacacatattttagtagtttggaagcgtacatgtggaaaacgaggtcttttctctctcgatttcccagcaacgaacaagttagagatgttgattcatgtaatgtgcaaatgggatgttcaggacaatggtaataatacttttagaacaatcttccccttcccaggtggagttccatcatatgatggaatgggggggcagtaaatacaaaggttgtaaaagcaaagatggtgatagtagagaggggatttgggaatgagatcaaattgtgatgcaatcttagggattaactaaagagttgagagaactttttgttcatatgggttgttggttctattcttggtgttagatggtggatattgtcatgtcctgataaatctcaagcactaaaatatgcctaagaaatattttaaagtcgctttgattatttttcttaaattctccatgctctaaattggttccgcaaattttatttgaatttttagaacacctaaataattataatgcaacatcaacaaatttcaaagtttattaaaatgaaaaaactaaaactaatcatctccttcactttgggccgaatccagcccaaagctctcccttccttcttcagcccgctgccaaagtctccttttgtatcatacccttcctcctctccctctctttctccaccaacctcttgggccatcctttcccgctgacccaacctcctcttccctgctccttcccacgccctgcctctcgcgccttgtcgatcgccctcgtgctctagcaggtggggcccacgtgccaagcgcgtaccctagctgcgccatttcactctaccggccaaaacccttgtgccgcccacgccgatctgcctcctcccagtttgtttgctcttccaattgattgcaaaaattggttctcctcctcctcctcctcctatcatttcccagtgtttctccctcttaatttagcctttattacccgaatttactctccgacgaactgttgccattgatggcaggctggagagctcccccggcctttcctctcctccccttggcttacaaagggtaggcaacctcctctccccctcctttggcattccggaggtctgttgctctcttttcgtctcctcacatctatacctcgccagcgaactacagctgccattcctcatcgagccgagctgggcaggaacccggtgccaccaccctcggagtcgcagccacctcctcttccccagtctcacgtctggttcgccacaagaccgcatgaagcgtgctcggccctcaactagtgaagaacatcatccttctccaccttcacagccattctccgtcgagcagggctgtgccagcccgtgccgccactgtcgacggttgcgtcacgccttccttgtccttggcatgccctttcccgagcctagatgccaatgaaacaccagcccaccctagcttttttcctctacctacagcccctcccgcatcgtcggagcgtcgtcccgctgcaccatcgctgtcgccggtctttctctcgttgagttctccctagtctatgccttcaccaagctccgccagcaccggagcttcatcctcgccatcaacccaagccggctatctttcctactccatcaccgtaacctcctcgcagaccaaagaccttaggaacgccaccctgttgtcgtcatcttcctccgtctgtcattcctacctcgtcgaagcgccacccgtggtcatcgtactctccatcaagtcagcacctccatgcgcatcgttgtctacctcttcaccaggcccgaagatcgtcagagccgtctcctcatcaatcttctccgttcatcgccgccacagcaagctcatcaacgattgccactgttaatccctcaccgcatcgtgattgtggtgagaactctcccctagccgtcctctactcgtcctccccatataggcacagtttaaggtaatttgatcaactagaaacaaaggaaaacaaatgtggttttcagtctgtaaatgcctgcagatcaacatttctaaccaggctatgcttgttgctttagcaacatgcatgctagaaaattattctcaaacgctattgaacctgcgttgatcgaaaccatattttcctaccctgctgcatcagttagtcttctagcacaccaacttgataattggttgtcgatcttagcataatatatccagatccgttcttctggttacatggaggtagtcattaacactgatcttgaggcatgccgtgttgggtttagtcccagttggtaattgatgatgggggagaatgacttcgatggtgggagtagtcctcacccatgagactagtcttttgagttgtataggcctaggacctaaagtttgtggcttcggttgggcctatggtggagcaggcccaatgtgatttgggtggcccacggttggtgggccgagctgcgcactctaacaagtggtatcagagcccagtttcgaaatccggaacgatttccatagctcacatggtggagaggccatgtaacaagtcttcggaaccacatgggttgatgtgacgggggagactgttacgcctgatgtgtcacagaggatattgttcggtttactcccacatcggtaattgatgatcgggtacatgacttaaaaggtgggggcagtcattacccatcagactaatcttttgggttgtatagtcccaggatctaaaagttgtggctccggttgagtctgtggtgaagcagacccaatgtgacttgagtggcccacggttgttgggtcgggctgtgcactaacatgccacgaatatgtcagctagaggatgcaatgggacaatgccgaagtgtatcttggattaggctagatcgcctgcgcatacttcatgcatgtggctagcttggatgagcacaagccggtagcgagattgtggtatgactgatgatgacgtggcggtgaggggaatatcaaaggggacagaagatacaatgaacatgagtaaaattgacattttgagcttcttctccttcgagaaaagtacatacaatgaacatgagtaaaattgacattttgagcttcttctccttcgagaaaagtactaactgctggattgatggattggatagatgtctaaagctcccgttggctcattttgtcaattttgtaatcacttctgtacactttacttcttcttcttaatttcctttttgcttaattcagataggccttagtacagatgccatgaccactgaagagcactctaagaaaattaagtgcaaacagcatattccggtataagtcgagctaaattttgtaactcttggtgtatcttccgctaaaatgcttactcctgatccctccggagcctaggagtctattgaaatcttcgaggttgaagttacacctactccatacgcaaatttgtgttggtttaccaaaagcagtactgcagaccaacagccaaattatatcacaaacaacttctacattgtccaagctctgaaattctcatgtttcaagaatgcctccttcgtactgaatactgccaagttatcacattgaagtatatttatacaagttcagtgcccagctaacattggaagaaattatcaaaacaggtctcatgttgggtttattgcaagcacccatgtgcaaatggctgtgcacgcctttgtgtgaggaaatcttcgagttcttttttaatttcaaattttgttttttcagtgactttcagctgttacattttgttggtcagaccatttgggaagtggctaataaacgcacttctttttggttattacggaatatctatacttaatgatcgatccctcatcgcccgagacttcattaatcatttctatgattctctgatgttaatttcttttcttttcttgaatgcacaacaatttatgtatcatttcattcagaagggaaagaaaaacataatcgggaaaagggagcagtgtgcagcctcacctgaaccaccaataggacttaggcattacaagaaaaaaaaaaacacaaaacctcacccaaatagggctaacgagctagtaagaaactcgctaagaaaattttaggatcccattttacatttcgtacatgggcctcaaatttctaaggaaagccataaatagtgaaaatggtttacatcttcggcctttatcaacaggcgcgaagccaaattccaaactcatatattagcatgctctttttgtcaatgcgctaatcatgttcctatgttcagataccataatcagagaagagcactctaaaaaaattaaaaattaagtacaaacaaaatttaacgatacaagtcatatatactaaattctgtaacttctgaattatctttggctacaaatgtgccttctgatccctgccgaccatacgagactctgttgaatgctttcaggttcaaagtacacctatagtccatgcacaactttgtgtttttttgaaaaaagaaattagaagaggctcctacagtgagcaaatatattaaaatttaaaaaagattacaaattacatatgtacgtaaaaaaaaatcaaagattgtctagctattctaacataattaaggggtttgagactatcttttgccctatggataaccaaggaaaaatctttttgaatatatccttacatacatgaaaataaggatttatgcctctaaggccctgtttggaggagcttgtcccagctgcagctttttctaaaagctgcttccgctagaagctgccaaaacagtccacagcttctgagaatctgcagttacagattctgaaaaatgaactaagaagccaaaagttgaagaagctaggtttaaaagcttttccagattctcagaagtttgttaccaaacagctgctcagaatctagagctccccaaacagtccctaggcctcaccacaagcagcacagcagaccagtagcaaagcatgtcagtagcgaaaggtgcatacgtggcatatttttatctatatggtacatttaaaaagattaacggatttatgcactttactcctctctatattgtatggatacaatttagtgcggaagccaaatgttctcatccgcttaatgatattgctattttcatactctctggtgcaatcacatcaacataattgatgttatatatcaattttatcaatttccgccacaaatttgcccaagctcaggtacatgtttcttctcaggtttgatctctagctgaagctatatcagattaggaagcctccgagaactctggctcaatctcttcccccctagcaacaatgaatgaaaactatgtagtacaaaccacatatatagagcaaaccggaaaactaatgattgatatggaaatggatatatgatagatttgtctatgtcattctgagttaaacttttataaagttttcagatccaaaagttttacacagggtgacgtggataaatctcatacgtctattcttagattcttttgaagtacatatcatgtttgcactactttttaaaaaaattttactacgataataagaacatctggtactagccgctgccaccaccggcaatgaccagagcaaacaacatcgcctttatatatcaatatctattcaatacaacttcgtccatgcttctcccctcgtacaaggcagcagtcagcctacatcctcccactaatggttcttcgtgtgtataatttgctttcgaccatatacttcttcagcaaaatacgtaccggtagtacatgtttcatgcaagagaagggaggcgtaagatgtgcagcatgtgggcataagagagcggtcgtcacactgaatgtgggttgcattagtgggattctggaaggtgctaatgtgtgtttcggttgtatatgacttaattactcccccatcgcggattagagggcgtctatttttattttttttggctttccacctgttaaagtgattggaatcggattaaacatactagccgtcaacccgtgcatttcacggactatttttttataaacatcataaagatttaattacattggcttagattaaaataagagttagtaagattaacaacttgctaatcaatagaaaatacttgatggacagtcatatatagcttcatgtcaattaattcttattaattatggatttagtaattgctaaattttggaaaagccaataataaactaaattttggaaacgccaatactaaacaatctacgatatttttaatgccatgtttgcattcatacgcagcacgtacagcttgcgtaactccactaaagctacaaatgcacatgcatttaaattccatttttctttcattgcatgaccacatatataatgcgaagtttattgtgcatcaattgaataaaatgtgcatggtgtaaaatggtctcaaacaatttttagaacttgaatttggaaacttttaccaaataacgataaaaactttatagagtataattaataaagtaaatctaatattagtaaactacgtcacaaatacgaatgatagaaaattaaaaatatattgtaatatcaatatataagctagaataataagaaagttagagcgcatacagacaagacagatggctcgtacctgaattgcaacgaaaattagtccgaaaatatgcagcggagtacatttatgaattatgaatatggtgaccatcgatcgatgggcttattagttgcaaacaaacttgttgatttgtgaatcaacatccgaatatctaaaatttacatgattagatgatgtatactgacggactcagtgaaccctaaatataaagggcgttgttgcagatgaaaagattgcatgtaaagaaaattgaattggaaattagacattcgaataaataataattgaaaaggtagcaattagaactcgatcacctgtcgttgtgcggtttgagtggccggccgaccttggcttagtctgggcagaaatcatctctggtcatcacgatgcgagcgacgtggtttgtgtgcgccggccttgcgagcagaacggcatggacgaaggatgtatgtgtctgtaccggccgctagcttcttgctggccgccgccgacgtttgcgatggccatgcatgccgtaccccattgcagttgatgagatgcgtatacattgtacgtgcaaaccaatagataatctagattagattgtggcccaatatcagtttaattgggctttttatagcacatgataatctatggtcaagatattataattaatcaaatcaacggtcagatttttctaattaacgtgagagcttttaaaaagtgcccgattagtataagtatagatagatagatagatagatagatagatatagaagtatagatagatatagatagatagatagatagatagatagatagatagatagatagatagatatatatatatagatagatagatagatagatagatagatatatgtgtgcgatcaattagggggtataaccgcgagaatgctagctatcgtgcatctgatgggataacgaaatatcatggttttcttttctagccacccgtgactccctctctctctcacacccccttttctctctcccacgctcacatgggagggcgaagctgtttctcttccctgtgcgccattgggaacccctgagtctcgtcacccttgcttcatcaccaccaacaccgtttctctggcctactgctgctaccggtgggaaacccctagtcccatcacccccgcttcattggcaccgacatcgtttcgctagcctgctgctgccggctgcttgatgtttcgtgttccaaaacgaagtgtttcaatccatgattcaacagtgtttcatcattttaatagtttgaaacatgtgttaagctagtggtgaaacattcttctataaatactgaaacatcgtctgatttttaggatgaaaatcatgtgcccgacttgtagttgcctgcgcataacaatagcaaactacttagcgattgtttggtttgcaatgccaaatcataggcaagtttttgtaacatttgtatagtattggcaagtattagtagcaaacaagacattgccaaaattactatttaaaatgctaatattttggtatggcatgttttggcttcaaaccaaatcagcccttaatgtgttctctccttagcgttagcaaaataagtgaagcaccatctaaacatgggatggtcggaatttaataagaaagagagtcaatgtaaaaattaaattactatagtggacttagggaaggactaaatctcagcatgcagtatgatcaaatatcaccagtgtcagaattagggtatcaaccatgcatgtagatattacgcaaattcaaaactcgtgctttttgtattgctatagcctaaatgttttgtgcgcccatttaagatgtcctcaatttgcaccaagtaaataatacgacggaccaagtcatcactgacgggcttaaactgtcctcgtcagagatgttaagtggtttgtgatgacaaaatctcatctgtgatggatgaacacctgtcgatgagtcatttgtgacgggtgtataagtcatctcttataagtcgtaacttatcacccgttaaaaataagggcgtgttaagattgatgtcatttcaaaccataccatttcttggtagagttgccaaatatatgcatccatttagtttcttatcaaactttagttttttcttacttattttctttgcttttcatgtgaagacatcactacgttggtgtgtcaggcataacacatagacacatcacaccactgtaagaaaagaatagaatgagtagatggcatggggaccaatctatcccatacccaaactattaactccgtacagtgatagatgtatcatgacctaacactcacactaggacaacctcacttggcattgggaaaaaaaataaagagtaaaagtcccctcctctaaccactttgcattgcctatatggaatcaaagttaccaattcttataggatacaacattaattacttatataaaagagattaacacaagttagacaagttagagccatgatcaaactagtttaactaaggtctagggcaactaaaactttatcatgtacactcacataccactcattattgcaactccatgttgttctccataatagctttccgaatatagttatgcgcaaacgttaatatccacactatacactgcaccaacgaatcaaaactaaataaatttttttataccacctagctttacttaatatacaatcagatcttattcgtagaagagcatatatatctagtaacaacaaaactctagaaatcacaaatacaatgacttagagatcagtaatcaataaaataaatcagaagtgtgatgcaatgaatgacccaatcccattctactgtgcaccggtgtgtcaaaattttaaattgttaaggcccatctcatgttttgtgttaatccattaagcaacttaaagctctttttttttccaaaaattcactaagcagatttggtcaaagttttttttagtcaaaattatttattctctcccatggacctaccgcccgctctgataccaactgtaacaccccaggtattcttttacctagaatactacacactacggtacagaaaccactaagtcctaaattcaataaaaatttcgatagagtctcccctgtaaatacggacattcacgataggcaattataaattaaattaataataacatcattcccgtaacgctatccatccatataatccatagaaagaaactaaaagatatctaaagtattattaccaaaccggacctaagcaatatagtttgatagtgtgtagataaatgtgtatataagggagctacttcccgcccatgcgtgtccatctcaatgcatacctaaaaccaaataaaacacaagaatgactataaaaatactcagtaagtataatatggaattagaaaacacatatacacatcattggcaataaagcatgaacagaaggctttctttctttgataagaaacacattttcaaacaccaagtcaaagaagatagtagttcccatcccaggcaggcatgaattgaaatagtagtttccatcccggataatagtgattacatcctagcatttgccggcaaagtcgagtaagcgtgatcagcgcatacccataggaacatgaataaaaaccagatagcacatccatgactcgcatggaacatgagtaattaaaaccggaatcaaagaaccaaattgaaaccatattggacatccaagacaagcagggaacttgaattatttaaccagaaccagaatctggaatactgaaacaagaataacatcgtaatcatcagacaaagttgaaatctaaatggcgtgaataacaatctgaacataagcagtagcatatcacatataaatataccggaaataaataggtggagcagacaatccatgaatcacacaattagttcgtcatgcacttgcctccaataaaaggttggtatcatacacgatcttaaggtccaccacctaatcacgaaaaaaaccttagcaaacacattcaaacatgctataaaacaatgaaaaaggtgaacctactgccccatcccgtcaaaatggaataacaaggaacgccgcttggactatacacaagactgctgcttcaaacctttatatcttgaaatatgaaaaggctatgactaaaaatatatacattttgtaaatctacagaatagtacctacaacttttatgtagaaagcatatttttattctgccatttaaatggtctaacttgcgcttgaaagcaggcttcagaatctgtccaaaatttcagaggatacatacaaaaacaactataactggagttctactcatccgatcgaagtgtactttaccaatatggaaagattggagaaaaatctacaactttttctataggcagccagactgattccgctgtttaaccccctccaaaaatagttcaatctactactatccaaattatgacataaaaacaaaagttatactaaaaaaattatatctccgataccacttgagataaaatcacgccctttggtcagaagatagatccaaacattatcgacaacttcctggtaatacacttttgtagaaaataacatttagaaccccgaaacatcgaaaaactgaagcactgcaaatctgcccacatgcagaactacaacaaaccgaaccgcaacaacccaaactccttctctaaccttccctaaccacgaattaaagcactaaagccacgctaaaacaactaatacaacaaggggaaaaagcctcacctagggtttctttagagaacttatgaggagacactaggggagactccgatcaaacccctcctacccctctccttctccttgttctgtttgtccacttcgcttcttgatccaagttcttggggtggagatctatgagggcaatttgctgcagaggggagagatgcggacacaggaggaggggaggaaggaggcgtcgttggaggctggccacggagatgggtggcggcaccaagaggggaagtgggattcggttcccctctctctaggttttaggggagaaccagtgggctgggtttatggaacttatcatgttagcccacttctaaaggtatttttcctttatttatttctgttaacatctttattttaacaagtcaacccaaactaaaaaaacctaaatatcttttaatataaggggtattacaattattttaggatggaggtagaacccataaatccacgactttcctagcaatgtagacatgcgtgcatttatattgagtctcaaacatgagaccttgctctctatacagagcacacattacttattctttcaataatattgtttttactattcctatccaaagcacatgtaacatatatttaacactcaaaacgacttcaaatgaaaacatcgtcaactaaaaccttttttttatcttaacgtgttctacaacttttctatagggaatatctccatccaagatcgtttgaagaattcaaaatttttgtttttccaaatatatattaccatataatgcatatttgggcatgtaaactgtctcggatgaaaatattatctaatataatatcatagatctggttgagctctgttacattgatatagagcttgtttccatccgagatcatttgaaaatttcgaaatttcagtttttaaaatgtagacctcatcacttgtagtatgtgaacggtctgtaatgaaaatattgttagttataaaattattgatatcgtcgagatctacaacttttatatagagcatatctctatcccatatcgtttcaaaattcaaaaatttgaattttcacaaccctacctaatccttatatatttttaggccaaacatatatagaaattgaactcaccccactttaaacctcgccctcaaattttgtaggctaaaaagttagagcgtagccagtgctgccctcccaagaattaaggactctccagcagacggcacaccggattgaacggattgaactgatcttgcagccctccacactcgatggaaatgtactttacaatcatgatttaattacagaaaatctatcgtatggtgtcccatggctgtgcggatagtcacggaataaattaaacgactggataacgttttagttcttatccattccttttctcttctctatccaaagctttggtcaacaccttcgcgtttgggcaagccaacacccgccattccagccgtgcatcgttgcaagagaagctcaagagagaagttcccggcggcaagatggccggctgctgcgtgttcctccgatggccgtcgaccctgccctcagtcctcggctaccgcttcctcgacgacagcaaggtggccggcttgtcgtctccagtagtgacagtcgtcgtcgagaaggagtggtaggtgttctccgtcgactacctcatgctcgacagctacccatcccggttgctcctcgagacagcggtgaggaaggatgagagcaaggcgacgctcttcgtcaacgtcaccatccttttcttgtcagtgttatgtgcaaagtaaatcacgacttgatacctaggtatcaagtttggtaccaagtacaaggggtcttggggtctgtacggcgtacgccatcacgcgcatgtacaacgtcttggggtggatgaggcctagccacgatggcaagaagaggtggtcgcacgggcggaatgtggagcgccatgctgtgggcggcgctggtgttcgtgttctccgccgccatgctgatacagctggtaccatacctagtacctgtgacacctagtacccaatacttgtgatacctagtacctaatacctgatacctatgatacctggtacccgatacttgtgatacctggcacctggtacttgtgatacctagtacctgatacctgatacctatgacacctggtacccgatacctgtgatacttggcacctagtacctcgtacctgatacctgtgacacttggtacccgatacctgtgatacctagtaccctatgatacctgacacctagtacctgtgatacctaatacccgatacctgatacctgatacctacagcatggtgtacgctaattaatcacacattaaaattgtcccgtgacttcagtttttcacggtatcccgtgggctagcagccctctttaattaagtgcaagaaagaacagaaagaggaaacgtagacgacaccgaataatgacgagaaggaaaacgttgtaatataccaaaaggagaacttgacaattagttgcatggagatagacattaacattgatctagaggcatgccgccaatattatctagtgggacatgaccaatgtgtaccacaacaacattactgtggtaatgctagatcggctggtcaaacagtgtgcaggtgacaagactgtgctacgactgaggaccatgcggcagtgtggggaatatcaattgggacagaagatacaatgaagatgagtaaaattgacgttttgaaattcttctccttccagaggactgatggctggattggattggaaactaaatactgaactcaatgtctagagctcccgatggctcctatgcctatctttatgtttgaaaggagaacatgttcgtatgggattatcctgcggcaaagccaaaatatttcattctcagtggaatgcccagaaataatagtagttgtgtggtgaggtactcggggtatcaaatgttgacagtacgccctatgtggctttgccccagtgctgctcttataagaagttagttctgtagaataattgacataattatctgtaccaaagaccgtaaatcttgattcttcgcaatcattagaaagaacttctcttatatggtgacactagcaatttccttgatcacaaatatgcattaaaaataaatttgactaaaatatgcatctcctataccaatctaattttttttattaatggaaatggtttacaactctggtttttgccgatagtttacacagacaaattcaaaactcttggcctaatatgctcatttcgtcaatgtactattcacctttccacaatttccttgttcttctcccctttcatttagacagactgctcaattcagacaggcatttagttcagatgccatggccactaaagagcactctacaaaaattttgtgctaacagtacattccgatatatgtcaatccaaatattgcaactttccaggtattttccgctacactgcttcctcctgatccctcccgagccaaagagtctgttcaaatcattgaggttgaaattaccccaaggccagggcaatttcgtgttggttcaccataataagcagcactacaggccagtcttgtgtactgcctaacatctgaaattctcaagtttcaacaatgtttccttcctactgaatactgtcaaatgtatcacactcatgtatatttatgctggttcgagactagctagcattggaattttggaagaacttgtgtaaattggtctcatgctgggttcattgcaagcacccatgtgcaaatggcagtgtgggcacctttgccattatggaataccttatcaacacagttaatttccgaacggttgattttgatcgccatcctgtttccattgagttaagaatcttcttttttcattcgttggccggacagcttcaggctaaacttgaagtcatctctagttagcctttgctcttgtttttgtgaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtcca

SEQ ID NO: 71826 - DNA, 2156 bp, Oryza sativa
tatagctatttacgatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacggccatggcgcccatggcgcaagatgtcgccgagtacctgagcatcttcttggctctcgtcgtggcccctctcctgctgctcagggtggcgaggcgggcgcgcggcaatggcgccggccggccgaggcttccgccggggccgtggcggctgccggtcatcgggagcctgcaccacctgatgggcaagccccacgtgcaccgcgccatggccgacctcgcgcgccggcacggcgcgccgctcatgtacctcaggctcggcgaggtccctttcgtggtggcctcgtcgcccgacgccgcgcgcgaggtcctcagggcgcaggacgccaacttcgcgtcgcggccgtggagccccaccctgcgcgtcatgatggccgacggcgagggcctcgcgttcgcgcgccacggcgcgcactggcgcctgcgcaagatctgcgtcctcgagctgctcggcccgcggcgcgtgcggtcgttccgccgcgtcagggaggaggaggtggcgcgcctcctcgccgccgtcgccgccgcggccgcggccggggccgacgccgtcgtgaacgtgagcgagcgcgccgccgtgctggtcacggacacgacgtgcgcgccatgatcggcgacaggttcgagatgcgggacgagtacctggagggcgtggccgaggtggggaagctcctgctcgggctcagcctcggcgacctgttcccgtcgtcgaggctggccagcctcgtcagcggcacggcgcgccgcgccgcagcgagccaccggaagatgttcgagctcatggactgcgccatcaggcatcaccaggagaggaaggccgccatggacgccgacgaggacatcttggacgtgctgcttcggatacagaaggaaggaggtcacgatgccccgctcaccatgggagatgtcaaggacaccatacttgtaagcaccatggtttctctcttcactctacttattaattaattgtctttcatttcatcattgtgatacttcattgttactgctacatatatgta

SEQ ID NO: 71827 - DNA, 25826 bp, Oryza sativa
cttcgtaagtcaagatacctcgtcgctttcggtcgtatgaacatttatgtctcttgacaaaagactgactctcaacaaaatatatggactacttcccgttttttaaatgtacgacgccgttgatttttcaaaatacatttgaccattcgtcttattaaaaaaaattatgtaattattaattattttattgtgacttgatttatcattaaatgttctttaagcatgctttaagtatttttatatttgcacaaaaattctaaataatataaatgtttaaacgttaataaaaaaaagtcaacggtgttatacaattaaaaaaaggaccccgcaaaaaaatacattaaaaaaaggaggttgtacatatgttatctactccctccatttcaggttatcagacattttgactttgatcaaagtcaaactactttaagtttgattaagtttataggcaagcataagaatatttataataccaaattagtttcattaaatcaataattgaatatattttcataataaatttgtcttcggttgaaaatgttattatttttttctacaaacttagttaaacttaaagcagtttgactttgatcaaagtcaaaacgtcttataacctgaaacggagatagtattaagtatagagaatcatgtcggtgaaatccaacacgataaaaatctgaactaaaagtctctttcaaatggtcatcaaattcccgttcgaacggggcatttcactggccggttattacattctgtccacaagcacaaagccagttagctgccgaaactgaaactgaaaaatagctgccgatcgatatttttcacacatgcacggagctaggttaggccccacacccacaggccggtgggccaccacaagatttgtgccctgcaccacacgctgatcactaatcatcactaatacagtaacataccatctaacagtcgaaagaaattaagacattggcttaattaaatgtttctggtgctgctgcaatgtcatcagtacatcctaatctgtctttctgtccgtgtctatatatcgctcactcttaaggattactcagtattctcaccatgaaaagatgtctttttgatatctcaaataagtactttaaacattaattactatctgtttaaatattaaatatgtatatagatatatgatatccatacatgcatatttaccttgaaagatattatacaatattacagttttcaaatgttttataacaaaattagcgatcaaagttctatttcaaagattatataagacaatactccctttacttttaaatacgaatgttgttcacttttagatatgatgtttaacgatttgttttcattcaaagaatatagtgtacataagaaaaatacaagttatgctatctttgataacaaaacaagtgacaacgtaacaaatagtattcgcatactacatctatcctacaatataaggggttctgaaaatatcggtgcattaccataactcccttttaagacggagatagtaattctttgtaaacaacacaattggtcaaaagtcatataaaaaatcaacaatgtcatataggagtatttgaaaacagtggtaggagcaaaccatcgtcagatggaggggcatcatcatcagcaatgcagcatggtgatcttctcctcaattaagctccatcgcatgctttcaatttggggcagctgggaggggggggggggattgaatgcacaaagcgacccatcaaaaaggtcccagagagaggcatccccacaataataattagtaatcccagtctcacatatatgacaagggcccctgattaattgttcagttaatgactgggaaatggtccatgacctgacctgactccatcctctctctatctctttctgtgtgtgtacaacgctgaaaaagattttgtctgcttgtaaactggacaagaatctcttgttgtgttgcaggaggagtatgaaactatgaactgtttggctgctgcccctgcttctggttagaaagagaaacagaagaaaggacttggttatgctaatcattgctggttttgactgacaggtttgcttcctggatttttgtcaatgttggaaccccgacaagtgcccaggattaatttgatctgaaaggtcgtcaaattttaccaaattaaccccttttacaatgccgcagtaattcctttacggacttacaatggcatgaccaaaatggttgccccaaaatataagttggagattaatcattttaaaaatagaataatagtatcaaatgataaacatgttgctcgaacatattaggcaggcacaactgttgtaattgcctctgtatgaaaatatattcgactcccagcaaaaaagaacagagaagaacggagattcatcccatctcagttaatttaaaacaagacgatatcctgccattaggaaatacaaaggaatgacttaactgcatcaaagagaaactatttacacttttcagagctcagcccatccaaacaaactgtcttgttatcatgggcctaatggaccattattaattcttaaacaatgctacgtatgatatatcaattgggccgcataatttttacttactgggccgtacgttcacttggatttcttagaaacaagtctattttgcctccctcatgttcttgcccttggtcgaatcacatccctcaaccgcaaaaccgggtataacgcctcacccatctccgaaacccggtgcaaatcgactcctcaggtagttttgtaagcggttttgtcctatgtggtgcttaggtggcattctacatagaaaaaaaatataaaaacatgatagtggccccacatgtcagtctcactttctccacctctaccctctctctagtctccctttcttctccggggtccaggactgacggctggcgaagaggagaggaagaggtcaggggcggtggatccgccttcttacactcccacaccttggcctctgcctcttatccatggtggtggagctctacctccgcctcctatctggttttgctatggattaggctctagcatgcttctcctcgaggcagtcctgcgccagccatgtctcctctgtgagttagcaaaatatcacaaaatatcaattgactaatgtgtgaagggaatacgtctccacgagctgtgcgagctagccacggggctcgaggccagcgccgcgccgttcctctggtcctgagggaggaccaagcagcacgccgtggggctcgttgtcccgtgggcactgtaggtaggtgttttgtgccacgcatcggtgggcgcgctcatgacgcacatctggtgggcgtcggtgatggagggcgtgtcaagcggcgtacccatggtgtgccgcccattcttcggcaaccagaagatgaacgcgctattggtgtcccacgtttgggggttcgggatggcgttcgacagggtgatgacgtgcgacggcgtggctacagtagtggtgtcgcttgttggcgggaaggatgggtgccggatgagggcgcgggcgcaggagttgcaggcgaaggtggcaacgatgtttatcgagccaaatggaaactgcaggaagaacttcgccaggcttgtcgagataatctgtgcatcgtgaatcaatcatgttggccttcaaactgttttgttgactgtttgcttttaaattttggatatttttggtgagataggaggcggaggccaagctccactgtcacggataggaggcggagaccgaggtgtgggggcatgggaaggcagatccgccgcccccgacctctccctctcctccttttcgcgggcttcgtcggccgtcagtcctagcccccggagaagaaagggagaccaaagagaggggtagagagagagaaaagggtagaggtggagaaattgagactgacatgtgcggcccactgttatttttttttctatctaaaatgccacctaaacaccatgtaggacaaaaccacttacaaaagcacctgaggagttgatttgcgcctattttcggtgatggaggatgtgttatacccggttttgtggttgagggatgtgatttgaccaagggcaagacatgagggatgcaaaatagactccatggaattattggtgtagaaactgaaagcccataattggagtattttcatgggctttttatctgcctctgtttagtggatctgctcctctagcgaattcggcccattttgcgtctctgtcaattccaacaattctctgggctggttgaacttatatatacagctattatgtgcttctgctaagcatttgaaacaagtcctctatcagaaaaaaaacgaaagtttgaaacagattaatttgaaaattttggctttgaggtgaatcctgataaattcgggggagaataagttgcccacggattggataggaatcggcgatagcggggtccacgtgcatgtttccagttttttctcccacgcgcgcacgtttcgtttttttttctgttttcctttctttttttttttggaaaaaacacgtttttttcctttattttaggatgcggtaaattatgatagcaacggagagttgactgtaacaaacttttaaagcgaagatttaaaatttttaacttagacttgaaaacttttaagtcaagatttggattttttgaaactttcaacttagatttgaaaattttcaaatcaaaatttaaaaattttcaactcgtatttaaaagcttttaattcagatttgaaaacttttaactaaagattggaatcttttaactcaaatttaaaaactctcatctcaaaattaaaatcattcaacttaaattataaaaactttcaaacttggacttcaaagattttaattaaaattctaaaaacttttgactcaaaaattgagtcgaaagttttcaaatttgagttgaaagttttataattttgacttgaaagtttccaaagtttgggttgaaagttttcaaaattcgagttgaaagttccaaatttcacgtagattttaaacttgtagtgaaaatgggaaaaaaatctgaaaaagagaatgttaattaataccgtgattatcggaagttaaaaaaaaacttatcacgatttttcctccgaatccgcgtgcgcgtgtacctcccatcgttttgttgcgcgaaaaaaaaattggactcgcttcctcgctggtgggccggaatagaacgcagcgaagtgggctagaaatgcgcgctagatcgataagtagagcgtttgcgctaattagcatttccggacaaattcttagggaaaacttgctctttcaaataccaggggtgaaacaaactggatcgattagccactaacagcctgaggctcctttttcttcaaaatggacaccacagcctaacgtttaggttcctttttgttcaaattttgcatttgggcattgtccttgagactactgtagattttggactttggacgaggaaaatctgacccaaggagctcagcacacttgatgtactgtcaattgacctaattattgtctctctcaaactaagaaattaatcactttgtacttttctcacaaaataaagaacatggctgaataccttgaaagaactgtatattatattgcttttatatagagtatgacgatgactcatgacttcatttgggtaatgaaaattaaagaaattacactctgctatttcccctcaaaacaatcagcaaagcatgcaccattgtaccaaagtcagaccaaagcatccaaaccactggggatagaatatcctgctcacatactagctggagttgtactttccattgacctacatcttggtaatcagcaattagtaatctctcctagaaaggtgcaaagatcccccacctgtatatagatataaattcttggaagtcacattttagaaaaacaaagacaaaaccccagtccttggtagccattgacaggccccatacctagatgttcatatcagccaaggtctacatgccagtacggtttcatagaagcgatttatcatgcaataattctgtgacacaacttaatttgataacaaggatgcatatattgttttttgttaacaaatatacctatactttgataccagccaaatgtaactcaaaatatccgtcctttctttgaattgtggcaacttatgatggtgataaaagatatcaaactcggtgcaagcttgtcgccagtggacaccttcaaaattaagagtatatatttctacttaatttgtaagttggtccaaaattttaatttcttaaccaagtcactgatcaaactaacccatcataggtgattccacatgccaccacattgcatctagatccattgctaacgctcatacttgaccttacagcatgcctaatataaacattgaggttcaatttacaatggtggctagttagacttgacactgaagaagagctgtcaaaccaagtgcatgaatcctagctcgctatcaatggacaccgaaaataatagggtatttctacttaatttataagcaactcgatccaaaatctttatttcttgtagtgactcgcgccatcgaacggacttactagcgaagagctataaaatatattttaaaacatgtttctagatctgctgttttttgacgaaaaccaacaggagagactcctactgaaatgaattgccaaacaaatattgacaaacaaactgtacaaagaagagggaggagggcggggggggggggagattacatatcacaaattataagctgtctagccatgatttccaaaaaggtttatcctgagctttaaccctatgcaaaagtagggtaaaatcatctctaaaaagagatttccaagagttgaaggaaggctggacgttattaaagatgaagtcatttcttcttcgccagatgttccaaagagctacggcaatgacctcaatgaaaaagacatgggggaaattcctttttgcttcaataaccataggcatgaatcccaagtttgattgccattgtattcccacaaaattccagcatctagtggcaaaaggacaacagaagaaaaggtgcatgaagtcctccaaaactgagagaccacacaggatgcagtttggtccggaagggatactttgattattttttttctttgcagcaaatcttttgtgttcagcctgtctaccatcaaaagcaaaaggaaaaactttaattttaaagtgcatttgctcttccaaatgagggtgaggggtaactccactgtaagatgatcaaagaaaagcgagtagaccaatcttgattgaaagccaggatgtgaccatttgtaaccctagtgatcagcattatttagagatacatgagtaaggagatcattcagagcatgccatacatgagccaacatgctctagatctgctgttgatgctcatacgagctttattaccacctaatattaaaacattacagttccttatactgatagctaccgagacaatctttttttaagtaacggattaaaaccgacctccacatccacagagcgaatgtacgcaaccaaaactatcgagacttactagtactgatcagagctatgaaatctatttttatgcatgctcttgcaaattgatgccttgaaaattaccactgcttctacttaaattataggtataataatcaatttacgcgtcgcacccctgcctctagatccgttgctgatgctcatgcatgtacacatgcatgagccgaacgttagggttaattagggttcgtttaatttgcagtgccattttctgatcgatcagctcgtgcgtgtcctcaagaatcaagatccgtcacatgagcctcacgctctccctgatcgatcagcagaaaaactaatcaggcaagcattagtagcttcgtttagaatccagtggcggtcaaaagctgcattaataattaactaatctcgtttgcaatgcctataatttgttcagatatatgcgtctctcctgtgtctctgctagagctaagggttgacttgcattgcatgcaatgctggcatgcaggcaggatctgggtctgggacggtggtgattattaaatttgataatatagggcgagtgttcatgtgatgatgatgaccgcctaatattatgtgtaagtatggaatggcagtgacgacatgaaaattccaaattagttttcataaatcgttctgctgcatgcatgtctagatgctgtaggcgtcggtggatggcaaaagtctaactacaaaatgatctgtattccgtcagaagattatcacagtgttgtactataaagacttaattaaaatgtaaacgtcgcgattttgttccatttattagtgcatgtgtatacgaccacttcaaaagaaggatatatatgataaattccactaaataatgtcgtgtgtgggtgtatgaaaagaggcggaatttaagtggaaaaatggtttaaacagaaaaaaaaagggacgagaaagtagtgcatgcatgtttggttctttaccatttacaacattactaattttgtttttgacaatgacaagaattggccattacccaaaattctggaaaaggttggctaccaaagttgtgggttcaattcaactaggccagataatttggtgatgctaacttttttctttcccaaactaaatggatgactagtttttcggcattgcgcaattatatatatatatttcgcattagactacaaaccaaacaaggccctaatattttgcaggggaaaatttaagaatataatttgacgagaaatattaaccgtcctggtaaaaatcaaagaatcaaactgtgacagaaatattcaattatttgcattgcgcgtgagcagggcggtgcacatagcggaggcaacgtttgacctacacagattaacaaatgctatagcatgaaaacagtgtcaggggaaaagcataagtaacatggttaattgagatcacctaggacacaacaccgacataacttaattattaattaatttatataaacccagatacattatgcacagttatgtttgattagacacttggggttggtgtttgtcttgatgagtgattcttgctgctcctgcttgatggcaggatttggttattctacttttagggttttggggttcaggctacgaatatgataacatttgtgtacaaggacacttgctcgatcaggctgcagtagtggtgtcttgtgctcactataaaagcatccagcaagttcacctagatggtgatcagtttagtagatggcagtcaatagtgatcagtttcattagtgatgtgtcgagcaaattactcatcagttagctggaccaattctgtaccacattagaggaagcttatgcttgctcagtagcaaagaaactacaaagcaacctagctcattaactcacaattctgtccagctcttgattttgcagtattgggcatgagctgaactgattattttggaaattccttttgtgaagctgaacttagtgttttcaggccagatcgatgcatggtaaactgtttttagtacagtaggtcgtaatatttttttgtaataactcataaatgtattaattaatcaggtttgcttttacggttttgtaacaaattaaagattgtgaacggtgctccaggtttctttagaacaacacacttccaatagtattatccaaaaacaacttcttgacacggtgaacactactccaggcctctgcacatattgagaatgtgatatcaccatgatgttcaccttgccactaattcatactcatgaacaagcccatctactcggatcgatgttggactaccttcaattagcctcatgtctccagaatatgaagaaccagggaagggatcaacaagatactaagttccttacatacatatatataaggttcaatagaaacacaaaaggagaggtgcaagtcgatctattatgaccagaagaaagagtacagttgtttgtatttcattttcttcttccaagccgatgtgctctgcatggagcttacagttgggaagagaactcaactagctcattgcattcttcttcatcaaggataaaattaattggattggatgcacaaaagtagtttgcagctagcttcctctaccaatggaaggtcatccatgcatgtcctcttggatcaacaggaacagggatcaaggatgaactcgtggttcacaaacatattgaagcagagatacctttgcataccttcgtatatagtaatactaattactatctccatttcatattataagtcattttgatttttttctaagaaaaatatagcaatatttttaacataaaacaaaggaactatcaaaaatatattcaatattagatttaataaaactaagttagtgctataattattactatatttttctataatattggtcaaattttcaagaagtttgaccttacaaaagtgaaagagaattataacatgaaacggaggaagtactaataaaatatccgttagaaaaagagtttaggggtacaaatgaatgtatcatgctcaccagatcttgtgaacgtgagggtaggtgctaacatcaaaatttggtaagccccgaagtcatcatcggtctagagtcagtatcggctttagagtcctggaatcggccgatgggaattatcaagtcttcaatagttggattctaagtagaatcgattaaagaaattaatatattaaatgaagtttatccaaaagtgaccgagtttaaaggaggatgcggcatggcagtttatctattaattaggaagagtctattagtttccttttatctttaggaaaatgtgtttagtgtctgataaagactttatgttttccttttatctttaggaaagtttctttcttgtccaagaaggactaatatctacctatgggtataaatatgtacaccaagggtcattgtaaactatctcacgatcaatacaatttcggcgcatcgccaccttttacctttctactttttcgatgagttcttacttcgaattagggtatcgatttcgatcttctgacaagaggtatgaattgtctcagcggtttgcgctggcggattagggcatcgctttaaatgttctaatctatcttctacagccgctggttatcatatatcctagttaatctagcttagcatcttaatttgatcagatcacctgagattcgttttagggtttatgtcggtatcggctaaattatcttgctagattagattaactaagatatccaccactcttaaaatttgtcaaaggcatgattgtttaggctttatgtttctttgcatactttgagttgcatcgaccttagtcgtgcttagaaccataaaaactaacctgcctttgattgccaataagggttccatcggggtttcagctgatgagttttctggacattgcatcggcttacaagaattgtatattaggtggttttagccgatcacaacaaaggtttcattgtttatctaatcttgtggattttatgacatcggacctccagccgatgtatgctttgatcttcatatcagtgtttattctatcatatcattgttagccgattggtttctacgagattatattattgctttattatattaccattagccgattgtctttatatcatcatctacattggacatatagctgattgctcaaaaccctatcggcatcggctcactggtgatcttcaatttatatatcttgtcagttgcaagatcaaacagactggcacgtccacatctcatcaatttttggacctacattagagctaagcagatctcccaggccgttgtgttcatcgacttagttcgcgccaacacagacccgacaccatcggccgagcgcggattttccgtcagcagtaggttatgggggtgaaaattttctacattgtccgtacattgtaacgggtcagacctatataattagagataggataggagggtaattgagtattgcacacggtggtaggagcagatggaagggatgttgaacagtccatgaggacctaagctccagagtgggatgggcagcagctgtgccctaaccgcagaggcggaaggcaactgtgccccaagctcggaagtatatgcgccccaagcccggaagtaggcagcggtattgccatgagctcgggttctagcccgctgccatatgaagtggcccaggctcaccttcgttgcatactgatcgatcagatgacgagttggtaggcccccgagcatctgatagaggggctctggttaccactttaccaacataatatatttggatggtttatagtaagtttagagcagataacgtgaaagagagagaaaaagagctgagccagaaagagagagtgtgcattggaaattagcaaacgaaatggaaaaatcactactacaaaatgggtttttgctgacagtcagaataagttttttacaagcagttaggctagccgtcagcgaccataggccagaaaaaatacacaatcttcataggcgggcatacaaccgctagcgaaaatttattttcattgacggctaggttaagccgaccaccagtgaaaatgattttccccgacagagctaggttaagtcaaccgcctgcgaaaatcatttttgcctttaaaaaaagaaaaaaaaaacccttgcatgcaactcgcttctgactgccaacaaagattattttaggcaaacgaaaaataaaaaacccacatgcaattgcattcacaatttccacatcaaaccacaaatcaagcaaatatgggaagaacaattcatcacaatttcatcccaggtgtacaagaaatccattcacaatttcatagctactctaagatttagcaatcagtctgttctcatcgctgtttcttacaaaaattgtgaacagagaagtacaagcaaatatgcagcgattatttgtaagaaaacattcacaatttcatccaagatttagcaatacacaagaaagatgagagagaagaggtcactggtgcattcaccgatccacggttgttgccatcaccgagacacgtgcgaacatcggcaccaaagtcggcgagctccgtggatttgagagaggagggttggcaccgctggagcttgaggcctcaccatccccctccaccaccgttgggggcggagtgcactcattggagctctgacccggcgggaggttgggctcgtcggctagcgacacctccacaatgagccctttattcaacgccatggccgcaagagcaccgtcgaccctccccttcacagcggctggaccaggcggcgaatctgccgctcctgagatcgccggtattggatccgccgttgtcaagctcgatggcgacggatccgccactcctaagaccgccagtggcggatccgcccttttcgagcctgccggtggtggatccgctcctcctgatctcattgcagccgtagccgtcgccgtcgcccccacaatcgttttggccatcgccgccgccatgtacgccgtcgtcgccaaggacgagggagagggggggggggagggagggaggaatatggcagggagaggagggagggaggacttatcggtggggaaggagagttagatgcggtggagatcgagcttttcttttaatatgatggtcctctttagcaaccagcagcgaaaatcgatttttgctggtggtcgtttaggtgagccaccagtgaaaagggatacattttcattggcggcgctcttaaccacgttgttagcagagatccattttcgctggcggcccataacccctcatccctcgttacattgttgccgatggttttgatgtatggccgtcagagaaaatgatagggtgacgccatgaaaaatcgatttggtagtagtgaattagacaaagttataagctcatgttaattataaactaggactggtgcataggaaaataatccataataatttttttaatccaattccttttcttcaaattatatatgtgtgtgaaattttttcaaggattcaatactccaaagatcctatgaatttccttcaatccaaagatatgaattgagtttctaaataggataataaaggttggtataggtattctttcggaacagagatatatacaactagtaactcccatatgtgcaatacgatatcaaccatgattgattcgtctgatcaatttacagttagacttgaaattttcatctgaaattggagagagaaaatgtagatgtgatttacagatcaaataaattttggcaaccaatcaagctttagtttatcttttgaacatttcaatcattgcacagtctcctaagtcctaccagaattcatataagaaaaggctggattaccaaataagagctgcttcaatagagatttctttagacattagctagttactagctagttagcgtagtagaatcaaaattatatacttatccggacataagagaatgtcattttagaatatgcatacgctctaagcgcaagttattttttattatattattgtttaggctatatgttttggacctctatagccaagtatattataactagtgcttaatttaatgatgttactgttgtgtaattgtttttgcatttacggggaagacttaaattgtcaaaatcatgtgtctgtttgactataacatgcctaaatcgacattcttttgggtgacggaaaaggaccactagtgaagaaattgccggtttcaaaccactcatcaataccggttttagaggcagcaccattatagcggaactaattatgagggtagtcactaacgttggttctaaaaccgatactgatgacacccttattgatgctaattctgattaaaacgaacacctctaatgggtgctcccggtttttatttctacaaatgcggaaaaaattataaaaaatattttgcatttaactaggtttctatctacgcacggtcgcaaattgattctcacaattcacaagattttttcacgcaatattcacacacaagagattcacaaaatctaaacccaggacatctctcaatttccaaagccttcttaccatctcacctatcaaacacacacgtcgtcttgtaagcaaatcgacactactactaaatgaaagttatagtacatatttatcaccatagataagctcaaatgaaaatatttttcaaccaaactcgtatagattttatctctgtccgagattgcttagaaatttccaaaatccgcttgttcaaatagaactgagaagtgagaacttaacacattttgtgatatctaaacgatcttaaatgaaaaagtcaactacaaagtttagatcttgtagaaggacctgtttgtgcggaaaaacctcttataggtgttaattttaagtgaactgcaacctataaagacattacggacgtggtgttctgtactaatgtaccattctgatgtgatataagaacacccaaattcttcaatcaagtgatctatggttcttcaggttcttgtgtagctggtttcctagcattagaaattcttcgagttagagctactggtcaattaaggttatcaaggtaggacgatttatacatttgtagtccaaaataagacaatagttaatagatttaaatatatacaaactatatttcatattttccataagacttatggaaatggagctatatatgccaaaccatcctaaatatagctagcttgcaaattaatttcaccatggactctataaatgcctgcaactacaaataatttactccctctgtttcagattatataaaaaaactgtgtagtaacatttttaacccaggacaaatatattatgaaaatatatttaatgatagatttaatgcaactaatttggtgttataaatattaactatctttgtcaacaaatttaggcccagtttagatcccacctcaaaattttttaccttgtcacatcgaacatttaaacacctgcatgaagtattaaatataggctaacaaaataactaattgtacagattgcgactaatttccgagatgaatcttttaagcctaattactccatgatttgataatgtggtgctacagtaaacatttgctaatgacggattaattaggcttaataaattcgtctcgcagtttacaggcggattttgtaatttgttttgttattagactatgtttaatatttcaaatgtgtgtccgtatatctgatgtgacacggcaaaaattttcacccttggatctaaacacacttagttaaacttgaagtagtttgactttgaccaaaatcaaaatgacttataatctgaaatagagggagtaattaccgcagcatcttcacttctctaacaagttctacctcttttaataaaagaccttattttcagactaaagcaattgttaaaaaaaacagtgtaattatctttagacgtgtggttcattgatactcatgcttgttttctctcttgtggttagagaccatccccgccttcaatcgttatgtgcaaatgccattaattttagtttaggcatgtcaaaagtctaatcaagtatacaagcctagaaaaaacttagtactctctccattccaaaatacttatcaatcattctaaatgtttagcataaattaagattcaagaaagaaaaactagtatccttcattaaatgatgtacggtgtgatagttggagggtattatagggaaaaaaattgaatgaacgatgatgaattgggcaagtagaacttaagagtgataaatactttaggataaattttaaattataaaaagataactattttgaaatggaggttatagtcattatgagagacatacatcttcattctcatccatactaagattgtgttcttttcctaacttttcctacatttgcttaatggtttttgcacacacgcttcctaaactgctgaacggtgtgtttttactaaagttttatatagaaaaattagaaaaattactttaaggaatcatattaaccattttctaaattttttatgctaatacttaattaattacacctaattgataacaccgtttttcgtgcgtggacttggaacgcaggctgatatgtgtcaatgacaggttaaaaataagatctctttacgacagaggcgttagataattctgtagctctgttgtcttgaagtatattcttgagacttgagagagagagagcatgcacgtacgtacaatataagtatacatacacatggataaacgagcaacatatacgtacgtgtgtcgaacttaatatatatatacccctatttactagctagatgtgcattattgatggctctaggtctcgctagctccaacaacacgatcggaccccaggtaagtgcttgcctcgagatctgcgctaatgaatgtgcctacaacggaattagggcctgatcaaccaataattaagagcttaataatataattatgtggatgaatataccaagaccgcaggttagcatggacttgctccgtttctcaaatgattgttgtcgttgatcgattttttacgtcagttcaaactcggtaagcttaattttactaaataactgaagtgactgtttatagcaacgaattttccaaaataacagtcgttcttacacggtgaattacctacacttacattatacgctgcaaatttcagaacttacattgtaattactcctctgaaacattgtaagttttgaatattcacatggtaatttttctaatacataatgtatatgagtattattatcaatttgaaaaaggagatagaagagatggaattagcacacttgtttacacatagaagatagagcaatcacatagagaaaaaaaggcgattgaaattaaaattaaagaaatgttgttgcgattgaaattttgttgctagaaaggtgtattattaattaattagtagatttttataaatattttttgacatgttgccttcacaatcttttacaaacatatatattaggatttttactttattatattctctcttcatctttcagaaaatttgaacaaaagtttgaaatttaaaaattctatcgatgcgtatgaatgcaattagttagctaggaaatcgtttggccagcgaggacaatgtgtaaggacatggaatggcagagatcgataagagaggagcaaagaaatcattgatttgaccaattttgacccaagttctccagtggagtcacttaatacagacccacttgtaaattaattcgaaattacacggaggagagtaccatgctcaagaaaggttagtagtagttactccacgggctaaaaaaaaggttgctactactccctccgtctaattttgatagttatatttctaaatctgaaaaaatatttttgatagtcatatttcaattcaacaacctatcatcttaatgactttctcagatttaatacataactattcattcttccatacacgattgactacatgggcatcggaaaatgtaaatattaatgaatcgcttgtttacgagaaatgactagtagcatatttaaatagatgataagtagaattacttatcattagtctgtgtgccaagatgaaatatgagtatcaaaagtagatggagggattggttaattaatactccctccgtcccattttgagtgcaattgtaagttttccgtatccaatatttgacaacccatcttatttgaaaaaattataaaatttctttaagaaaataagtcatgcatagaatactattcatgttttattatctattaataataaaaatactaatcatattttttaaaaaaagaacggataatcaaatattgaacatgaaaatttataactacacttaaaataaaaagggagagaaaatgaaaagggaaggagtaactatacttatattggtactacacaattgtatatatgattctagctgggcgacctctcgtacagttgtaccggccatcgtctagatttgcacatgtgagaggtcggtgtatgcatcgtgggttgcggccgatggaagcttcagatgatcgttggcgccagcccacgtgaggttctgaattcgggagccggcctagctacctaccacccttctcccgccagccattgccgaggagattgagcacgtggcagctagctttgcatcctgcatactaggtgttagcatccataagtagggcattaaagaaaaggcactaaagaagagagaagaataaagggccgagggacctagttattaagacccgaccgggaaaaaccggaaccacagcccttgccggtccggtccaggtaaaagaccggcatgcaattgacccctccccccggccatgaaccggttagagtacgtgggatggggtccggtccagataaaagaccagcatgcaattgacccgcccccccctcctcggaaatcgcaacaacattttttatcaacattggaatttctatttttcttgtccgttttcacttttttctatctttcttgtcctattggaattttttttgtccgtttccaactttttttttgtctgtttactctttgtttgttttgtccgtttacacaaaacctaatcgtaatacccttctatttttctttttttcttatttttttcgattaacatgggattttctagaccgtgagagcgaatatggagacttctttttcttttactctatagatataatagatgtcacctccaatattatgttgttttttttaatggagggagtagagaagaaatatacttaagccttcgtatcgctgctcttctgtatagactaaacacaagacatatatgatagaaggcattgcacattagaggatgcagatcacagttgtgtgctttgctccacatgggaagaaagagaaactttgagatacatgttcttcatatatctttttagtggagcttgctagaagagaattggcataagttgaaattgcaatctggattttttttttcatatgatagttcttgctaagatcagattcagaaacaaagggttcttcaagattatattcatagcatattggcacctttggaagcaaagaaatggtttcattttttttcaaaatattaatccaaaagaaggatagttggtttagaagttttaagcgagagattcttccatatctctacataatgaatgaatctgttctttcaatggtttctatcagggtacgacatttgtaatcttggagttggaccttttgtagttgttttctttttatcctaatctaaaatcaactactggacacaaggcctgatagtattttcccttaagaaaagaaatgtactcaagccaaacactgggtagcaagggcatatagagacggcaccttcgaaggctataggtcggtatatcgtgagattattggctaagtcaccgtatgtaccttgttgtcgacaaaaatatttcctaccactgaaataataacagccaatatatctcaattccaataacgttgtgttagcaagtacaaccgattaccattagagtttgtctacacgggcggagctaaccccattcgtcgaaatttctaaattaaaacattgtttagatctgtagatcactgtgctgtacaatggagctaacccgccgggtgtcatttttggcttgcttcgcctttgtaaatgttatattttcttaaagtttattttaatttccgtctttttaatgcaattgcaaaattgtacactttatattctagaaaatctaaaaatatgctaaacatattaaaataattacattcggatggaaattaataacaaaacacaggtttgatggatgctgaacattactaaactataatacttgaagttattttaattgtatttatatttgacatgctagcatgaattttattgggacggaaaaggggttgaatatcttgggacatggcaacaaatattatatataggagactaggaactctttgtctagaaaaaggacttttttgtcaaagctttgtaatagtttttatatggccattaggacatatagaaactactagcaattaaaactaccatttgattttttttagataatggaactaccatttgatgaaacttgctgactaagatttacttagaaaaaacaaagattttagacagcaagagttgtttaattaattgtattattgttagagctagcttgacttgttagctagatcgaggtacgttgacacatgtgatgaactaaagctagcccaagtggcacaattgcacaagaactgatctgatccactgagatacctaatcagttacgtgtttgcccagaaggagccaaaggaggacgacagtacattaagcaagtcatatgtggactaccgatgacaattatagaggcagaagcaccaattcatgttggaagctttactaccacgtttatgaaataataatgagcaccaatttaccaataggagggagtgagattaattaattaacctgcataattggagcaatcaaaaggaaaacacatgggcaaatggttcacctcgcaactacatagtttcctttttccagaaatgttatggaatggaagttgtctattgtgaaggaccacatgaaaacactatttcggatgggaattattgcattagccatcgtaaagtaaactttgttaggatcatgcatgtagatgttttgttcacctcatcagacttaaaatcatttctctataaattttataagtctaggcatttttaatcaataaaggaaaaatgatttccacatacgggtgtcataacaatcgcctgtagaaacaaattaatcaacaaaggtggctagatatgaagacgtaccgcccatatgtaaatattagtgcagttggtcttcaaagcaaaatagctcaggtagattgttaggacgactgcccatgtaaatgtctgtttatatatttgggccttcacgaaaaaaaggtatatatgtcctagagaaccccaaaccaatgccgtcatgttgctgaaattcctaatccgtcaacactcaacaggcatgagctcgaccacgaccacactccgaagacactgccaccgcaacctccttctcgacacagccatccactccactgccgccagcctgctcattatccctaacacgccggcaatccagaggtcaacccggccaccgccgcacctcctagatgccgccaccgccggtagcgacctggtcttccttccaaacgtgtcggtgataccgagttcgtccctgacaacgccgctagccacctccaccttccttaatcctgatacactgtctccgacggttagtgtgaattgttaaaataaatgaatatagtttaaatgtgaaattaaaatgatacttagaatatatgtatgtgatttaaaataagtgtatatatatagtttagaatgtaatgataagaccaatgtggtaaaaggaaactgaataaccgttgcgatttaggtactctaaggaggataacaataatagttttgagccctacactgaagaggagactacaactagagatttacattccacaaccgacataacagggtgtccacgtagaatatccgaacaacttctacaccaaattggggcaactagaacatgctcccgaaaaaaaaatgttaaaggccaatccatctacacatttggttcccacttcaagtaaagggggtgtgtgggggggggtgtggaatggatggatcacaacatgtgtccaaaaatcgtcggaggaaggataagtgtgacattatagtggcactcaactgcaggaaagaaccataagacctatgatatcatcatccgatgagagtgggggtgaaaccaattgagtacaacttgccgagccatgtcccatgcccgcagccaccctgatatggggagaacgacattgattttgaccctgccaaggaagtatatattaacatgatacgttgcattttacatttcattttccattgtctatttctttataacaactatcaatgttttataggtctggatcgatggaagataaacttgtcgaaagtcgaggcaagaaaattccctcccttagctacccaacccaagggtgcctcaacggagaataggattcttgtaatccgaattttgggagaaaaaactctcgtgtctccccttgtgtgcaatttgtgtttcacctgtgatttacctttcttagctattcattactttcttctaagcttctttaagtattgggaatccttgagaaccaatatttgtgtctcaaaaagaaagaaccccaaaagtttcacaaaagaacaccgaaagttccgggcagccctctcagtcttttgtcgcgagctgccaggaaatttcggggcctgtcatctaactgtgtcaattgaagaaaacttcaggaaagcctattcacaccccccctccctctaggctacaccttgggctttcatagagtttgctcaaaagaatgccatggaggaagccaagaaattgagcgaggcgaaaaaccaactccccaagagaaattagttcccccgtcgcttgggatctagtaagtaagatggggaagccgatgaatggaggaggaaaaaaataggatgaaaggatcgggagacagttaacatcaaaatttggtatggttctttagtagattcggctaaggaaagaaaccgattggttgatggaaatttgtgtagataaagctgaattcaaggaggaaccgtgaagacaatggcaaggcggattcatattttttagtatatttcttaaataggcatgattagttatttccttgtgagtacaacatttgtgagttccttaggttggatgggaggtatatagtgaaccccaactagttaagtcaatatttataattgaacaaatagtgtggttcttaattatattgatttttaatgttctaactcttttagttattgttttattacaacggcccacacaaccaacctctttcaaacttaatggaacacatattgctaatatacaaagtttgatgttgctagattatccaccgatagctattatacacaatgctgccacgggactgatagctatttttcttgaatgaaacacagcaggggaagcccccactgttaatatattaaaaagaataaaaagaatttacaacagcagaatccaattcttaactacatcttgatctctctcatttaatctaaaaagcaacaacagataatccctcttaaggagatttttccaagaagaaaaggaaaacttcttattataaaaaatgaaactattctttgcttccatatattccaggctgcaagaaggagtttctcaaagaaacaatatccagaataattagctttagccaccactaacatgttatccagtttcagattggtatcccaggaaatacccaaagagttccaacaaacagtagagaagggacagaggaaaaacaaatggagcatggtctcagtgcattgaagttgacaaagcatacagtacagatcacaattagggggggcacaatgcttatgatccaacagaaacttagtattcagcctgtccataagcataagccatccaaaaactttaaccttagatgtgaatttgcttttccaaagccaaacaaagtgttgtggtgacttcaaagctctgaaattgaaagcataaaatttctgcgatgtaaatttcaaactgccccaaatataagaccagctatcacaatctccagaaaggtcaattctagacattaggtccgataaaatcaagagctcagagtaagcttgatgagaaaccggcagatgaaaatgatcctcaattggagagattaagaaattctgaacagatacattcctattcaccacaaaagagcataaccttggcatatgcaaagaaagaggtggaccatctgaccaaacatcatcccagaaagaacaagacaatccattacccagagtacaccttgatattcctctgaaaaggtccattaacttgcgaacatccttccactaaaaagacccccttggaggagacagatgagggatcttgtcatagtaagaagatcagataagagacacccaaggcacttgtcttctattataaaacttgtccaaatatttaagtaaaatagcctgattctggatagacaaatttattacacccaaacccccttttaccttaggcttacaaaccttgtcccaagcagccaaagactttttactagaattgaaatctcctcctctccaaagacaatgtctcctagccctgtcaatattctcaataactgttttaggaagctgcagtgtgcacatataatatgtagggtgagaagagaaaactgaattaaccaaggtaagcctatccccataagaaagaaaggctgaatttgcagacaatattctctcaattctatcaactagaggagcaaagtcaatcactctgggttttgtggtacccaaaggcaaaccaaggtaagtgaaaggaagggtaccaattttgcagccaaaaactccagccaacatctcagccttatcatcattcacattaatagggatgagacaggatttatgataattcactttaagacctgtaccttgagcaaaggtttgcaacagggcctttaacacaaaaagttctttaccacaagccttaacatacaacaaagtatcatcagcatattgcattattggaaagttatggtcatcccccatgggaattggcttagataacaagcccttttgatgtgccatatttattatagactataagagatcagctccaagcacaaaaagcaaaggttagaggggatcaccctgccttactcctcttttgcaatgaaagtccaaaccagggacaccatttaaaagaactgaagaggatgcataagacaaaattttcctcacccaacaacaccacttatcagagaatcccatagcagccataacctttagtatagctcatgctctatagt

SEQ ID NO: 71828 - DNA, 1937 bp, Oryza sativa
gttgattaatttatctgacatctcttattaggatctttttgctgctgggacggagacatcaacagcaacactccaatgggctatgtccgaggtggtgaggaacccaagaataatgcaaaaggcacaagccgagctacgtaacaagcttcaagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcagttggatagcaaccgccctcttcagaacagcgttctctctcagatatattgccagttgctccttcagcatcacattttcctgcaggaaagcaaagcataactgcttaatttgcctaggagtacaagtactatggatg

SEQ ID NO: 71829 - DNA, 3794 bp, Oryza sativa
ttgttttgcgtgagattaagacggaaattcgaggcgctgtaatgattttgtgcactgttcgtgtagaatttgagttagaaggccgctggactcttacatcacgcaggagaatttcattgctgaagctttgcattgtgcgttgcctttgcagttgtttagtttgtggtttgcattcttgtgtacttgtgttgtttggaaattggaaagttctagagtctagacatcttaagatgtcagatctctccactatgttaaatgcattttggttttgtggaagacaggtgcttgtaacaaaggtgaacactttaattacctagttgatgcgccgacactgtgaactctgtgtagaatcattgatgactaaattctaatgctgacaatgtgagcactagcacaactgttttgtatcttgtactcaccattctcgctaccttttgtggtgtagtttcgtcagagtggggccaggacacctcaatgtactttgcttggtgctttgactaaacctaacgatgaatatgaattaaaggtaaacttttttttatggtttttcattttgttcaaggcatatttgcattacacttgtgaattgtaagttgattacaatgggaaactatgtactgcagaagaatagcatgatatactaagtcggattactgattcgtaatgtgctaaattgaattatgcagaagctttctactaggtggcaaaagaaatttggcgaggagatagatcaagatcttttgtatttgatatcagtagacagaatcttgcacattgaagatttcaatgaggtaaaatacattattttcttctagttacttttggtttcttcatattctgcagtttgtcattttgggagttcttattctagtactgcagtgtttgttccgcattgattgcctcactttatctacttctatacaaacattccttactttatctaccgtattgggtgaaaaatgaacttattttgggacggaggaagtagaaggtgtctcattttcatgagaaaatgagatggaacttttagtgttcttcacacttcattctgttttgctaataataaggatataatagttaggtatgggttatttgtgcatgattttttgcatagtgtgagacagtaacaagatatgtagacaagagatgtgggttgaatttctttttactcgctgaagattgctgtgcagaacggtatcaaatagttatccatgacgctgaatggtgatcagtaaactagctgacgaaaatagcctcttaacgtgaaaatgtacattaaaagcatggagcaagataacttttacattctatcctaagaatattttcagttggaacatccatttcattaccttggctgtattggtctagttatcatttctgtgtttcaggtgtagtgcaccccttgaaagtgtctggccttctttttttgttataactggttttgccttctttcatattcggaagaagacctatttattgtttacattattcagattttgtttggctgacctgtattttacgaggataaatatatggagatcacttttagtagaatgtctttctcaatttcctttcatggatagcttcctgactttagaaaaaaaaacatcaagatattttagcacttaataaaatcatcaatttatcaattttcccccacacctatatttagtttattccccactcattgaatcacttccacacgaccaaattactacggaaatgaattgatataggttgctaattgaaccttgagcagctgctgaaatttgttcaaccaacatattaggtgctttaaatgttgtcaagtttcatctgttgcatttgatgtacttagttctatgtgagttgtgcagtttttattttctgatggatgtgtgctggtgagccaattacaccttagaactttgtagttcaaatgagactgatattcatgggatactttttctgttcaggatggcatgtgggtaattccatcagaatacagtgatgcagaacctgaccctcttcgaaattttgcggaaagcattgttgaggaaatgaacagcaaacatgctgaagatgtacataggatatacagtatttatgttgaatcagatttccaggtactgaagttattcctgtcattcctacaactttgcttcttacttcttgaaaggaaaaatagctaatgttaagataaagcacatgtttgtcttttcatagtttctttataatcacacagctgtagagattttttttttttgatgggaacatagctatagagaattaccaaaacagaaagatgtaatttactgatagtctgatagtggtatagtgattatgtgttatatatatgagttaggggcatatcaaactatgcatctttttattctttatttgaagaaaagtaattaaaaaattgttgatcttatcttttctaaaagatactccagctgattaatattttatgtgctatgtgataattcatagatagtgagatattatataccgcaccaagtgttgagttccgttatgtttactgaatgtgctaacagtgttcttttatggtgacaggcgacagaggtgaagatgatttgggtagacaggttgggttttgacttgcatgttcattccggggaaagtacctttgctgcccggatccctttcacgagagaggtctctgatgagaagggagtgaaatcatcattcaacatgatgtctcatcatgcgtgggaagtagagaagagttatgcggccccagagtttgagaaggtagagctcttgaagaaagtcagataggtactgtgatttctatggtgccgccttaccctgcatccgttgtcagtattttgtcattcatacgagtatagcgcaacttttgtcgcattaaatgtattgtgtgtacctccattttttgccatatgtgctataggttagtcgttcttttgtggagagctatgaatctagactgtaaggttggaactttagctgtggcttcttcatgagatgagattgagataattaaatcatgtttatacgatcttcagttgtaacatgcaacgttctacgtagtcagaattgcagtggagtactggctttatgccccaagtatagagcacttttgatgtaactaggaagatagcccgcgcacatgcgcgggcatcttatctgatgttgttttaaattgtgttaagaatgttttatgtgggtgacttttcttaaaattattctttgacactattgtaaacgtgttttttcactaatttgttttggattgctttgaattttggttatgattttcttatatttacccttggaagtttaaattctaaattaaaattaattggaactacgctgttttgaaactatgagaaaatatgttgtcataataatggagtttgttcttataaaactatcgtttgtactatgtgtatttactttttaatatttagcatatcttatctttttttagagttttttttatgtttctatgctttaagtaacaaaattgcttttataccatatatatttatgaatgttaggatatattaagtgaatatattttctattaaacaatatggctaataggaatgtttcatctaattaaaaaaacttctattaatttacttctactctcttctctttttttttcatatgttttcttattttctttgaaaaataaaattgatttgaaagaatagcacaatcatataaatttaattagtatgtgtaaagcgtttataaaggtttaagtgccatgggctaaattgcagttttgttcgatcaattctttttatcaagtatgttttact

SEQ ID NO: 71830 - DNA, 6117 bp, Oryza sativa
tggagtcctctaccatcgctgacggtatctgcctcccccctcaccgagaaccttgcaccagcgctcaagccaccgccgatcctagggccacagtccccgccgccgaggaagtcttctccccgaactaccaggctaccgccgccagtggccgctgcgtacgggacccacctccgtcggatctgccatctcgtagctgaggattggttgttgacgcttaggctgtcgttgtccaccgctagtcgcgccgccatttgaagggacgccgtcgtcgacacttcgccactacccgccgccctcccgatcaactttactgccgtcaccgacctgcacaactagactcgggcacgttccgcatctgtcctccaccgcccaccttcccgatatctacaccgccagatctatgggcagtaaccccaaccccaacgcctccccctcccccctaccccctcgcataagggagcaaggtcctcaccaaggaagccccgcctaggggtggcaacaaggcggggtgggtccaggttgagctggattgccccgcccccaccctcctacgggtatccccgccctcggccccacaatgaaagttggatgaaaagcatcacccgtcccgcccccacgggagacccggtgggtgaccggggccccgtatcacttggatggagttaatactctataaaaatattgcaatacattaaataatagtatgataaaatttcaatagccccagttgtggggcttgattgaagaaaggaaagggattacggttgagaggaactagggtgttgagcttttacatgtcaattctgaatgggcctgttgggtctatagtattgcaatgggctacttttagagaattaactcacatccgggtccccccggtcacccgcaggttaattccgatctctgccctcatccacactcacccactggtgagaattctccccctgccccggccccgtaggggcgggtcccaagccccgcagccgccttcctcacagctggttggcacgcaggcggtcttcttggcggcagcaaggcagcggagaaaggagactatttcttcaacatgactaatggtcaagcaattacacaccacacgcccgatgcgtacatatagcattgtccagggagctagtaatatattactatttgcgccataatttgattagtagttagtttcatatgagtataccaaattatctacaataattgtcgtatttgctgagtattctctttataaggctagttaaatttatatttgcagtgtgatgcatcggtcatgtgtgctagctatagcatttaggttactaaagttgtaccgatgtcgctgagatcactgtgcttggactgatagtatatatgtgcagatggcatacaagatgtacatacactggctgtttgacatgcatgggaggacatgtgcttggattatttgctgcagtcaaggagcttcaggctgatcatatgcagcagtggatcagatggtcatgtctaggagccggaccgcagcggcagcagctgaactagtaaagctgtggcgtgccgttgtgttgcattgcatgcaaggaaggtggccgagacagaagcagagcgtgggtggctaactggctatacaagatagagatactttgtagtacttcctccgtttcataacgtaagactttctagcattgtccacattcatatagatgctaatgaatctaaacatatatgtgtacctacactactatatgattgattttcctggacgcctcccctttttgtttccgtgcggttcgtaagtggaaccgtacagaaaaattgagaaccggcgctggggtgtcgcccgcacgggaaaatcgattttcccatgcgggcgtcctaagccaaccgtacgcaccgcacgggcccaccatttaacccctcccaccagccaccgcccactcccactccactcctctcctctcctcccactctcctctcctctcctctctctccctccctctccctcccctccacgacagcacgggtgcagcgacgggaggagagcatgcggcggcggcggcggccgccgtgggcgacagcgacggtggcgcgcgccccctcgcctccttcccctaccagatccggcggagggtgggcttgggggcggcggatccggcggcgcttgccccctcccctccttccccttgcagatccggcggagagggcagcggatctggcggcggcggccacgggcgacagcggcggcggtgtgcgccccctcccctccctccccgtgcagatccagcggaggggggggcttgggagtggtggaaccggaggctgccgccccctcccctccttccccttgcaggccggcgacgcgcggctctctcccctcccttgcagatccggcggagcggcggcatgcgtcggcgaccagatctatctctccccctcctctcttttttacttgtgtttttttgtgtgatttgttcatgtgatgtgtgttcttgtgatgtaagattcggcggcgggcgacggcgacggcggcggcgggcctcggctaggcggcggcggattagggttagggctagggtttcttttttctttttttttgtttctttttttgttgctccgtgcgggcgacttaagcgcccgcacgcaaaaatcggttttcgcgtgctggcgcaccacccgcacgtgaaaatcgcgattttcccagacgactgggtgcgtgcgggccgtccacccgcacgcgaaaatccgcccacccacacggaaaaattggcgctgtagcagtgctagattcattagtatatatatgaatgtaggcaatgctataaaatcttacattatgaaacggagggagtagttgatttgatagtactcatgagagtttccatatttacttaggactgttgtttaagatgtttcctatatatattaggctatactaggtctctttaggcggaaaacctaatgcgcgaatgttcgctaccagcgaagtcagcgaactaatccgggtttcagtttataggttcacgcattattttcattttctgttcacctgctgcctgcatgttccctcgctgaaaatattacatgtgaaagggtgaacataagcacatgtaatctaatcttgttatttttctctggagtggcctatcggccttaatgatcctaacataaagtttctgcaaattattttttaattcgtttgaaatttatatgtgcaaagtttataggtgcagaatttacatgcagaaactttctatgcataaagtttatatgtataaaatatctatgtataaagtttctatgtatagattttttttcacgtataaatatttttttagaaagggtattacatactgtagcattcatttaaatttgtatgtacaaaatttacatgtacaaactttctatgtataaagattacatattgaagtattgatgtatatattctaggtataaatatgttttgggttgatcaagacgttgttgggctaaagcctggtaaaaaagaaaaggcaggttgaaacccatgggctggcttggctagctcgcagcgttgcacgctggttggaaaccacgtatgaatgtacaagagcgataggctattggaatattcacgggtcacatttgttcgcgtactagacacgcccctgtttaggacccctgaaaaattatcaatcaactatttcatctttttatttttctattttatttttatggctgagctttagcaaccataaagtttggttaatcttcaccattttacgctgcaaaatggtcgcgcttctccacgaaaatttaaaggttattcttactagtttgctcagaaattagtctttcgtcatcatgtaagtatgatatttatttttttttctttgctaattttctcataaattagtcgctcgattccgtgaaagtgaattcatttggaaagtgaattagtcgctcgattttgattcttcgattttgacgattccgttgattacaccttaaactgtgagatcgatcgaaaacagcaaattttatcgaataccatctacctagtccagatttcattgcaaacataggatttggctggtgctcctcggcaaacatatcggcagcgccctctacatcacatttcttgtcgccggtttcgtggagatggccgtggagctagaggtactctgcgtagtgaggctggaggctgcttgtatgtggctagggtgacttgaacaaatgcttgttgattgaaggggatagaatatagggaaaacattgacatcttcaaattcttcaccttcaaaacttgggactaatggctggcttatgcaaaactgtctgctgaatcaaaatttcccaatgactccaaaacctatctttatcttgtaaaaccgacttgctcatgtgcgacttcttatggcaatgccaagatactttatcctacataatcggaatgcaaaaatagtgactttggattggcagtgacctgtgaggtggtggggataacaaatactgccagcacacaatatgtatatttcgctcaagaccggcttggtgcagtagcccagcattgctatgcagagagggtgagacagaagaaataggtagccaatgacatgtgggcctacataagcattcgatataaagaaactaagatggaaaacgaagacgtcgataatgatatgtgggtcaacatgaggataggttggtcattttaccgaaattcttacaaattcctatcgtgctaatggcatggcaccgttaatagagatatcaatcacggtggcataaaatgagaccaatttaaatcaagtggtatatgagttaactcacattctgaatggcaaataagcgatcggaataattttcagtggcattacagtggcttacaaggaattaaatttttctcgtgaaaaaaaaaagaaatatacaacaatttattctagtttcaccacattatatatactcattctgacttactaaaacaacgtcccacctcatatgccagatttccacgttcgtatgaatcgatcaaagagtatcatactacagctatagctaagtattggtctgatccagttcaaccaatgcaattaggactttcggttcctttttttttcactgaggtaaatacgacatttttagttaggtaaaatacggtattttcgaagaacaatgactatttattgaactttaatcaataggacatggctatgctcagtgttcactgtttataaatcacaaaacatccaactaagcaaatgttaagcaatttcagcacacctgatccatacatgtcttttccagggagctagtgaagtattactagtagaacataaccatgtaacttctcgtataaagtagctgctagtggtttaagagatcacctacagtctgatttttttcgtgaaaccaaattttccttattttttaccacaaaaacagaatatgaaactaccaaaacatcccaaataccaaaccggacagaccatgtggtaattgttcactttcttgccaaaattacccctactaagttttggtaattgttaacattgccaaatcttacctccattacaaaattttgataattctagatttttcctactgttatgtatttacatgctaatgtgctcctatggaaccttttgatcctatactatggacagtgttgtagtctcaaagtctaactgctcagcgaccaaacaacgcactatttcctctgattcgcacagcatcatttttattggcacagacaggaatagaaattggtgtccttccattgctccctactgccctccgcgatgtgtgctgacatgtcccattctcataggatgaagcacttgtgttacagtgaaaccatatatatgtttcactgcatcaggactttgagaacgaaatgctgttacttgtttaagcttggatggttggccaacgttctcaaagcatgcactaacccttttgtgagcgaaaattttacgaagaagttctcagatgccctgtccacccatgtttttgtctattgttgaagcaagagatgcaattatgcaaaattaatgtaccattgtacacctttgtcataaagtccataaatttgatgttattcatctgggcgcccagacaaagcatgttgttggaagcaattggatggaagtacaa

SEQ ID NO: 71831 - DNA, 14555 bp, Oryza sativa
aacatattttatgtaattgatacttatgaattttgagcctaaaaattgagattgcatggttttatgagagaagaaagaagagactatgtgtaccatagatctatcatccaaaggctagaaataattgtgatgtggcttcatgagagaagagagaaatagcattaactacacttagtggggatgaactataagtatataggattaggatgatccaaactatgatgtgataatatcttggtttttgggttaagggtggttgagccttatattttggaatgtagggaataatttataatattgaccaaccatcccaaattgtcttattggtttacatgatggtttttatggaatacagaaagctccagtaaaatataagaaaatgtggatgatttacatgatactacttttggtttcaaaaaagaaacaacttgtgtttcttagttttcattaagtcaaatcttacatagatattgcagcctacagagtaatagtcatgaaggactttttgtctattggatccaaccataaaacctatctaattttattatgtcactgtgggatgcatcctgccattagcttctgttcctatagttcaaggtaaggtctaaaggagccaggtgtctatacccttagttagcactatgaattcccgtagtctctcgagaaaacaatgtgctgaagattaaggttaggtcttacagacacttcacacaaatgaaaattgtgtgttactaaagcagcaagtgcaacagcaccatttaatcaaagctttcactctttcagcatatatcagctataacatttcacattatcatagtgcaatgcagaaactagaaaggcggtagaagtacattggaaagaaaaaaactacatgcctcaaagtttgaagaaaccgttggagtagaagccaaactacttttcagagcatctgaatcagcagagctaattaatgatttagtaaaatccctgtaaaataagaaggtgtttcagatagcagtgcttgcatgtaggtgtgcgcacacatgtctgtacagcaacctgcacaaacacataatctgtccgaaaaataatctaggacagcacagagcttagtataaaaaaaataattgatatgcagttgaatgttgaacaaggaactggcacctttcatttgtaagttggaggattggataaaatggcccagcaagcagagccaaaaagtgtacactgctgtctggagtgtctgtgacactagcgaggtcagcctgcactcagatagacagcggcgattaaagggaaacaacaaaggcacaacataccatacatggacatggggagatgcatgctagtcggaaagcttacctcaatctggggcagaaatggtggtagcctgcttgcaatgtctttgagtaactaatatcaaaaaaattgcatgattagaagaaacttatatgttgccaagacacagacagaagtaagaagaagaagaagaaacaaacctggaggtggatattttgagaggattgtttgtgtgcagtgatatgtggcaataggtagttgactagaggctggaggtcaggttccagtccaggtatagggattccaatgagctgaagaagaagagtgacttattactcggaatatatccggaggaagagtaaaagttatactagtagttactcctacctggatgaagaagatggcgatagggttgccgcgcatacaagagatgcggacgtagcggcaaggggtgtggttggcaggatagagtatgtcgcgcttgggagcctcgcagcgcgggcgaaccttgacgaaggtatctggcttgttgtagcgcaggccggcagtgatctcccactcgaggacggacttgttgtagatgcggatgtgggagaggaggcacggctcctgcagcagcaaattcagcaattcattcagggctagagaaggagactcctagttagagagggggaagaaacaacaagtcgctagtacgcacgctgagctcgagcaggatccactccttggtgttggtggcggtggaccagtgggagcgcaggtctggctacagcacattggccgccttctgcgccgccggctcgcacgaagacgccttcacccggaaacccagcaccccgacaccatctccccactccgacgatgcctccctctccggttccatcgcgcagcgcagcccagccggcctcctcctgcggctgcccacacagaggtagaggtagagaggaggaggaggaaggggagagtccgagtcctagtcctagtccgaggaggaggagggttgaagacgacgacggcccacacagataagagtcgagtcgatatcggatgggccttgggccttacttcctacactacgggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaatagaaaagtttcctacatttttccttttctcattcctacgaatcaaaggcatgaatagtgtaggatttcaattcctttgtttttcctccattttccctccaattcaaagggggcctacattttttagcccacaccacacatttcgccccgccgcagacggcagaccacaccttacaacttcttcttcagttgccttccttttggatcctctcctctcctcctctcccgcaggcgcaaggtgtttgatgaaacgcctccatgcatgcatgtacacgagctgtgtgtctacatctctgtctcctttaatttcaatctcaccaacctggttgttaactgtgagtctgaaattctgcaggaagcagtttgttcattcaaaaataggttcaagaattagatactgtagtttcatctatctagatctggactagatatatacaccctgtcacactgaagccggcctgatcgaactcactggtttgtgtgccttcacactgcaatcctaaagggtcttcgccattcacactcctgcacactgctcttcgtatggtgcatatatattatctgctgactcgatccattgtcgcgtgcctatctctaagtgtggtactttctctaacctgcaaatatattgcattctagctagcctttctgcctgaaaatatatattgtattaactgattcaagtactgattgcattgactgcacctttttgggatagtttaacagtgtagcatggacttgattggggttatattaggtgcatgtgtgtgtatacaccaatacaccatggtatcgtacataccatggtcgcattcgtacggtgtctcctgtggactttgttgagtacccaccttgcttacagatggacctataagttccatagcttgcattgactgcacctttcttgacttacaagcacaaaggctcatttttttaagacatcatccctagattaaattaaaactttacatgaagcttgaaaacatagccaacgtgcttctgttttttttttacttttattttcgctcccaattcattgattttgtcaaaagcagattaattcatctcttggtgaatcctttcaaaaaaattcatctcttggtgaacaaagaatcattatataccatttccattatctaaaaaaccaaagaattatcaagtttaattactgaactgatatagagttctagacttcttttgagacagctgtgcttttcaaattgcagatcatgtactctaatccacacacaaaataatctgttagctcttttttttttgaacgaaaaacagtactatagtgccttttcattgaatagagcaggagaaaatacaacccctaggggcaaaagaaaaaaaaatctggagcctgcagctatacactatacaaagtgcgggattaactcgcgcagccgctttacccccgctaaagcccaaaggttagcttattctttgattctcgacatgaggaaacttgttgccacctctttgtggtcaaagattcgccgatttctctctttccatatttctcatacaactagcattatgagtgatcggagcccttttttcggagcatttggcatgtttgcaaggttctcccaccactgttgcactgacagtgcctcctcccattgagccggctcaatctgctggtagccgacccgtccagcaacgaggccctatatccttttagtgtatctacaagtggcaatgagatgcagcgccgtctcagcctcgcagtggcagaggacaaacacccattgttttgccatccccttgtcgcaagtcgatctgaagtccatactctattttgaatgatgagccaagcatgaaatttgcatttccccggcgcccaggctttccagattaaggagttgaaacttgtgctcggtgttccttgacattgcgcatggtaggccgaggaggtcgtgtagcgtccgctacttgtgaatttccaagtaatttggtccggttctccaatgcctaagtggacattccggaccgcttcccacagggcaaccagttgtcaactagttctactataataggcgagtgtgattctagagccaggtcctgaacccaggcgtcctcctcctttccatttcgaagagacctccctctgtttttagagatcgcatagaccagtggcatgaggtctttgggtctttgtccctcgatccaggcggaatcccataagcgcgtcatgttcccatctccaattgttatctttgttgaggcggcgaaaagactcctgtcaatttcatcgcagggcgtttccagtcccacccaaggcttggtcggatccttccactcgtgccataaccatcgcagcctcaagaccctcgtgaatttctctagatctaggactcccaatcctccctgactggttggcaagcacgtctttttccaattgactttacattttcctccggtgatatctcccgttccggcctagagaaagcgacggcgctgcttgtctatttgctcaagggattccttcgtggttttcaaggcagtcaggagatagataggttgtgccgtaagcatagatttgacaagcgtggttcttctagctgctgccatgttcttccctgtccagtttgttatccttcctgagattttgtcaaagataggttgcaaatccgcctttcgtaatctacccagtaccaaggggaggcccaagtactttatggggaagtttgctcttatcgccggaacgccctcaagaacctccgtcaactcaatggtgtcacatctgatggccgccacttgggatttttgaaggttggtgacgagtcctatggcaatgccaaagcgatgtaggatgtctgcaaaagccgtgacatcgcctcgagtggggttaatgaagatgactgcgtcgtccgcatacatcgaggtcctcagacgggtcgttctccctcacaacttcgagattgcaccgagctctgttgcctttgagaggattcgttgcagggagtcaattgcaagtatgaatatcagtggtgaaagggggtccccttgtctaaggcctctgccatgcttaattcgctgccctggcgaaccattgaggagtacttgcgaagttgacgttgagaaaatagcccccaaccaatctctccatcttgttgggaaacccctttgctatagcaaggcaagaaggtagtcccagcgaatggaatcgaaggccttagttatgtctagcttgaatagcagcattgctcgcttcaagcggtggtatcttctagccttgtttcttacgaaaaggaagttgccatgaatgcttcttccttttatgaaggcactttgattgaccgaaatcaacgtatgcatgtgtggccttagccgcagcgcaagcatcttggagaagatcttggcgataccgtgaatgaggctaattggcctgtagtccgcgaccccctcagccccttctttcttaggtattaggacgatgttcgcggagttgagcagatttagatgtgcacatatgagattatagattgagtctaagactagaagaatgtcttctttgatgatttcccagcagactttgaagaagatcccagtgaagccatctggccttggggctttgtcggtgggcatctccttaatggccctatgcactagggctgtcaacgagccgagctcgagcgagctcgtcagcctaggctcgagctcgatacaagctcgagccgagctcgagccgagcctataaaatgttcgagctttccgacaggctcggctcgagctcgattaccgagcttgatttttaagtaaaatatatatatatttcaaagataatctttaaaaaaataattaatttctagtttatcatactaatagaagaggaaaaaagaataaaataaatatattatgtcaatataagacatacaaataacatatttgatctcctaagttattaagtaacaataaaaatgatatattactaggctcgttagaagctcgagctcggctcgacaaagctcgcgagcttagggagaggctcggctcggctcgtctggagctcgagccgagctcgaatcgagcctaggacgagccgagctcgagcagctcgcgagcctcgagcttttttgacagccctactatgcacctcttgctccgagaagggctccccttttagttttctttggcttacaatttgatattatcagatgtagtgtcactgaaaagtatgccaaagcaagtgctgctggttgtgcatggtggtagtgtactgatgtgcctcagaaaaacagtgcttcgtcatgcttgttagggcaatttgattgcacatggtaatagtattgttttttattgaataatggtaatagtattgttactcgttatatactcttccttcatcgatcgtgatttgcaaaagcaaaacccacagccaactcttgttaatttgaggaacatataccaacaacaatatcttactcctgtaaacattcaattaaaataaatatatagccgttcctattgttacaatcgtagaaacaagctatggctaatacaaatgaacacgctatatagtagtataaaagtaacttacagttgtccattctaaaaaaaaaaagtaataacttacagctgcctcttggtggtattaattaattggtcccctagtaactgtaaaaaataattgtgtgataactggcagagagtaggaagtattggatcctatattggagtattgctcattttatttaatttaatcattatacgaatgttcttgtatcagagtgtgaagtctagtgggagggtgaagtgccttaggttgagcaatggcttgaaatcgttgagcagatttacattgtgatccctccaggttcgattaaggtgaggctatcaagttattgatttatttttttcaatgctgggtgttctttcctgaccaaagctttttctggcagatgaggaccttctccttgtctgccttgtattcggtatcatgcttgtcacagttccatctcattcctttgacaatgatggctacagaatccagaaagtaggcgttctcgcggattatggcataaccagtgggacgaaggatacggtccatctcaagaagtacaaacttcatctcgcacctgcaattgcaacgtacggtaagtacgtgttaattgtaactggatggagtatttcttacttgctttcttgtgaatttgaagttagaaatgctgatttgcaagtgtacgtacctatgagactctgcagtaaacaagccatcaagatgcaatagatcgtacgtcctggggtatgtagagaatgcctcacacctacagtagagttgattggaaggacaatgagtagttgaataattaagctatgatatagtagaagaatgaattaaatgcaaatagtcaccagtcgtggttggtgccgatgaggcctctgtcgaagacgacgccgagggagttgggtccgtaggaggagacgacgttcatgacccagacggggtccttgatgaggctggcggcgaagcctccgtagacggtgttcatgtccatcacgttcctgatcttgtcgctccccagcgccgggagcagagccttgtagtgcttggtccggagcttccacttgccatcgtcgtgcttgaaggcggcggcactgctcccggggacggtggcgatgcgctctggggcgacggccaggcgctgcggccacttgggggtggcgtcgagcgccagcttcttgtagcgcgaggaagtggaagaaggcgaggtgaggcaggagcgcatgggcacgtaccaggcggcgtccgggtcgacgctgtcgtcgcacttgggcggcgaggagacgggcgtgagcttgtcgtagcaggcagggtcggtggacttctgccacacggccgtcgcgacagccacagcttactagtaatatgccaaatggtttataaccctatggatataagcgttggctaaaccttcgagcgttagtaatatgccatgactacaggtattgctccacacttgctacagtcactgctctttttttcccttcttttatatctgaaagccaccgaaataagccggaaacaaaccagataatatttgcattcctcggggatataaagaactaaaattcacaaccaattttcagacaaatgatttttcagtttttctctaaggtccttctctgttaatgcataccaacaaaatgcatacttcctatagcaaacaagaacaggccgatgaacatataaaaaacaatacatttcgagctgcatcgtatatttttacacagagaaaagaggaaggaagattaaaaaagataagggccaaaaaaacaaccccacgtatatattgtttgaagcaccattcgagatagaaattgaatctgttactatgctcgaggtaaatatataatatacacggtgcaagtaagagtatattatgtttttctaccggaatccattttgtcatgcattctgtaagaccccaacgatccccacgcatgcaagagacaaggttgcactaaaacctaaactcaatttattcatccaaaaccacgatctgaaaccatacatacatccctagtaaatctgaaaccatacataagatgccactggtgccggtcctcagtaccgatcttcctcatcatcgctacatgaagagaaaagtatgtatattccctccacatctaaactgagtataagggttgttaattagaaaaaggtgatctcagtcatagaagtaaaaggatggctcagattaggtgaaattcacccaggaaaaaggatgtctctatgatgtacagatgctcatcatgttaacacttcactgaccgtaacatgtcaatcatgaattccgtgttgtcatctgaagaagcctaaaagagataaggtcttttaaaatggtaaaaagaacaataattgagagagtgaaggctagagtagacgctacacaccattttggaaaatgataactgatgttccaaacaaagttgcctcgcaatttccttaaaagcaaagtaacagaagcattagcatggctgcattggagttgataaagcatagaaacaactatggagttaactgaattggtggacaggagttaagagagagggagatctggttcagagagcatgtggaatacagaaattgaaccaaaaaagctggcatcagaaagctctaaccttcgtggcacagttgtcatcactatgtagcatcccattcagcctgatctgaaaaaagtttgcacaatgatccaactggactacaagttaacaaagtctaactaattgtgcattatgatatattgtccttttggctaggccatgcatttgagaatataaaaatatgaaaggaatttctacatttagccttgtccccttccgccctaaagcgccctgaaacaaactattttctcgtaacctgtgtttatttcacggccaacgtaggtaaatcattggtcgtgtattacgcaaatacatggatacatttctagcaacaagtaaagtcaggatattgcattaggatgctccttcttcagatcgtctagaaccatgtcgacccctgcgaagaattgaaatatcagtccaggccaaaacaacagatagcataaagtcgtagaccgcccactggcacatttcgtcgaacaccacccctgcattccagaaaactgctgaaaggggaagcagaaggaaaacctcacagccgcaggggccgaggagcaggacggagttgttgcaggcctcggagacggagctggcgacgaggtacttcagcttactgtgcccaacccagaacaaagcgcgtcaatcatgagggaggcgtctcgcgacgcggtcggcaggagggactgggcgccggctgcgcggtcagcggcgaggggcggcgccgccgtcgctggaggggggcacgagcgtcggaggcatatcgcgagttcgcgacgcggtcggtggggaggggagccgtcgcgctggtggcgaaacggaagggtggcagcaggggagagaggaggaggcgattagggtttgccggggggagtgcggcggcgcttgtggtggcaggggatgcgacggcgctgtaggttgggagagggaggcggagcgatttaggttggggaaggagagcgcgttgaagatggcaggaggagcgatctgagcggcgtgattttcggttgaggggagttggggaaatgcgcgcggaggttgagggggtacgtggaacgattctgtggcgttggattggatgattctcgtccgtagtatttgatgaatgagtatgtaggtgtaagaatgagttggtgaattatagggtagactagtaatttgcccgtgctaacgctacggttgcaatagtcaacccggcggcacaacgctactatagctgcacgcttgcctccatggagaaaataccctcaaattttcaatgcaaacgtaagcagcaataccaatatcaatatgtcatgtctcattgtattcacaaagtctcttttatataaaaaataattattttcgtgaatgcctttgaattttcaaatgtcttttgagttttggtagataatccagaaaagaaatgcattgctttctttcttaacaattgcatctacgaacttaacaaaaccagaggcatatttcaaggtcgcgtgcataccatccaccatgctcttcaggtgcttgggtttcgccacacaaacattatggtgcttacatgctgttaactttcctttcgatccgatggcatgaaaaattcagcaccagtaatcggtggtaaacagcagtcacaccggcacaagacaggcaagatgaaactcaaaacaatcgccatcctcaatattaattaatttgttcatttccattctgcttgcattacaccataatatggaacaaaatgaacagaaaagtcattggtcagacactcagacctatagtacaattgttgcactcaagaaaacgcctaaaactgctaaccaattaaataagaagaataaaatataacgaactgaaattctacccgggagcgctgatgccttcatgccgctggttttcagacttcatgatgttaagggagcagaaggaaacatagagtagccttgtctgatctataaactgagtgctttggtactttttaattagggctgaaaacgatgcctataaatgtgagttgtgacccaagatatgagatatatagaaaaatattaatacctgaagacgccaactattggaagacccttttgcattgcaatgtcacgtctcattagtaagacagctcgagcaccatcacttacttggctagcgtttcctatgggttaaaacaaacactaatcttgagaggtgaatacaactaatcaacagttgtgcctaacaaactttcattacacattaccagcagtaggggtgccatctttagagaatgcatgtttgagttttgactggactgccaatgaagtgcctggtctagatatattgactcaggactaaagtgtcttcaaatattctcagtaatacgcccagccttcaaattcagtagttttatttatggtgtaacatatatgctaggagtaaaatttttcatggttaaatgcatggtaattgtaatgttaagttggagtggcaatgttgagatcagccaaatggggaaaatgaacatcagtacccttcattggccatttgacattgagaagaatatgtgcaaaatatctggtcatatcaatcacacaaggaaaacagaaataccatatactgctacagtggtcagtcattatatttgtgttagatgtatttttcactaaataactaaatattgcatcttagagatactgcttttgctattgatccgaccactattttgttaatttcattgcattttaggcatggtatctcaattagcagaaaaagaaagatgttataacgcatcaatgagatcttctagagatgatatgatttttaattttgtactgatcatcatcaacatataaaatatattccccatcagttaaaattttccagactgctctattgatagaaccgcttagcaatttttaaatggtacgatacatagcttgcgtacgtagttcatgcacaggtaagtccaggcaatatcaatcaaatgcgcacaggaccaaatcaaggaaatactaagccaaacatcatggtaaaggagccaagaataccttgagctagcaaggtccgagcttcccttcgtgcatccctggcggtggacagtaagccgaggtggacaggtgaaaaaacagccaggagtcccacaggtcaggtgacctctgaaggagacaagggatatgttgattgtttctattattcatatgacaaatgttgaaaaaattcactcaaaggtaatattctaaatttggaggtaccgatgcaagaaaaaccactacttatgtggcataaaataaatttgtagaagctagaaggttaatttcagagcgaacaagatccgttcttgtaaacttgtactgatgcagtgatataaactctacgtccaatcaataatttaagtaacatgatggagaccatgtagatatcactcaaaatacaagacaagtatttcacaatagacaatcatatgcagacattcacgcacgacccaatcatccttttctaactttgcacaacgatagaagaaatgaaaggttttaagccatgataaataatcaaagctgtagaagcttccgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcataagggtactataagtataagtatatacattcatatgggtactataagatgtaatttaaggcatatatgtacattttcataatatatttaagaactccaaggcaagcattccatcaagcaggtcacaagcagtggcgcgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgagtttgaatgcatttgtgcataccgggtcagcaagccagtgcatccggggcacgaagcccaccatggcagagagcgcactctgccacacggcgaaggcggcgtcggtggtgagcccctggatgggcctgaacctgttgttgaggctgtcctccgcgttgatcgcgaaccgcacccgcgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgtggcgtcgcccgcgtctcccgtcggccgtctcccccgccaaacgccgccgtcctcacgccacctgccgccgtcgcccgctccgtcagctcaccggtcagttccggtgatgacgggccggatccagccacggaagggccagatccggcggcggcggatccgcagccacgcgccgcgaggccttcgcggcgcgctgtgccgcctccttgcgccggagacgagccgccgtcgggggttttggccccgccgccgccatcccagcgtccgcgtggtttccggcggcggcgaggcggtgagaggaggggtgggtggcggcggccgggggctag

SEQ ID NO: 71832 - DNA, 11601 bp, Oryza sativa
gccctacagatagagcccgtcacaggtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatcattgtacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaagatgtatccatttatgtcatatccttgccaggtggtggcactccattcaggaccctgtgacaaccactaaagtgtttcactagacaacttaagctttctggccaaatggtacttcaagtagcactaccgtaccacacactaacaatactagccgtcaacccgtgcgttgcacgtgctctatctatataatataaataagtatggaagttttaatcagatgccgaaacgttgattatttatttttcaaaatatttctaaaaggcaattagcaggattgcccctacaactttaccttatttggatttttgattttcccacacaactctttaatagatagatagataataataaaaatatcaagtaatttaattatcttattgagaataattaaatttttttattagaacaataaaatcttagcccacgttgaacttcgtgtgtggcaggcaatgcttgcagtgcaagatttttgtaattattgaattgctaaagaagtcacccttttgattatctatttaaattagtaatacaaaggtttactggtgtcgtaattttagattttttttgattaagtaaattcaaactgtagaattaatcaatgcaaaagtactggggcatcaactgttctttgggtatataatctataatttcaaattttgaaaataataagtatcatgatgtacttgtctaaatatctattttgtacgtattttttttgttaatgtaatagttgtcaaaatttagaaaaaaactatattagtgagtcataactaatgtgacccatagttaacatgattatgttggtcgccaacctgtgcatcacatgtgctattatataattattataaatattaaaaagttaatatgctaaatgttacttttctaattatatctatttaaaccaaaaagggtccacatcaaggactgcatacaaattattaattttaaacttctgaattaaactaataaaatattataaaacaggagtcaacttcatatttatccattcaaattttggaattagcattttttaagaaaaaactgaaactaaagagtgtatgatatttattaattcaaattttggaatttttaggaaaaaaactgaaactaaggagtggatgatatttatgtaatattctattgctcaagaatatttcaattgaaacataatctgttgtgttttacttgaaattatacttacaatgaatagattaacaaaaactaattaatacaaccgagagttaaaatactaagttatttataattcatgcaaaatcttaaatcgagaattgatatttattaatatatgcatgtttgtaaataatgaaatctaattgaaactgcaatgaagttgtttttatatttgcatcatatgtgcaacaaagttgttctattttgtggatcaatacctaaattttatagtatcagacgttatgatggtgtggttgagttctgatctcatttcagatgagaaacatgtaaataaaacaaccaagatgaaaaaaaaagatcaactcaaaatctggatggagaaaatagtctgaacctacagagtctgaggttgtgtgtatccaattgacgtcgtcagttaagcagtgtatgcacacgccggcacgctgctgatcttcatgtgcaagacgaaggaggtcgatgtggcctccatcatgccgtactccagcgttgtgaagagtaggttattggctttgtctctgagtaatctgcgggcaaagattgatgaaaagtaaaatcgtaattacctgtggatgacacaatggatataagatcctcatagttaaaaattgccccataacatagattagttaaatttaataatatcttgaaaattgaacgtgaaccatatatatatgtcggtccaacgattaaattgcatcttgtctggcaaataaaattagtaatgaaataaccaagcaaaatggttgaagcgtagccaatcttttggaatgatacaaaaggagcagtacatcgtaaaaggtgtgggaaaaaaaagaactaaccttaaatgaatctgcatgatatgcatgataaagatagctataacaattatagtcattaaacttttgctctaagaaacatagcaaagtaattagcttggctaaaaacaataatatgtaactcaaagataaacatttgcatgtaccattgtttactggaaagtaatttgcaagtagcaaagtaattagctttcagttgaatctgatgcagatgccattgtcttgctgattggttacctctgcagatctatttaatatatacgtacgaaaaataatgatatatttgtaattaccggcacatgatgttcaaagagcagcttttctatttccatcactgttattttggctgcaagaagcaagatcatgttatcggtcaaatttgtgtacgcaaatataccgtgtggccacttgaaccaagcaatccgtattatgaattagtaacggcagaaaataaaatcaaacagtgcaagcagttatataatcccctctcctgttgtgctttctcttcataattgttctctctccttattgaggatctgcctgctcctgcagcagcgctgcatatatacacgcatgcgcttcttgttaaacacagataaagacggttagggaaataaaattagcattactttttacctaattttgaagcagaaagattgaagggcgatgtccatctcctcgcgtggaacgaagttgtcagtattctgggtttgatcggattaacgttgatggccagccggcgaatgcatctgcctggtttacgctctcgtcgttcccatctacgttccgctcgtataattgactggctattggagatgggatcgatggggtaggctactacggagagatatgatacagtgcgttacatgtaccgcaaggtggaagggctttaacgtgggccataacattaagtgtagagattggattttagatcaacggttacaatggtacgatatatctaaacaacggctagatctttctggttaacgtgagacctcgtagaaagtgcccaattagtataggtatagataattaagcttcctgatcacccaaattcacatctgactaaactgtctttcatctctagttggtgatttccttttcttttttcttgtaccatatcaccagctgtccatgcctcgcgggcgttggaggagcagcaagcaagaagaagtctggccgtgttctgtatgcatataactcagctgaatcattcaagtaaattgcatggagggagttgccatggatcagcatctctgtgttgcaagttgtaaacatctccggaaccttcgtgctcaaatttatcgatgttcgatatatacgttggtttcattaattggtatagtgggtatgttgaaattcaatggaactatcaactatggttgattatcaaccatgcaccgcaaatattataatgttgacctctctaagagcatccccagcgctcatccaaatatcatcctccatatacccatatggatggccatccaaaaaatattcctcattcatatctcttcccactctaacagatcatccatattacatcatctatatcacatcctcctatatgttactaatatctcccaactaaccttacacttgtatttttaagggatatattttgaacaactaaattttaacggtattatttatcacgataaaattttgaaatgagtaaattttaacgggtaattttttaattgatatatttgatttgggtgaatgatagcaagaaatatcataccaacacaaataaaataaacatactactactgtcttttctctcctcagtttttctactcttctcttcttctttacaggagtactactactcttttctcacagagaagagggcgaggggcgagcgaggagggggggggggcgactgaggggcggcagcggacgtgggcgaggaagggcgggcgggcgcgcgggcgagctggtgaggggtgggggaggggcggcggatggaggtaggcggcggtgggcaaggggagcggatggaggcaggcggcggcaggcaaggggagcagatggaggcaagcggcggcgggcagatgggcgaggtgcaggtagcggtgggcggacgggcgaggcgtgggcggcggggtcgccgggcagagggcggtggcgggtggacagacgaggcgcgggcggcggggtcacgggcacgggccgcggtgtcgcggcggaggaacgacaggcggcggcgggcgggcctctgcctctactccgaacctccaccgccagatccagtaggtctctcctctctacctccatgccttcacctctacccttgcacggcacccatggagcgacgcgatccggatggtggcgtgagtttatccagagacgggcagttgctggatggcatgaggagagagaaacgccaaatttggagccccctatggcgtatctgttggagcccccttttctctcctcatgcgctattttcaggatggagcatgtgatacaggaggtgctggggatgctctaacccgagtcaccacaagctactccctctgtctgtcgctttagggtttaaattttgttacaaaatacttgtcactttagagcaccttttgtaacatcaatcatttggaggcatgtcacaagggctttcgaccgaacctgccgaaaccacaaagaaccccacacccgcgaggcgccagttgaagcccaatgggttagcactcgggcgaaacacctaggcgaagtcgaaggacagcgtctagagggttcaccaccgagcctatgggactcatcgttggatcttcactttgggtgaagccatggggcgaagcaggaaagattcgcccgaagaggaatcatcttcgccaggaagcccaaaggacggaacgatccaggaaggctattcaccattagcgggctggcccaagaagcccatataggggcccatagctagggtagacactatatgcccttactaatgcccctatcataaaggtatccatataaattcctctgtatatatattaaaccctagaggatttgagcctgtactgagactataaatagccatctaggaccatgtaatgagggatcccaaaagtttttaccaattaatatattgtctttactacacatccaatcctctaagagtgccacgcctttcgacgtggcatggttgtcttcccgacaacaatttccaattcaaaattttctccatcctacccccaactaccttctcacttccatccgtacattattgaataaagggcattatgtttattcttcgtaaaccttaaattttgctaaacaacctgtacagaggtagtattagataagtgcaatccatacgcgcaatgtagccacccatcctcatcatgtatatgatgaaattagacctattttttgtatagtaattacaatgtcgaactaggaagaaaggagatgtttaataacaaatagcacacgccagtccactaccaaggcatgtaccgtttgatcatccgcttgttagcgatgacccaacgctcgtacaccaagagacccttctcatactatcttgcaaaaatctcaattatatatttcaagcgtatactcatgcacatctaacccataggacggttgttacctatgcaccttcatctcaattaatgacataaagtaatatggataatattctaaacatagtcaagggtactaacatcgttagagttgcaggagaaaaacaaaacatggatcatggtatgcccgtattaacggcaaaatttgttaatgttctttagtggattcagttttggaaagaggtcgatcaaccaatgaaagtttatcaataagagaccgagttcaaggaggaatcgtgaagaccacgtcatggcagtctaattctatctattaattaggcaagatttagtaactttccttttatctttaggaagtatttatctagtgtctgaacatgacttgtagttttccttttatcgttaggaaacttgtaccatgtccaatcaggactagtatcaacccgtgagtataaatatgtcaaccaaggtcattgtaatctatctccacatatcaatacatttacttccgatgcatctgttgatgaaaaatccgcgctcggccaatagtgccaggtctgtgttggcgcaaactaagtcaatgaacacaacgacctgggagaactgcttagctccaatgcaggtctaaatcttggtgagatgcgggcgtgccagttagtttgatcctgcaactgacaaggtataaaattgcagatcaatgagccaatcggctaataagtcgaaggagtaatttcatccgatgctgatgccagccgatagcaatagggttttgagcaatcggctaaatatccaacgtagaatctaacactcgacgtataaaggcgatcagctgatgataatatagtaataatataatctagtagaagtcaattagctaacaatgatatgatagaataagcactgatccgaatgttaaagaatacatcagctggagtcccaatgtcataaaatccacaagattagattaaacagtgaaatctttgttgcgatcggctaaatccaacttgtatgtaatccttataagctgatgcaacgtctagataactcatcggctgaaaccccgatgaaacccttattggcaatcaattagcaggctagagattatggttctaagctcgacttagtagatcaaacctaattgatgcaacactaagtatgaaaagaaacataatatctagacaacttagtagatcaagcccttgactgatttttagggtggtagatgccttagctaatctaatccagtaaaacaatttagtcgatatcagcagaaaccctaaagcgagagacaaccgatagagctaaattgagattctaagactagattaacaaagacatatgataaataggcaagcaaatatatcaaccaaaccagagcaatcctagaggtcgaatgtactgatgcagccttgaacgacactattgtagccagtacaattgcctgggccagcagaacattggacttaccccttcgccggagatcgaagacccatgcagccccgcgtcagttgccaagttcgccgtgataaataaaaagtagaaaaggtaaaaggtggcgatgcaccgatttgtattgatcgtgagatggtttacaatgacctcagatgtacatatttatacccatggggagatactagtccttacaggacactaaacacactttcctaaagataaaaggaaactaacgaactattcctcattaatacataacttgccatgccacatcctccttgaactcggtcacttctggataagcttcctttaatagagtaatttccttaaccgaataaagcaggaattcaactattagcggcatgataattctcatcagctaattctaggattctgaagccaatactgactctaggccgatgatatcttcggggcttaccaaatttcactgttaacagcactatcaccctcttttacaatgtttttactaccgacagaatttggcacctgaatcacctgaatcggggctacatcggcttcgatctccagcgaaggggtaagtcctaagttttgctggccctggcaattgtatcggtatattttgcctacatgatatttcaattgtatctctaattgcactatgtttagagatgaatcggtttacttaggactgtctcagttagatctgttattctgatttaggccctgtttgattcagcttagaattattataatctggattattaggagtaagctgaaacaaacaagtagattattatgctagattattataatctataagccagattactataatccaataatctcctctagaggagctttttccagattattgagtggctaaagacccactacccttagatgcctctaataatccagagaaacaatcaactcgtagcttattttatattagcttactataatccagcttagagtaatccgatttaataatgtagattacaataatcttaagctgaaacaaacatggccttagttgagatatctctacaatcacaatattgttttagataaatttgttatatccatcacattaaatagatttcattggctcattgaatattagattattatatacaaatcccatgctgcatcagttaggttcgagctgctaaattgtcattgataatctaagtcttgttaagccgataggtttcatgccagtgttttatcagagcgctagccgatatgttatctttgcatcggacttccagccaatgtatgttttaaccactgagcctacatttattattttgtatcaatattgaccggttgcttcattggacttatatttcatcatattatcaccgaccgattggattgtttgttcaaaccgattgttgaaaaccctatcgacatcggcttgttagcccatcggctttttgatcgtcaacatatttatctatcttgtcagtgcaagatcaaattgattgacatgcccacatcttatcaagatttaggacctgcactaaagttaagcagatctcccatgccttcgtgtttttcgcgtcaatagcctgtccaaccctcgtacatgcaactgactagttataatcatcatgaaaattggtgtcactctgcacattaaagtattcatcacctacatcaaattctaaatgcaactaccattaatacaaagcaagagttagtaaaaaaaaatggaaatgcaagacctaaatacatgcaagctgagattaggagggccatttgtggtcacaattttcagcgtaaagcaaattttgctgtggtatatttttaaacctttaaagtaagtacaagtaaattattgtagaaacatcatcatgcttgctgccctccacggcaggaagccaccacatgtcagccactaaacccttcatttgtaacccctccaggaaggtactgctatgaaaaaaaatgccggctccatgtacgtagcacgtggtgtcagtataccttgcatccgcagctagggtacattgcggtagtgcatgtggatgacctagtcatcaagaccagggagaaccagcccacaatgatcaatgaccaggaggaaacatatccagaaaaatgtgcatttggggttctagcaggatagccgactgggctagatttggaccacggctacgcagcctctagaattagtgcctttgccttgtttcaatgcacttcgccatggttcgcttggcttagcccttcaccgtgcttcgccaagcttcatcgtgcttcattcagcttcaccttaattattttttcacgattcgcatggcattgctgttacttgctttggctgacctacctccaacagcaaccacctgcacggctaaagggggtgcaacatttggctagttgcatggttgtggcggaagggtgtttcatctcctcgataggagagaaggaactacctatattcaagtggacccaagagactgaggccgccctccagattcaaaaatgtacctctccatgtccctggttttgactgtgcctagacccatggagtccttcttgccgtatgtcactgctatccaactgatcgtcagcacgatgctcatggttgagcatgacaaaggagaagtgaccgtctacttcgccaacaggtgctccaaggtgcccagacacgctaaaagggattatgcacaacctggaagccattggatgggcaaccaagtgggcgattgagctcgatgaagttgccctctaccttgttccttgcattgccctcaaaagccaatctgaagtcccaaaatccacatatgatcatccaatattatgatcacgcacatatggacatacataataaatttaaattgatgtactcaactttccatgccgaagggccaaaactctactaaaactttctcaattcaagatccaaataaaaaaccaaataaacaccataggataaggtcaagggtggacaagatgtataaaagtcagtaccattgaaatatatgttattcaccttctagggtttcctcatagtactgttcttctatattattacttatgcaagagtgagtacttatgtgcgtaattttacggtccatgaggaggtacgaaagataccatattttatagtgtaaaatttgttatgtctttacgagaaaaattagaggtagtatgcacctctaccataaaacttgctcgatcgcaatatccggttcttgtgcaagatataaagaataatatttatagttgagatgcccactagtttaccagcaagcattcaattccaatactcttgttccctaaaaaaaaattccaatactgttgaataaagcaactgatatatctagggaacatatcctgggtatataacttttacgtgcacactccatacacactaattaactaatgtcacaaaaaaatctaaaaaaacattgtgtagacattttgaaaaggatcacacctacttgtaaaattttagccgtaacaaaaaaaaaactgatagttttgagactataaatctattagaattttgtcttttatacataatgaatttgaggatgaaactttacaaatgtgatactattgaaagtacatgtgaatgtttactactccctctatattttaatgcacgacgccgttgactttttgtccaacgtttgaccattcatcttattaaaaaaaatatgtaactatcaattattttgtggtgacttgattcgtcatcaaatgttctttaagcatgacataaatattttgatatttgcagaaaaattttgaataaaacgaat

SEQ ID NO: 71833 - DNA, 5297 bp, Oryza sativa
cgcttggcattgcttagctccatgtattgcttatgtagctctcggcaagcaatacccatcacagctaacacattgtcctccaccaatggcatgcctagctcaaattgggctggcgccctcacgaccttccccgatttgctcaccagcatcgacgtcgcagccttgcccctttttggctccggcgccaactccccgaccttccccttgccgtgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagactaggggccggcacctctgtggatgcacaactactcctatgctgtgagggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttctagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttgagtagtgaactcaccagttcctgatagacgacggcatcacttttgttcttaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggtcatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctggtgttggggagggcgggtttgcgccgagcgttgacatggtttaactttcgcgaaaaagattataaatttcctaccattagactaaatagcattagagccaatgtaatacggggtaaactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacaaaatttgcatgattgacataaaacagcagcaggaggagtatatatgccacaggggtagcaatagcaggggcaaattaactaaaacaacatgtctagatatactcctcttatcaatccagaagaaaagagcaagtgcagaaaatctgttcttatgcataaaaacagagcaagtgcacaaaatctgttcttatgcataaaaaaagaacaagtgtagaggtatataaccactctacactggccatttaataaggaacaagtgaacaagtgtaggggcaaaaaaatgaacaagtgtagataatctgttcttattgagcaattcatcactggctatttaataaggaacacattgggcagcagcagcaagggtatataaatcatcaaagaatgacagaaaacaaaatgcatggagaactttggtgtctaggtcggttccgtccatggactacactgacctatcctttttcggctaaatgtaaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacgaggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctattcttatccataaagaacaagagtagaggtatataaccactgagtcaatcatgcaaatttaaaaaacagcccacaataagggtacagataaactgttcttattgagcaattcattacttattgagccacaacaggggcaaaaagaagaatagataaaaaaatgaacaagtgtagataatctgttcttattgagcaattcatcactggccatttaacaaggaacacattgggtagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtgtaaataataaaacagcccacaatcatttatgtggcagcagcagcaagggtatataaatcatgtatataaacaacaattcatgcaattgacctattcatagacaaaaagggtatataaatcaacaagtttagataatctgcaaagttccttaatcatcaaataatgacagaaaacaaaatgcatggagaattttggtgtctaggtcggttccgtccatggactacactggcctatccaccaaaattccccatgcattttgtattttgtgatggtttgataacccctaactagctagcttaataaactatttctagctagctaccctacctacctagaaacactattgccaatctatcaatccatcctttttcagctaaatgtaaacatgatctacaaaattttaactggctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaattattcatagacaacacgggtatataaatcaataagtgtagataatctattcttatccataaagaaaagaacatccactgctgcaaaattcatgctaagatcctctattgatgctaagattcactgcaccaaaatcatgtatataaaatctagcctctacattcatccaaaacatccacagacaacaaatcacatttaattcatctatacagcagcaccaacaatcgaaacaacaaatcacatttcattcatctaaacaatgcaattcatccatcgaaaaaaggaggaatgggggagggtggcggcgtacttggagaagcggcgtacttggagacggcggcgcaggccgtagttgtcctggatcctggtggcggcggcggagaggcagcggcgaagaggtcgaggcggtcgacggtggtcggggatcccggcgtcggggaggtcggggaagtcgatggacggacggcggagaggacgatcggcggcgagggcggcggtggagagggcgacggaaagggcggagatggcggcagagagggcggtggagatggcggcggagagggcggcggagaggttgaggcggtgacggtggagatggtggtggagaggacggcagcggtcgagagagtgagtgaggaggcggtggtgaagagggaggcggcgatggcggtgaagagggcgaagatggcggcagatagggcggcagagatggcggaggagagggtggcggagaggttgaggcggcgatggtggagatggcggcagagaggacggcggcggtcaagagagtggcggcgagaaggcggtggagaggtcgaggcggcggtggagagggcggcggcgaggagggcggtggagaggtcgaggcggcggtggagagggcggcggtggggagggcggcggagatggtggagagggcggcggtgaagaggtcgacgcggcggtgga

SEQ ID NO: 71834 - DNA, 11168 bp, Oryza sativa
ggccccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgtggggttggctaatgaacttgccacccgcgtcggtccactcttggaaggatttgtgccagcagttcaccatgaacttccagggcatatatccgcgcccaggcgaagaagcggacttgcatgcggtacagcgaagggacgatgagtctcttcactcgtacattcagcggttctgtcaagtccgcaacaccataccgtgcatccccgcacacggggtgatctacgcgttcagggggggcgtacggcgcaaccgcatgctcgagaagatcgcctccaaggagccccagaccaccgcgcagctttttgagctcgcggaccgtgtggctcaaaaggaggaggcctggacctggaactcctccgattctggtgtggcagcttcggccgcccccgggtccgccgctcggtcagggcggcgggacaggaggaggaagaaggggtcggcccgttccgacgacgagggtcacgtcctcgccgtcgagggcgcttcgcgggccccccgaaaggggaggcctgtgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaagcaggagcgctgtgagggcaaaaccccggcggctcccaccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggacatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctaccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacggctcgtccaagaccacacgaatcggtggtcttctggacgacaaataggaagacgcgctcgtctccttcctgcgggcaaacgccgacgtcttcgcctggagaccggcagacatgccaggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtgaagacgcgcaaccaagagaccttactctcggatctagcggaaactttcggaagtctccgctccacccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcggagctggccctccgcctgcttgtccgacggtgccaggcgcccccgacccccaggatggccccggggccactgcgggaaggctgcgcctgtcgccctctgaccccgaggtcatcggcacagaagccgagtgcgccccgcgtggcctctcggacgaagagcgccctggagatgcggcccctggcgaagaggattggccccgccgaaaggtgcagcggcccgtatacttcgttagcgaggccctccgggacgccaagacccgataccctcaggcccagaagatgctttacgctattctgatggcttcgaggaagttgcgccattatttccaggcccatcgggtcacggtggttacgtcttacctcctcggccaaatcttgcataaccgagaaggtactggacgggtggtgagatgggcaatcgaactctctgaattcgatttgcgctttgaaccacgccacgcgatcaagagctaggccctcgccgactttgtggcggagtggaccccagctcccgagcccgtctccgcccccgaggccagctcgggcccctcgcagctgcctcacaccgcctactgggtgatacagttcgacggttccctgtctcttcagggcgccggtgcgggggtcacgttgacctcgccgagcggagacgtcctcagatacctggtccgcctcgattttcgggcgaccaacaatatggcagagtacgagggactccttgcggggctcagagtggcagctggactggggatccgccgcctcctggtgttaggcgactcccagttagtcgttaaccaggtctgtaaggagtaccagtgctctgacccgcagatggacgcttacgtgcgccaggtgcggcatatggagcgccatttcgacgggatagagcttcggcacgtgcccagacgggataacgcggtcgccgacgaactctcaaggctcgcttcctcgcgagcccagaccccaccgggcgcctttgaggaaaggcttgcccagccgtcggcgcgacccgaccccctaggggagacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgtatcattacggataatggcacccagttcactagtgagctcttcggtgactactgcgaagacatgggcatcaagctctgcttcgcctaccccgcccaccctagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggtggtcctcccatctgagctcaccctgaggtcccctcgggtcaccatgtattgcgaggctgatcaagatcagcttcaccgagacgacctcgactatttggaagagcgaaggcggcgcgcggcgcgcgctaccagcagagcctgcggcgctaccatcagtgccacgtccgggcccgatcactctgcgtcgacgacctcgtcctacgccgcgtccaaacgcgtgccggactgagcaagctctcaccaatgtgggagggtccgtatcgagtgatcggcgtcccccggccgggctccattcggctggccacgggcgacggcacagagctgcctaacccgtgaaacatcgaacaccttcgtcgcttctacccctagtgggggtcgggtgtcatgtctcgggctcgggccaaccccgcacccccccgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaatggggcccagaaccgagccgtttcccggggcgtggtgaactccgggggggaatcggcaaaggcccacaatcgggtcatccataaccctcggtcaccgctctcccggcctggccagtctcgacacgtggatctccccaggcactagccccgacccgcgccgtttgaggctgggacctgggcactagcccttgttcaagccaagacacagaaggaccgcggcacagaccatcctcgtcttatacacacaacaaacagaactgacgcagaaatttcctctttacttgattgcagattaaatcagtctatacaaaaagggggcccgaaggcctcggaagaagaaggaaaagttattaagattggcggggccttgggggctcactccgacgcgcccgggtcgccggcctcgtcgtcgctgtcgtccgcactgtcgtcaccgccctcctcgtcgaagtcgagggcgaacgcgagccgaggggccgtaccctcaaagctgtggacgatgtggtcggcggaatcccggacctgcgcgcgcgcgccgtcctcggttccgggagggaaatcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggtgtacttcgcgtaccgcccgccccagaggcccgcctgctgcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgttcgccagtcgctgcgccgcgggctcggcctcttcgagagttcgcccccgctcggtgagcgcgtcctcgcggaggcggagtgcggactcctctttagcgcaggcggcctcgcggtccgccaggtttctctccttcgcgtccagggcgcgggcgcgctcctccagcgctgtggcgcgagcctcaagggcctcttcgcgctgccgggacgccgccttgttctccgccgcccgccgttcccgggcagcggcggcgtcaaggactccccgggcagcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgtgcgcccacgccgcgtcgagctccgcccgctccgcatgcagggcctccatctgggcacttaacccgtccagcaccgtgctgttcgcggcggccaaggcctgcaggaggggctccgcgctcagtggggcagcggaaggcagaggggagagccgcctcagtgtgggtgccgcgcggctcggcccgccgatcgacgtgccggactcgggggcgtcccccgaacctggctcgtcccaagcgtcgcccgaggggtcgggcccgagcggcgcgcccgcggcctcgtcgtgggtggcctcggaagtcggcgtcgcctcgggcggagtcgggtcgggggtttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggctggacttggaatggcggggagggcgcgacgggatctcgcttaggcagaagaaaaaccagaagacaaaaagaaacgggtgagtgaaaactcgccttgaaaactcgcggtgggcgcggggacgaacctgcggggatgtcggctaaacgaccacctcgggggcgagatgaggctctcccggcatggctcggtccccccatcttgcggagccgtttcttctttcgctccccctcgggctgcggcgtcgacacagcaccctccgggcgcctgctgctggcacgcaccgccccgccccctcggggaggagatgggggaggggtaccctcctgcttcctcttcccccgggcgtcggtagggcggatacccccgggcccccgtcgcggggcccagaagcacgaccccctcccggggtagattgttccctcctgcggctcccgcccgcgccatcgtggcctcggggggcccgctcccccgacgccccgaccacctacatgatggccaggatcttggcgcgctctggatcgcagcagatggggaggaccccttgggggatgagggatgcctccacggagctgagattcagcacccgttggaccaccatcctgaagtcctcagggtccaagtcccatttgcgcccctggtgggtcctcacgtagtcctcgggcccggtgtacacccaggcgccccgggcgcgccgctggagcagcgcgatccggcgatgaaggtagtcaccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcatcccactttttgcggaggacgcagagaatgtagcggttcagcacctgcccccgcggctggaagtagcagccaccgactaccgtcggcggcgacaccggctgtacggtgaagaaccaccggaacagccggagagatgggcgcaccccaataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggtgtcgggcgtccctcgcccagcgcgaccacctcccggccggtggcggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaaccgcatttataacaggttggacgagcgcgccacgccgcatttaatgcgacgcagcgcacgcttatccggtccgtgaccagtcgcggtgtgtgaccggtcacagaccggtcagatcacgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaactctggctcgctctccagctctctgtattccttcacgcacagatccactagaacacaggagtagggtgttacacttcccagcggcccgaacctatctacgtcgcccgtgtcttgtgcacttcctctctcgcggacgttcctcagatcgagggcaaagaacctcacttagcgcccccggccgaaccggcaaaggggggcctgcgcggtctcccggtgaggagccccacgctccgtcatctggcgcgccaggtagggggcgcgcgtgtctttttaagccctcgtcctctttcgtgtgcaccaagcttctcccgctcagcctaatggccgaacgggcagtggcgcacagcctctctccgaacgctagcggtgacgacggggagcagaacccgcgccgtcgggctcgcaccccaccgtccccctctcactgaaatcttgggcggggggaggcgctcggggaggtcgaaggaaccgcgacttcaccgcccgcgggcgacgggggaggacggcgagacggggcgtgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatggcggcgcagcagcgcctaggcgccggcgggcggtcctccgccaccgaggcctctggcgctgccgccgccggctccatgtcgtcgaggcggagggcgcggcg

SEQ ID NO: 71835 - DNA, 545 bp, Oryza sativa
aacagtactagaattgtttccaagaccaaaccaaacaaggaaatggatatgattcttgatgctgaaaaggaaattgccgggctcttttcgttgacagaacagctcattaccgaggctggaatagatgttgcatcaccaagcatagcttcagaacccagaaatgtatatcatattgcagttttgcaacatttagatagttgctgtgaagattcagctgaaattgttagcgttttcatttcttttgctttgggtctcatcgccctgtttgctgttggattgctctgctccaagtgcgaaagggagacatcgatgttgatatgcctcttactgtttacatgatatattgcatctgctgaaatcctagaaaaaaaatgataaatttgtgatccaaaaccccttctctagtcagccagtggcggatttgctgacaacctaggcagctgcctgtaattcatattctccaaaactccttcagaccggagttaatgaagatatccaaagcctgtaaaattgttgctgattttggagaggtgagaaatagtgaa

SEQ ID NO: 71836 - DNA, 3947 bp, Oryza sativa
cgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgagatggagaaggaagacctgccaaagttgtttagttgccctacatggcctagcacctgcctagtggataccttcgctgcatcggccgttgaggcatcatcttcaacaccaccggcgaagctgagaagtagtgagaacactgcatgggttgcatgcagggcagcggtgtcaggccattgttgggggtagagaggaatccagaagaagggtcctccatggaagatgctgtgcttggtttcatttatagagagtacacgaggtttctttcacaaagtggaagcttaggtggtggagtgccttttcgcagaccgaaatgaggtatcttccttagcatattccttagcatgtggaaacttctttttctgttctatgcttttgatttgctttggagtttttcaaagtatattccatgcttttgtgtgctttttggggcctataggtttatgaacaataatttagatgatgaatacactctagatgtattggagtaccttgacgaagcatgggctggaaagttggttttggtggtgatcacccggagcagatcttgcgtcatggacctacttagcaggtgcagtttggctggtcttgcattgtgcctgtcagattagtgctgtacttgatgcattgttgtcgtttatacatgaaaccaaatgaaatacaagaaccatatgtagattgcagaacaaattattttccttctaaagagggtgagatcttagtagaactttattgcttgtggtgccctgctgtttgacaatgtaattggtgcgagacactggcatatgatctggcctgagccttgtgtatgatgttatcagactggactaggccaggtgggccttatgcctgctttggtcttcatgccaataaacagagggagggcccaaaataagtcctttaacaggacactgatgttcatgttccaatgtatacttacggagttgtggacttgtggttataacttataagttgcaagggacagatattgcccaatacatttcatgagaaaaatctcgctatgcttttgcatctttgcacgctcatttggtgcatacggaggattggcctaaggctgtaaaataacaacaataataataaagctcaaggcttgcgagttgctcgagctcttaacgaaccgagctcgagcccaaccccaagctcgcaaaatttgttgagctgagctgaaagcatctaatgagtctggttatatgggctggtacattctaaattgtttttttactacgaaattatcatcaaatatatgttatcacgtacttaagccaagcccgcctgaaagcataaaggtggaataagcttggctcaacctctagcataaggcagccttacgctctggcttgcttgagctcggctcgttgacagccctaaattaaggcgtgtgaacctctgtcaactaatggcaggcacatggtggtggttcttaaaaaaaaatcttcgtttcaaaattcacattgaagttactaggttggtcacaatcaatttgatgcaaagcggatcaattactaaattaattgataataaggctaatttccccatctaactcagatactatattacgttgcaggcaccgctaattaacccaaaattaaaaagagtaaatttcacaaaactaaatatactttgactaaacgatcacaaaactatggatttaagacattactagtaatcgtgcacgtgcaatgcacatattaacaaatattatatgaatatgaaccattttgataagcatatcacattcaaacgattggcaatagaccaaggctacataaacccaagaaacatgtttttttttctttaagacattgtagttctgcttttatttttatatagcaaggacatattactatataaaaaagagaagaataaacgttgttccgcttgtcatagcatgttgactgtagcatccaggtgaatcctttggcgtggcagcataaagatttattttagttgtttattttggcaacttaaaatttacataaaacttaatctgagacgcatcccatctaaagaaaaccaagagataaatctttgagactatagaattgattcattcactatatgtaaatcaatctctcttgcagtgtttgtggcaaaagatgagcgatgcaatcttgatcgtttgacatagtttattctctttccatcgtttgtacacgcttgttttttggtctcctacacatcaaaagaagaaaacacaaaagaggtaagcaaatgacaatacatgctttactgaagatactggcaacagaatgctatatgaatgctacttattgcagtttcatgcaagaactactaatggaaggatgtgcatccagtaaaaataaactcaatggagcagaccatgaacatgattacatgaatggagtcagaggtggagacaccatcttttgcatccccttcactgtgtagaacttgttatcagtaatcaagttttagctaaaaggaagtcagtatagatcaaaatccaagcaattgaaatatatccaatctgatgcagagaagtggagaaccaacctcgtgcaatcgctgagcactgctacacacctatgaattcctacttcaataggaaagaccataaacatagtagagctacctgttttccttcaattcaagaatttttggtttcattaatcgaaacaaaaagaagaaccgaaaaaattgcaaggagaggaactaaagattttctttagtacaagagccttcatcctcgggatgttgctttcaaaataaaagatatagagcagtgcaaagaaatatttttcacaggttaaatcgcaaaccaaatttcagtacagccgaaaaaaaatagatactccaatcatgcacagacatgaaaaaaaacatatttcaacaattagagcccatttcaaaagaagcggtttcagttctcacaaatatgacatgcaatttgttaatcttaatactggtgggctgaccatatcaaggctaacatggaaataaagcacatcagttgaacttcagattcggtagtggtagaaaattggcatatttagccattttattatagtagtagttttttgagcaggggctgcaggaat

SEQ ID NO: 71837 - DNA, 2260 bp, Oryza sativa
cctccccctccccctctccctcctcctcccacggtggcgggcagggatggcaccctcccctccaccggatctagcaggaggggaggcaacggcagcccagcgtccctgcaacgacgacgacgacggtggcacccttcctttccggcgtcggcgtttttgtgcttgtgatgttcttgtgttatcgttgttgttgatgaaatatgttcttgtgatcttttagtagtgttttctctaggattttgtgatgattccgatttgtatttggattgggattgggattgagattgagattgagattttgtttttgggttggattggatgtgggatgtgggatttggagaggaggtgtgccatgaatcggatgaggaaaaattagtccgtaaaacgcgatgaggaaagcgcgatgaaggacatatgtgacgaccgaaaaaatccgaatatatatatatatatatatatatatatatatatatatatatatatatataaccacaacacaaatgggcttgtcatattcctggtgccttccaaccctaagaccctattgatgctttacatcggcaataatttatagggctacgcacgaagtctaaaagtggatggatgtacatagacaagtgtttgagacaggttcaaattctgtcaatgagagataccctacttttgtttaggctgggataacgagagatacccaacggtggttatgagagctttcttagagtgtccaattaatataggtgtccaattaacgagagataccctacttttgtttgtttaaagtctattagcaaaatgctcgtgcattgatccgggtaatggtgggtggctgaagtttgatttcaattatttattgaaacaccatgccccaagcatgatcataagcatcgatgatgtgtataatgacaaaaagtcaagtttgttctcgaacaattaatttgctttacgttttacgggatatggatgatgctcatgacacgaagccgatggttgtagcatatgagaggaacaaatgggtgcacaatgcgattgcttttgttaaggagacgacagatggaaatatgtgtgatgaacgaaaaaatcaatattttcttaaagtagataaatataacaaaaaataagaggaattgacgttgctacatgatgaaagtgcccgagattgaactgatcgacacatctaaatcgtggcacaacgaaattatattttcttatattctgtgcatggtggtcgtcattggttggtcaaatctgattataagccataacgactcattagcgaccaaaatatattttgcggataaaaattttatatacatgtaaaagtcaatgctgaacaacaaactacattaagaaaacttcaaacttatgttttaaaaataaattaaaattcaaaattatatacgggcaaatacgattttttttcatttatattcctagcaatatatatgtgtagtcgttggcttcattaattcaatattcatgtacacccgagtgtacatgaaactacagggtcgcacgcttaatgggccagaataagaggattggatggagatccaatatgagcttaattctaatagggatccgaataggagtcctatgggccttggaggtccaaggatcctatatattcgcgcggagtgtgaccggcggtgagattgcatcacatgagaaaccctagccgccactcccctcctcgagcaaaatcctagcagcgcatagacgctagcacgtctgcgcgtggcgttccatccctgtacgtttggataccgatagaggtgccgctagtttgcggtgttgatcggtgtgggagcactgcgaggagaacgcatgaggaggagaatgtcgagctgttgcgatcaactacttcctctacaccgacgtgagctacgtccacaacgttccttcggctacttagcacttactttcgctgcacagcgcgtcgagtggtaacgatttatgatctaatacttgcatagttcctgatttacatagtagaaaattttttatttatgctatcatagcctatgcgtatcctaacagccaccgcgccctcactacagcatgacacaaaatccccaacggaaaaatcggttggcaaagaccacattcatatacaatttgtcgatcatccaaagttttcctgaccaacttcaacagtcacaagaaatctagtcagcaaagagatttcccgaccaacatatttttaccgaccgaccatcagaccccaatgatagagatttgccgacaaacattattttttctg

SEQ ID NO: 71838 - DNA, 651 bp, Oryza sativa
ctgccgccgccgggccttgtcgtcctcgtcgtcgtcggcggcggcggcggcgtcggcctcctgatccggcgcgacgaacagcacgacggggccgagggggacgtcgtcggtggcgacgagcagcggctcgagcgcgtcgacgacggcggacatgtcggggcggttcttggggctcccgctgaggcaccggtaggcgacggcggccgcctccctcgccgccgccggcgagtagcgcccctccagcgccgggtccatgatccggatgagccggagcgggtcgcgcaggcacggccgcgcgtactccacgaggctctgctccctgttcggccgcgtcttgtcgacggcgcgccgccccgtcaggatctccaggagcaccacgccgaagctgtacacgtcgctcttcgccgtcaggtggccggtcatgatgtactccggcgcggcgtagccatgggtgcccatcacgcgcgtcgacacgtgggtgtcgtccccctccggcccgtccttggccagcccgaagtccgacagcttcgccttgtaatcctggagggagggacaaaattcacaggcccaaaaaccattagcccatttgatgcgattctcttacttgggcttattactaatgaatgggctttaaagtgggggaaattcaag

SEQ ID NO: 71839 - DNA, 2281 bp, Oryza sativa
tgagtgcagtgtttttatccatttctgtgcgtgtacgatgtcgctatgaagcttcctcgagagtaaaaatatggtattcgtgaggcgtatgtacaggaatctcaggaccgagctcgccatttttattggggtagtgctccgctcatgaatcattctgacattatcagcagagaaccacgtgcaaaccgaagagagaatccaccagcagaatcaatcacataatactactaaccagatcaatcgcaaaaaaactgaaacatgcaagtacggatgccctgactaatcatgaagtttttctaataacacttgcaagaaatttcctcgtaatcctttgtccctgcacaatactatggctctagttgtgtacagatagtgctgttactacccacaaacaattgctaagaaattagtatcagttagctgtttcaataatttttccgatggttcgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgtaaatacaaattatatatatatatatatatatatatatatatatatatatatatatatatatatatatatatatatatatatatatatatatatatatattcttagcgatctacaaataaatgctgaaaaataaattcgataaaaaaaacctcaaaatcaacttcaaatttaaagttaaaaatttaaattttgactgataagcataagcataagtgaaaagattaggccctgaaaaaaggaccggaatgaagatgttagaattttttttattttaaaatttttattttttaatatgtacagaaatattatatcatccaaaatatttacaggaatgg

SEQ ID NO: 71840 - DNA, 680 bp, Oryza sativa
gagattcatgtttcagatacagaaaatgcttgagcttatggggtggttttccatagattgttcagtggctctgtgacctaatcagtttctagttgcacatgataactgaaaaaaaatacagcatgctatttgcatttgttgtagtcattcacaaaaaaacacgactaacttgtgttatgatgaaaagagctatttaatgaactgcaaaaaattcctagaataccttgtgtgcaaagaattgtccagctggatcacatgtgaagagctcgggggttcctttctcttcatcaattccaaagatcatagaaactgcagaggaaaatgtgtaggatcaaagtaatcattgtaatcctttgatggtagacgatgatggcaggtttcaccactcacaaaacacaaattggatagcactaaccaactccataaggtcttatctgagcatgctgggtgcggatctgtgctctgtctgcaatcctacaaacaagcaatgatacaccactagtaaaatgcagaacagttcagtgaaattagtaaacaacgttaggctattgaagattgaacagagtaatgtatccacgtagcttaacaaaataagggtaggtttgatagtaaagcacgagcatatgcttatcagaattcagaaaagttcccagcccgttgatctcatatgaactctcacc

SEQ ID NO: 71841 - DNA, 2279 bp, Oryza sativa
tccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagctcacgttctgagctttaccgaggaattcaaacttacatgtttaaacttttggaacttgcgaagattattattgtggtgggcacacctaacttcagatgcaactccgcaattacgcttgtaacagaattcagaattgagaaagaagagagaaagatgagtttggtgatgcagtccaggtcttggcggcaaattaaacgatttgaccggttatcagtggggcgaaatggctaggtgtgtgcattttgtttggctgactgggcccatccaatattccaatgattcagttaatgcctttctctgcacactacttaacgcattctacgcttttaattgttgcaccgcctgttcataggtgagaacagcagatgccactacgagaacatgtcttcaatgcaactactcccccgtcacaaactactaattgccaatagtcaaattaagttttgatagtttgactaaaagatttccaaaattataagaaatcatagtgcctaaacttgataaatagtagtagaagggatcagctgaactagatgaactcccaagatcggtcaaatggtcaacacacacgcatgtcttaggctggtagcctggggcgttctctctctcaaaaaaaaaaaagagagaaggtattgagctgaacctcaaaagctaatttttgcagcacatatagatatagaacgaccactatcatgcatgactcatgcgtgcaaagagttctagttacacctaccatttgttcctgaatcctgcatattttgtcaacacaaacatcacgagtagtgagtaccatgttctaacca

SEQ ID NO: 71842 - DNA, 552 bp, Oryza sativa
catctctctcacatcatgataaattcatgccattcgaatcagaaacaacaaacctttcatacatcacatctgtcgagtaggaaatgtccatctgatctccatggctccaggtgaagaaacagtaagggcaaggtgaagtctgaaagttcagaacaacatggccatttcttcgacaggtgagcagtgagctaggaacagaaagtgaccaagatattacaatatctcagagcacgcaagatgtggttattaataaccagcttaattacctttgacacgtcgttctacagcccatgtttatctgctagagatcactggtcttaagctaggtttaattattcttaccatatttctcttcaaagtgtaatattccaatggagcatgtaaagctagctgggctctgacgtacatctgtgtgttgattgtgttgactggttaattagcagttaataaagtaaagaaaaagagctagtactattagtgtgcaaggaaaacgaacgatcgagatggcactgataggatagataagtacgcagtgattgaaaggttggagac

SEQ ID NO: 71843 - DNA, 1578 bp, Oryza sativa
atatatgtaccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggtggcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatactgcacatatgctgcgcgtatgactatatatatagagagagttagaaagaccaaatggcagcaaagctgaacttgtggtttggtgcacacgtaggaaatggatcgagctagcacgacgaacaacggcccggcttgcttctagatgtggatgtgtgtgtacttttctaaccatttgaccacgagagagcatgatcagattaattagttcctccc

SEQ ID NO: 71844 - DNA, 25267 bp, Oryza sativa
  unsure (1)..(25267): unsure at all n locations
agaaaagatcagcaaggtatgtattgacatttcatcaggatatattgtaacatcctcttcgcctcttcgctcctagagctgctacctgcacttatattgtgatattattcttactatcttacacacggtgaactcatgacctttaccaggccgatcttgaggaagtcagtggtctgtacttggatgctaaatcgtcggcgcgtctccttcaggagcagcaggaaagatacatcacctaagatctcttgctgtacgacgatgtatttgtccttagtcattccgctggatctctgataacttggtactaaagtgcgaagacttctttagggcactggattgatttatgcggaaatgtagaatccgaactctgtactcccgccaacctctagaggaaaacttgatttcggcatattgcttgttcacattactccttgctgagtagattgcatatgaattatcgtgtattttggtttcccatgctaattagttccagattccgtttgtcatctgtcgatttttttcattaaccagctgcttatcatcttattctttgaaatgtggttggtattatactccctatttgattgggtttatccaaaatttttccgcggcgatgcgaaggcatctttgcgcctcatctgcgttgaggttttgaggacgtgttttatgcagaggggcacatcggtgcgtccgttccagcgtcgctgtttgctggcccctgctttttcttccgtataataatgacatttccatgtcgattcttgatcattcctacattcattgaatcgtagagcgaaatgccctgaaatttgtcaatagacgatatagatatattttgctaatttctgaccatcactataccgctagagattactaggcagcactcggctactggaggcttagcctcacgtattgccgtggttcagtcagatcacggcgaaaacaacgtcgtcgaagccccaagagggaaatgacgcacgccatgacaccaattcaccctgcaacgcgacaccctgcccgatcggcatcacacaggctgcacacgtacgccttgttgctcgcgcacggccctgccaaaattaacttttgtggtcatcaggtcaagtggttgctcatcaacgccaaaattccggcagaaacgtacctgcgacgttccaggtgcactgcacctcgctggcagtcgcagcattgcactcgagaccgcgaggcgcgcgtcttagctggtgaatccatcgagaacctgtgatccacatttgatcggtttttgcgagctgtgatgctcgccatcttccgttgtggatagggggagctcgaaatatctcacacagtaggtgacaagtcctctttgctctttagtcgccgtcgatatatatttttctcgccgcggcgacacattttatgtggcgttccgtcgagcatagtagatgggccatgctttgcatgatttggccatttgtagcttttcgtgtcacggattcgatgattattgcatctgcgcccggtgatcgaggaagctagggaggttggtctcttttgtctttagtttttctgatcgatggggaatcgaagagagaggtactatccaaattcattttttacctgtttcatataaccaatataaaaccaaaatattacaatacctctactttatcaaatctcaatacaattattcttcactttatttattcacaatacaattattttctactttcacaaactccgatgcaatgattactttaaaaataaatttattttgaaataaacgaaaggagttaattttactatggaacagaggaaatatttcgctattggtccgtttgatactccctccgtctcattttaagtgcaaccatcagtttttgcacccaacttttattgttcattttgtttaattttttataattaatatttttattattatgagatgataaaacataaatagtacttttctcgtgacttatatttttaattttttaaaaaaagtttcgaataagacggacgatcaaaattgggctcggaaaattatggctgaatcaagacagacaaaacgggtaccaatttgatcgcaccgtgccggtacactgtatcggtatgggcgtgggccgccggatggccggccgatcaattcgtactacgatgcaatttgggcagccaatggatggaggacacgtggctcacgatctcactgacaagctagatgaagactagcacgcacggctgacctggcgcactcccatattccgggagcagcttaaccttaaatctcggccacatttggcccaaattttccggagagttgtataatcaaatcgtggacaattaattatcaacagtgcgtgctacagtgtttatatgtgtgtgctcgatttgcacctcatatatactacatattactattatagatatcgatgcatagtggcatacgctacagtagtacagtgtatgatgtgatgagtatttgtgatttttatatagatttactgaatgttacggtattgccatcttcgacaggtgaatgattgcaatacttaccgtaattccggttttgttaggaaattcagcgaagcgcaaccaaattgtgcttattctattcctctttagtgggtaaacgatgaagaattttagtacgtagacagtatactcctacctgtaagttggtacgacatagctgtccccaaagctgttcatctacgttttctctcttgaaatggagactatcagcaggagttgtaccgggcttggtcacgtacggattagtagcaatgaagaagctatatgtttcctcaattttttaatacatgatgtcgttaactttttaagatacgtttgaccatttattttattaaaaaatataaaattatcatttattttttatgatttgatttatcgttaaatattctaaagcctaacttaaattattttatatttgcacaaaaaagtttgaataagacaaatggtcaaacgtttgtcaaaaaagtcacggtgtcatatattaaaaacaaagatattatatggttattgcgtaaatgctcaacgccgggcgaccggcgcggggggagccggatcgggcgcttccccctcctcacgcgcaatgtctcctcctggccccaccatgtatctccaccatatattccattgcaacaaatcatccacatattttggaaaccctctattaagggaatttggtttattttttgttccaccaaaaatgtttcatatagtgcactcacaatgtttcactatgtatagatctaatgttgcagtgaactaaaatactccattgcaacaaatcacccacatattttgggaaccctctattaagagaatttgttttataatttgttccacaaaaaatgttttacctagtgcactcataatgtttcactatgtatagatctaatgttgcagtgaactgaaacatacttttactatttgctgaaatattgtttttatataaggtgaaacaacatccgatttaaacaagtgaaatattttcgatctacttagtgaaacaattccgatatacctggtggaacatcgtgcaacatttaaaaataattcaataataagctaaatttttttcatcagaatacacatggtcttgttttgaagatttaattgcaacaaatttaatggtgcaatcgggtcatgatttggataaataatttaagagaaaaataaatttaaaatagttttgtacgcatgcgtgacgctgacgtcatggcccaattttaaccccctcccagtcccatcgggcgtccgaaccggagtcgcttcttgattattagtatatgcagcttgttaatttgatgctactaggtcactactattttggtactatctcatcctgcagtgtacacgttagctacatccactgtttgaaccggaagatacatcggtgatagtcatgcatgtctatgtacgtatgcctattgatcacggtgaattccaattccaatgtacttctggctagcaagtcaccatccacatgcatcggacggcctgaaattaacgagcgtgcataattaattacctcgcgaactgaccgtcagggagcgagatcaaaatcaggccacatagaaaagcaggggactgggtaaggtgagtgcggcgggtgggcccggcaaaatcccccgccaccgcctctccgcgaatggggaggcggcacccacgtgagcaagccccacatgctgacatgtccccactcgatcgtcgatccccccctatttctacctcctccaccccgctgcttgtcacgctctcgttggtcgatcactccatcgatccatcgatcgatcgctagctactcgccgtcgtcgaccggtcgatccgccattagcgagctgcaaggctctctcgcttataaatcttccgagtaggcaagcctcaatcgatccgagagtttggtcgttgatcgagctgatcgatcgaccggtgagtggtgcgtggtgtgcggccatggacgacggcggcggcggcggcggcggcgactcgtcgccggcttcgtacatcagattggtacgtctattgtggcgtctctattagtacggcgtacgtggtctgctagcttgatctggattgtggcctgcgagatgcatgtatgcctcattctgatgaatgtatagatgtatgctgattaatttgcacgcaggtgcagcatctgatcgagaagtgcatctgctacaacatgaacaaggaggaatgcatggagacgctggagaagcacgccaacatcaagcccgtcatcacctccaccggtaattcgctatttatagcttcacgccacatttgcataaatggctaaacatgtttagtacctttctttttaagtactatttacctaggagtttattacttgcattgcaactgtgcggtgcatatgcacatgcagaagctgtggctttcatcaattaatgcattacattgtgcacgctgcatgcgtttagttaatttgtttggccatcggagaaaaactcccatgtctctttttttccccttgaaatacgaatataagatgaatactccgtattctatatgacgatatctgctcattcgtcgagaatttttcaatattttttcttgattatgctgtctgtgagcagtgtggaaggagcttgagaaggagaacagcgagttcttcgccacgtacaagaagggccaaggagaggaaccagcggagagcaagagcagtagttcttcacaggaagctgctggttccaagagatcaggcggagacgacgactaggtgcatgcatggcacccacgagagagggggctacttgtacagtaggatatccatcaagtcgtagtacctcgtactgtcttacatctagctgttcatagtacatagcgtatagtagtaatgtagccgttattatgtacgttttgccccgaaaataattaagattcggattcgcagctagccatcgtctagttcagccggtggtgttgcatgcatccggaagatgacgtacgtgtgtacacatatattcacattcgagtgcctagctaccttgttgctgtcagtaaaaagatcgatggatctctctcggtcgattttttaagtaaatgacgccgttatttatttcacattcatcttattcaaaatatttatacatatacgtaggatatatcatgcttaagtatttttaaatgataaaataaattacaataaagtaagtaataattatcaaaattttctaaataaaagaaatagttaaacgtgtgttcaaaaattaagggagttatcaaggtacacaaagatcaatttggtactactccctccgtttcaggttataatatgtttttgattttggttaaagttaaactgcttcaagtttgactaagtttatagacaaatataataccaaattagttttattaaattaataattaaatatatttttataataaattttggcatggtttatatatattgtaggtaaaagatgcagtccatgtatgtataatttcctggacgaggagttgtgcttctcccaaaggccttgatgcaaacgtaaggtgaaattgtgcgcgtcgtcagagtacaggcgatctggctgggttttttttctctcctccggatcgtacacaccgcgcgcattattattggcgtacgtactcgatcgaccgcgagcgcgacacgcacgggcgagcgatcgtcgtcagccacttgggagttgtaccgagggggagcgagagcgagagcgagacgcgtgccgcgttggccacacaacacaggtatacgcaggtacattagtagcagactataaaacaactataaacatatttcgacaaagataaaatagtatagagaaaaacagcgggctacagaattactatagtacggacttcaaaatatatgtgtgtatgacaggtaggatcatgtattaattatgtagcatatttttataagtaactattgtatgaattgactatagatgatttaaagtcagtagatgggtatactattaaatttgctcttaatactactccctccgtctcataatataagagattttgtcattttgctagcactgtttgattactcgtcttaaagtactttggataataaagtaagtcacaaataaaataaataataattctaaaaattttaaaataaaatgaatgataaaacagtacaagtaaaatattaaaattctttattttaggagatagaaggagtagctagtagtactactatagctactggaccgcgcgtggagtcgccatggggtcgaggacacacgtgcgtcgagagagtggcgaagcagcgcaagctagcagtagctaggtcgtgtatagcgcgcgtgtgtggacgtacgtgcgcgcgcgcggtgatcgattggtggccgccggtttggtgtagacgtgcaagtctacgtacgtactgttgcgtgctagtgccgtcggctgcggtgcaccacacgtacgcgtatgcgtacgtacgcgctgtggtgtttgttttgtcaggccctaccgcgtatcggtaggaaggtaggtcgattggtcgatctgtcggccgcgcgcgacgttttgacgtgcgtgcttcacatgcttatacgtatttcctctgttttaaaatgtactccctctgtcccataatataagagattttgatattttgtttgtactatttgaccactcgttttattaaaaaaattgtataaatatagaaaacgaaaagttatgctctacaaatatagaaaacgaaaagttatgcttaaaatacattggataataaagtaagccaaaaaaataataattccaaaaatttttaaataagacgaatggtcaaacagtgcaagcaaaatatcaaaatcccttatattaggggacgaagggagtaagtattttttaggttgacacgagtataaagaaagtggatgggtatggttggagaaataaagtaaatgaaagataatgattgtgattggttgagaggaggaggtagacgaaaaaatagctttattttgggacaagatattgtgctagaaatagctatattttgagatggatcgatgtagtactaaaaaggacctaaggtaggagtactccgtacatttgcaacattttctgcttgattaagaccctgtttgggagcttagcaggcttctcctaaaatctacagctctccaagaaaaaatatccagattttaatctagattctaaaaatttgtagttgtagaatcatgaaagtgaacccaaatacaaatcggaaatcatagtttttcaaaattctcatcagctgcttcctgtcataatgttaggcttccaaatagaccttatttccactaggactgatctatcagcccatcagcgtacggactaatgatgtgagtgttttaacctggttgttaggattccaatccatatcatagtttacaagtggtcaagtgcttgtgcaaataagtctggagctacttaagcttctatgtgttcttgtgtatagcaatcgtgatcaaccttttgcccagtgtgccctaggcaacttatataccgcccaagcataattaaccgtgtcctaaaaaaaagcataattaatcgttttggggctagacatgcatcatcgtatgctctgtagctattgtcatgcactcatgccatttatcacaccgttattatttcttaccacactgtattatctcaggtttaactatgcctcccctcgacataatgcgtcagttgaagggaggtgtaactgcaatgtaattatatgtaactcgttatgaaacaaacatgaaaaggtaggtgactagtaggcttccatctccatgagatccctaggtctattcccacttcacgcatgtggtgtgaaattcttttatccatgccctagcacaaatcttaacactcatctgatgacccaccccgaaagtttctgtaaaaaaaattctggcgatagttttataacaaatccgtttatctttacggcgctcttcaaccatgcacggtttaaagatctgtggcggaaccatgcacagatgcattcgaccctgaaagtgaacaatccgattaatgatagattgcccccccccccccccccctcttttcaattaaaaaaagtagtaggactatacaggctttttaatgcaacacttaggtaggagtactgggctaagggcctaaggccaggccatctgatgtaagaaactggccatctattcattccggcccagcgtacgtgcttacgtttttcctactgttcttgcggaaatgcgtgtcttcaacgatatttgctgcaagataagtgcgttaatgatcaagaataagtccactacggattagagagatttattacagtaaacgcgatattattgatttattggtacaaggagaaagagacaatcgatgatatatatgaacatatataagggcgatatcggagtagatcaaggagtagatgtcaaggcggcggctgctgctgctgcctccctgttcgccgacttgggcttaggcggcggcacaaccgggaggcggtggccgtgaggcggcgaaggtgggaatggttccgtcgggacgggcatgaacggcagcttactcttgtccgtcgccgtggccgtggccgtcgttgccggagcagcagaagacgaagctacggcctgcagctgcagggaggagatgcttggcagcggcagcagcagcagcactgttgccgccacggccactgcaaggcctcgtccgaatccgtggccacggcaccctgccatctcgatcgaatccaacaaaatcaacaatatgagatcaagtaattcccctctcgttccatttataagcagaacagagtagcatcattaatgctggtgttatgatctgcttgcatagttcgggagtggagtaatgaactgctcattcttctagagtactagcaagtatgatacgtgtgataaatgtatttatgcatatgcatgttactcccgcctaacttgcatccatgcatggaaactgaaataatcaaccgattgctaagcagtagaacaaacaaacaaacaaacaccacactcgcacaagcacacatgcgtgcagattaatggattctacagtagagtagcatatatatagaccgagtaaacagatctcatgattcgtagccgaaggagcagaagaccgtatattaatgtaaagtggctgtgagcctgtaattaccaggcatatgtctctctagactttgagtataaattgtactacacgagatgatcgagatgacggatttaacagtcaagaatcctatagtctacaacaagtagttacaaatcacaatctacggctttggcactgtcacacccgccaatccagtatacagaattaaaatctcatacacccgcaggtttcctgacgagcaccagaaattctgaaactaattgctgctgctaaacttaataccagtggttgcgaacttgcaacctgcgtctggctatttttcatgggacagagcgtgctcgggccgatgggtgaactcgtagtcgaggtgcacgaacgctcgctcgatctcaggcaggcgttccagtttctcctgcagggcctcgccgatgtcgtgcgcctcttgcagcggcatgcttgacggcagcacgatgtccacctcgacgaagtaatgggagccaaacgtgtacgcccgcaccgtgtctatgtgcctcacggccttgtggtggttccagcataggtaggtcagcttctgaaggtattccggcgaggctgactgcccgaccagggagtggacgttctcgagcaccgtcatcgaccatgttctgatcgtgtagattgctagctgcaaacgagaaaacagaaagtagtctctgaaatacagcgtgtttttcttaacaaaaacctaaggaaacgtttggaatacaagattcttgagtaattctcatgtttgaaacgtttggacgttgcaaaggactacacacccaggacgatggaaaccactggaagctatttcatcagactttcagtagaggaatttagtcaggcagactagaaatattctctcttttaaaccaagtcactgtcaaggttatggacaccagttttgaaggaaaaaaaaatattggtccctttaagaaaccggtaactgccagttactggtttttaccggacaaaagagcaaaatcaaacactaattcaaaaacctgtaacatccataacaaatcgagccggttttttagttcaaaactttggattcaaacttttgatatagctaatgtgtagttgttcataaaacatatgaatatgactatgcatggttgtacaaaatgtgtattccaaattaaaatttaagttgttctggccagtacgaacaaaccagctcgtggataaatggcagtaactggtactgccaggatttgcatctctggttacaataaagtcatagctgatcttttcatcatggtatgttttccttttttgaaagaatatatcatgatacatggaaaattggcagaaactagttacttttcccagtcaattcccaatcaggatgatgtgcctagctccaaattaacgattagatcaaatatagcatttacttgaactctagttttacactactgcaatggaacaggagaaaactttttggtacttacgatgattgcaccaactgggtcgatccaaccttcgatataagtcgctagtagtgcagcaacaagaccaatcatatttgtgatgacatcaaaaaaatgatcctgtgcataagccttcactatttcatttgtgaatgtccggcaatataaaacaagggcaagtttcactaatgtcactgcaagcatgatgtccacaacccacttttcttgctcttttgtcaagctgaactcatccccctggagaacaagacaataagttcagcaatcagaaaggtatatggcaagctacaacagaatttcaaagccaacaaacatcaaagacacttatcgttctagaaaagaaatcctcaggcaaagtttctggtcaaaagcaaaatgagagtaggagttcaaggccaacaaaacatcagcagacttacatcagacaacaacgagcgtactgattctaggatgatctgaaggccaagtgtcgccataacagaggcaaagacaagtattccctgaagaagatattgtgatggaacagtcaacatattgaaatttggaacttaaaagtgtatgactgataatactaagtgaaaagagaagcgataaactcgatcatttagtgaaattagactgaaggacttatcataaatatttccatgcataaattgtctgctgccggagtagcaaagatattgatacagtagcattgacctaagagcaagagatatctgggggaaattgggaacgtgatttctagtaactatgaaaatcctcaaaacacaaaattccgcatgttactatggtccatctgccaggaatgtttgcaatagtttagtttcttttcattcctggagcatttccactttttcttttcattttgcggaaaaaagaacatcacagggagtaactggctatgcatcatgaatagccgagagttgagtcccttggaatcaattgcataaattacagtaagaagaataagcatggcaaacatgaaggtaatcttgtgataggactcaccagtggctgcatacgctttttaccaatagggtatctgtagggatttggtgtttgcatagagaaggcagtaaaccacaagataaatcctgacaacaagtcaagaagagaatccaaagtcgaagcaataatagcaagtgaaccacttctcacagaagcatacactttcgcagcaaaaagaaccatgtttgctatgttcgatagccggatggctaaagtctcactcctagcaaccttctcacgctcttcctacaggcaaataaatttatgttcagtgttgcaatgcagttgttaaacaatttgtcttccctactgttacaacagaaaagcttatcaaacataccttggacattcctggaagaaaaccacgatcagtaagtgtatccatttcattaaagccctctagcatttccacttgctgttggtagtattcagcaactacgtcctcaggaccttgagctgaagatagaatcgtacatcaatcacagaaaattatgtccagcatgaagaaagatagtgacattagtggagcaagcaggcatgtatgcttcacatgttctactgaattataccacttctcagtgaacctgataactctgatatctaattaattatatttcatctattgattatatcacatgtagaaccactgaataaaatgctacagctattgaaatgtacaggataaaaatgtcaattctgatttaaatagtactactagtactaggattgtggggccttgaattcaaccaccaatagaccacgactttaagcccacaaggactccctacttctatagccatgggaaagcagtgattgacaatacgggagagaaacgactactagatatccaaaccccaaatgttgagtgcggccaaatgacatgattgggttattaattcaactttttgtgcccaatgcaactttgttaaccagaacaaaacctctaaaattgcataaaagggtaaaataattgtgacaatacatgaacgctaagacacctggtgcccttctcacgctgtcagtcacccacacccagtgccccagtctttacaactcggctcagtgctaaccacccccgctgataaaaaaaaaagttttcttagaactctgttcacgtgcactccaagaacagagcagctcacgtgaggaccgtcctgccctgccccagatgagcacgatagtataggcaactaggcaatatcagaaagctagaaacaacaaattcctcattccaccaatataacattccccattcctattcttatctgccaaaggttgcacacgaagaatctagcctaccactaccgtcaacatcctaatccaatccccatctatactagcacagctgagctcttgctagttgctgaaacgaaaaataaaaggagttactgcctttttatattataaaggcctaaacggaactgcttttatagaaagcagataaaaataagttactttagtagatatctattgcaaaaggcaactaccgaaacaaatgaaccatgttgccaacacacgagaaaaggcaaacgaatgaaagcctagatcaagcaaccaagcatacgaacacaacaatatatccataagaccataaacatcacacggtacaagggtagcaagcgcgcgacggcgagttggagagagatcgtacataggacgccgaggcagtggtggtggagcccgcggggcggccgcctctcctgctgcacctccggcggtcggaagccgtcgaagttgaggcgccacgacttctccgccgctgcgcccgcgccgccaccgtcgccaccgccgccgaaggaaccggcctcgacggcggagagcaggagcagctcctccccctcctccccaccgcccgcgaccgccgccgccattattccacgaaccagggagccggaggcgacggcgcgcggcacgctggtgggcagtctccctcggtcagttgccctcccgccgtgcggcgcggcggcgccacggggagaggagaacggcgaggcggttggtagtttcggcgaagcggggaacgcgggcgctcgagcgacgcaaaaaaagagtgcgggtctcgtgattaaagaggagggtcaagagggcggcggggggagggaatgaaaggaaggggagggttaggccgcgtgcgccgagcccatacaccgcgggagattgattataatcactccatgtctcggtggctgtcgagcccgtttattacacatgtcaattaaattagntntacatttttttaaaataaaaatcaattgatatgaaatatatcattcgatatacatacgagtttaaattaacatctataaaaatttattaattaaagcttaattctttatgctttcataacttttcataacttatagagtcgagtttaaacttgtaaaatttaacttctacaaaagattaattaattagagcttaattttttatgctttcataacttatagagtcgagtttaaacttgtatatcggtggagtgacatattatatgtcaatttattttgattttttaaataaattcttttataactatttatgacatacaatatacatataagtgattaaaattgttttccacgtacatagtcgatcgccgcggtctttggtttgacaaggacggcggtgcacttggcctacggaggaggacggacaggtggagggtgcacaatttgagaggatacggatccccgcggttgcgtggcgcgaggtgataccgagaggatccggttcagcgcagtaggaaatgtggcccccttctccggtttaaaaacgcattcgcctgattgcctctctctgtcccccgtacacatatcaggaaaatggccgatgctgattgcgggggattttaactacttatttgccatcctttaccagatccatttaatccctctcacagtcacagcaacccctctcactgattttgctgtcttgccaagttgcactgatgaagcgacgaacagttgtaaacgtggacggggctcctggcttgatagctgatgacacggctggtgcgagcctatgtaggagaacatgattactcggttaagatgaactttcgagaaaaacaactatagagctcaagtgcatttggggtcaagaagagagtcgctagttatgactgatcggggcggcgcgtgcgcccacttgcaaacgtgaaacaagcgcgcggtgtggtcggagtcacctcccgcgtcgagatcgccgtagctttcgtctcccggggatagcggctaggtgcgtgtacttccaacaaaaagatgtgaaactggaaggaagtggaccatatcgtcctcgtgtttcttccacacaaacgacgcacgcacctggcaccagagagccacgtacgcatggggaggcagtggcagagcgaatgatgcaacagagagccacacggttgggacgggaaagcagatcgcatcatcgcatgacgctgcctcgcctcgccgctgggataagtgggcgggagcagccggagtcgtcctggccgtgccgatcaggccgtttttttcaccgcgcgagcacggtcttatcgccaccggggtgcatgagctaccacaatcctgtaatccacaggaggagtcgttgtccctgcttggcccacgaccgtctacaagcagcagcaaccaggcagccggagcagcgccttgctaccgatggataaacgtctcttcgtcggaatgtgcacgtttgccggtgtaatgatcctggctcattcgtcgcgggagacgtgaaccctccgaatggaaaggcaggaacctggcgaataacgttcatcacgatttagtatattccacatattgacgggggagctcagggagaaagggactcatcagggacacggaggcaaccaaataattgaagatcataagaaacaaaaaattgagggtctcgggtttggtgggagaatgggagtcacgtcaataaatcggtcaacaagagaaaaaagaacctacctcgctgaaagaacacatgcagtagtatatattagtacagggttgttggttcgaaacctgtgatcaaaaccgctgctcgccgtcttcaaacaaacgcgatctctgtaacatatgatgatcgaagcaaatacgactatacgagaatgccaggttcgaaacctgtgatcaaacctgctgctcgccgtcttcgaacgcgatctcatgtaacatgacgatggaagcgttggcgcccgttccgaagggttagtatatcataccttacagagttacaggctcttgtacaattgacccgctgctacagctttggaggcgatctttgggctgacgtcacgtagcccaatgagtaaaacatttaccagctgctcatccattcacagtaggaagcagcagctctccaaatccaccttcgatgagtaaaatctttcgcatgtccaaaacgagcctaaactaccagcattctggggttagtctatcttgcctatagaatgatttcatctttaatcaacaaaacaagccggactaattttgtttcactagtgttgacactcgatgttgataaattaccttcaacggtagtttcactcaattgcaaaaatgaaaacgataaattaaaaaaaatactcgtccttgcttaaatatagttgtaaaacattttccagcagatttcaaatactcagtttgtcaaagaagatattgtagcagccaataagatgttatcagaccaaataacagtctttttttttgccagaagataacttttgagtaatgagcctttatagaaagaagaaacaagcaatagatgaatacaatcatcacatcactaaagtttgataaaggaaatgacttttgtaagatattaagaacaagctcacctggcgcaaacgatagacacaggttgagtatagttttaagctcaaaacccacaaggatttatctaacaaacatctccaatccaagagcttggtggctgctagtaatatgggaaccagtaagattttaaagccagtactttacggtatattcaggtaaattagatatatatcagctgctatcaaggattctggactttagtcacagttgacaatatttcaaagttgagcacatcttgagatttagactactgtccacaatttcaaagttgtcgcaaacctttccaagccaagtgtcagactcaaaagctcagttaattaccaaacttttatccaacacccgagacttgttttaagaaatatgaccagtcacaagcaaaactcaccagggtgtaactttaacgtccggttagtttccagggctaatcatgcatttcaaggtaaaatagaatggacatgaaggtcaagtgaacaggccatcaccaattttcacgagaaatactgagatcctaaatgcacataaaattatattgataagcctatctccacaccaaacaggacatggtcagaatgcaatgctcaccttatatcaccagctcaccatcaaatacagtgtaccaatctttcatgagagccactggcattccctctatcctcaattgactccaccaagttgagatttctgcatgctacctgctagtactgggcagtcttgcaaaaattagtatgaagtaaaatgtgaggtttaaagacaggaacttgtaagaattgaaaaatatctcccagttaaaataaatcggcagtcgtagaactctgtctatatacaacagttaccttgcacatcatcgaacagaatgcgagttagcacatttcatttttgtggaacatcttcactttttttttgggtggttcttacacatcaaaatgaagaaatacagcattgagcattttaatctcagtatagtctcagtaaccacatcttctgtggcatcttgtaaagaacgggtgttgaagagcttcacgtgcctttaggcgcgcatcaggatcataccgaagaaggccttgaagaagatctataagatctccagcagaatgatcaacatgttgcattaccagattctgcatgagttagcacaattcgagtgtcaagaggataccacctatgagcgacacttggcaaagaggggaaaatgctaagaggaacatactgactacatcagataacaaagtacctgcagacgaggcaatttccagactgccttcaggctttcccgtgaggcagccccctctggccagtccaaccttaatccacgtctgaaatacttttcagcacggcgactgtaaaaaagaagtaacaagtacatgcaagtgattgataatttgaaagaacttcagatgaaactcagcagcaacctaagcctagatgtaaaccatcttatcttagattataataaatcatgaaactataacgaagaccttgtatacatactcagctctgacaatcatatgttttggaaggggacctagaactctctccatcatagccaaatgctccaaattttcatgtgtttgaaagagagcttcaccctagtagagaaaatcaaagaggcaacatatcaataggaagcactgcaaattcgcggagccggcactgggctatagagaaaatcaaggaactactcaggtatagatagtgtgaactaaccgagcagagttcaactaaaatgcatcccacactccacaaatcacatgaataattccacccaagacctgcaaatgaaaacagagaaaggaaataactaaacaaaggtaccataaacaaaacacagtaatataattatgtgttccactttataggggggaaatggaaaaggatatgatgttaataccaaggataacttcaggggcacgataatgccttgttgataccacataattgtggtcttggtgttcgaatgttgtacttccaaaatcaatcagcttgatagcactagattttggaagattcttaaaaaaggaaccatcctttgggggccgtattgtaacctttatggaaaacaatataaaaatcagtaaaaaataaatgtatgctcgtactaattgacataatgtaatggcaaccacaagtgttaacggataaaattgcaaaagattatagttcgaatgacaaaatttagtattgaagccaccttataatcaggcacccggatagattctgatgaaacaaggagaatgttctcaggtttcagatctgtgtgaataagtcgcaggtcatgcataactgcaaatattacaataaaataaacattagaataatactgttaggggcaagataaaacaaaacgttaatttgcataaccaacaaacagcagaaattaactgaatacccacatgcaacagactctaatatttgtctggcaaattcccgaacaaggtcgatcggaaatgcacgataactattctttcggaggaagtcatataagcttggtccgagcctctcaaatacctgacaaagttagtaattcaatattaaattctgaccatccaaaacatgaaaggaagccttcttgatgcacatgtacttactatacatatatgattacgatagtcaaaccaattccgtatttgcacacagctgcaggcatagaaccattcatgcaaatccatcaactcaataaagagtcaagacttagcaatgacgaaagtagtttgcttaccggctaccagtaaaatcatgcttcccaagcctctgaagcacatcaatttcaatcatagcagcctctcgatatttctgaagggagcgcacaattttgatagccactgtctcttggtgttccaagtcccagcactctaagacttgtccaaaagtccctgcaacacaaattaagaaaggtagttgttggtaacatgtacaaagggcaaaactnnnnagcataagcatttatcctgaactattccttataaaatgaaatgttgaaatttagaaaaggaggagcaactgaccttcacccatcttgctaagtattctatctgcaaagccatagacaagaacaaaggttaaacctcagaattatctcaaccaaaagaagcatcgccaacaaaacataagttcagtacagctggtagagatgcagggcagttgacaacacaacggcaatagatatcaagaatgcacgaccattacacaatgtcagaagttatttgggcaacgaacaaaggtatgcaaacattttaccctgatttaattgactgtaaataatgaatggttatttaatgaggcttgaaatgccattcaacccataattaggtggttgaaacacggtgttgcatttaaccagtaactgacaatcattaaacagctacataagtcccaaatatcaaacaaaatgaaagttctgtgtccagtatttcaacaattgtggcaagataaacttactccagaagaaaaacagtttaacagtctaaccaagcaagcgatcagaaatgcaaacaaaaacaataaccctatgcaataaataatactgagttgtggaaaaatacatcttggtgtaaggttctccccaactgcgaaaacatagtgtccatccttgtcatctggcctccagggaggcgaaagattgcgtggtggtcctgtataatagattggtggcggtggcagaaaagcggtcgcaaaatttccattgattagttcctgcccgcaatatagcataggaattgcctacaaaaataattagccacgtaaattactattaaccatatacatcaaaattggtaacaagcatataaattctaaatgaatagaaacaactgcatactgatctcctgtgttttcaaagttcaatgatatttacaccccacttagcaccattaaagttatctatctgttttgtttgatagtcctaaatagagaagtacaccgggtaacccatatgtttgacagcactgaatggacaaatacctcaagtaacggttgtgtcccaccaaaagagaacaatatcgattagcaaaaataatgacagaatatcaaactttattagcaagttccataaatttggcagcacttaggcacatggaggtcgtgagattgccccttttctccatattgttctttcgatcagcaactggctccgatcctatcccacaaattcacaatatcacatcgatgatcctctgcaacagcgcagcatatccccaattcccaaatatgcacacccagatcgaaccgccccgctctaaatctagcgaaaccacgactagatctagccaaaaactaccaccgcaacccacacgcccgagagagaccggatcgacgcagcacatagcgcatggattataccttggggggctggaacagcgggggcgcgacatcccaggcgaggcggggccgcttccgcggccgcttgtcggcgccctggtgcgggtactcggcgagccactgcgcctccattgcagagtcgaaatcgccaattaagccatcggcgaggccaatccggcgggggattttgggcgaggtcgccgcacgatccgcgggaggaatcgggatgcgaggttggggaattcggggaagaagcgacgcgagattggggaaatttggaaagagggggaggaggggaagctcgaggaggaggtggtctggtctggtggtgttcgcgtccgcgcaaccctggtttgttctgtggaaggcgaggttagctaactatggttagttcaattttttagcttttttgcgtacaagtccctcgaattaatgagtaattgtttacagtccagttccctttgctagttaaacacgtcttcgaattatgtgtgaatatttcggctgtgttgggttgttttgaaaaatactcgtgcaaatttccgtcggacccttgccgtgtttagattttttttttccaaaaacatcacatcgaatatttggacacatgtatggaacattaaatgtgaacgaaaaattaattgcacagtttatatgtaaattgcgagacgaaccttttgaacctaattacaccatgatttaacaatgtgatgctacaataaacatttgctaatgacaaattaattagatttaataaattcgtcccgcagtttacaggcggaatctataatttattttattattaatctacgtttaatatgtgttcatatacttaaaaaaaaattagccaatcaactaaacacaccctttttcctaaccgcagttggtgggaaacggtttgaacttccaactgtgccactgttgtccatcccattttgtcactgttgggctatgtagtgttgttatctttcccattttgtcctcacaagaaactcttgttttgttaactaaataaaacccatgatgctgaaattctgatactcctattgttgcttttgttgacttcagaaatagtattgttccctctcagaaaaaaatatttatgattgttccatgctagcatctttttaggtaaaggttatttaattttgaaggaaagctaaatatatcatgcctattagctgtttaccatgctttctatgtggaggttccatgctggcttaagcttttcatgaatatatgannnnnnagtaaccagtcaaaacaattggcaagctgggtttgagatagcggtagataaaaattgtgtgtagagctgtcaaaaaagctcgagactcgcaagctactcgagttcggctcgctttaggcttgattcaagctcggctcgttttattattaaactgagctcaagcctatcacgaagctnnnnnntttcgagccgagctcaaatagctcgacgagcttttgctgctgggcttacgtacaatttgccatcccttatgctaatctgttagggcttgtttagttcccaaaaacttttcgtgaaaacatcacatcaaattttcggacacatatatggagcattaaatatagataaaaagaaaaactaattgcacagtttgtatgtaaattgcgagacgaatcttttgagcctgattagtcaatgattagccataagtactacagtaacccacatgtgctaatgacggcttaattagactcaaaagttttgtctcgcagtttccaggcaagttatgaaattagttttttcattcgtgtccaaaaaccctttccgatatttgatcaaacatctgatgtgacacccaaaaatttttatttcactgactaaagaactaaacaggcccttagttgtctcatccaaattttcctccaagctttcccacaggagaatagctagcggccgctcctctcacatcaaacagcaaaatgctgcatggcacactaaatgccttcatctttctccatcactcatccctcccaacgaaagcttatgtccttcatttttcttccccgtgacttgcgaagctaacaacaggcaagctcgaggctcggtcgagccgaactcaagcctaccatgaaactcgaatgttagaacaggcttgactcgagccggctcgagtctgtgtcaagctcgagcctaagcatatgagcttgctcgagctcggctcgttgacagccctaattatgtgtgggcacatgaaacgaaaaaattattagcacatgattaattggttttaattattttaaattttaaaaatatatttatttaatattttaaagtaacttatatatagaaattttttgcgtgaaatgtattatttagcaacatgaaacgtattgtttagcaactacgcaagtgcacctttaaactttgtcgcacacttcaatatgtggattttatcatgatatagcataaaagagaaccaccgtatagatacatcccagttgtttcagacgaggagaaatcaggacgatgggggacaagttaaaggcaaaagggaagccggtaataaacataaaatgcaagctgagaattagtgttggaacacttatctctcataggctactttggatcgaaagaatttacaaaattttcacacgaacttattaaactcctaaaagttacttaaaaaaatcctccactccgaaaccatgacacatccttgccctaatggccaccacccagccaaaagaactaacaacatcctttcataaaagtttaagataactgacatatgcagccctatctttttgctcatgtttatacttaccagccaaattttgaattttcaattttttttatcaaagttcatttttcagcctttgctttttagatcgttaagaacatgtatataaaagttttcttcacaaattagttttcgtttgcaaatattcagcgaaacaatagggtcgatgctccctccattttatattataagtcgtttcaattttgattaaagtcaatttgctttcagtttaatcaagtttgtagaaaaaaagttataacatattcaacctaaaataattttattatgaaaacatattcaatattggtttaatgaagctaagttggtattgtaagtattactatatttatctataaacttattaaagtagtttaactttaaccaaacttaaaacaaattataatctaaaacagagggagtatcatggaacggtaatcatgttatgctacaaaatactatgtgtcaggggatcatcgccgaacaaaatgcaacaagtagcaacggtgatgcggttggcatctggcaacatctacgacctattttgacctgactaatcacgctccagtcatcaacacattcttccatgatcagcttttcctcctttccccgaaagaaagccccggaccggatcaggccggtgccgactctcccaagtcccaacaaacaaagggctgtgtttagtttcttttaaagttaaaaatttaggttgaaattgatacgatatgactgaaattatgtgtgtatgacagattgatgtgataaaaaaggttagaagtttagatccaaaagatctaaacactaacgtgtgccgaaattgaggaccccagacttccacggtgctgtagggctacagagaattccgacgcgtacagccgttcggaaactgcgacagcgctactgcgcgtagccgtcgacttgggaagctgggagttttgggcccgaacggcggtgggccgtgtgggcgtccgaacaaaacgggccgtcacggcagaaggccggcccactcgagcattgcacgagaggcgattctggatttttttttcactagcaaatatgcccgtgcgttgcaacgggtgaaaaaacgtaatgataatatacgtttttcatgcataaccatgtcgataacaatcagaaaattagaactacgaaattttattttctagcgcgttttcttttgtgcttttttctgacatttttccctcacgtgtttttttaaaccgtttttattttctcgcgcattttttccttttttaatattctgtagaaacttctcttttta

SEQ ID NO: 71845 - DNA, 15815 bp, Oryza sativa
  unsure (1)..(15815): unsure at all n locations
taatttgcagggctcatgtgtgctttttttgtttacactgtatctatttgaccatttgattgtttaaagttagttgtttcttctttgctttgtagatccaaccatatgttgtcggatgattcaattttctgttacatttgttccatggaaatattttcagatgtgcatgtcatatgttcagcacactgcctgaatgaggatcatattagtgaacccctatgatcttagcttcattagtatcttttcacaacaagtttatgatttttattattgtggtttcttaacctaattgcgtagtatagttaatttttacctacatgtgcacactatcatctcactatatcgatcaatttgtatcatctgacatgattctattgtaaaatcaatgtgtgttttgattatattttgatgatgaacaattggcatggtaggttattggttttgatatttggagattattggcgaagtggtttggtgctaattatgtgctctggtcaggccggatagactaggccggtcagaccggcgtgtgttgtgcggtcaaaccgaccagcctgacgatctaactggctggtttctgactggaatcggttttgggttgtttaattggatatctgtgattattgttgatggtcattaagtgcgaactttcactatcaactcctacataaaagaataccaaatataatatcaaacttattggtaggggtttattactaactatttcctctagtcttggtaaatagtggtatgtagttgatttctgaaggaaaacacactcgtcatgcgattaaatgtacctctgaccaatcatacgtaagcacaaggatcggagagcccacatgtcagtcaaaatcgactaaatttgagctaatccattgccaaccgccataatcactcacctggcatacactagagaatgtgggtggctagatgcggtgtgcctggttcgatcgaacgaggggttcgaccaaaccaaggttggcaccaccctcctcccctctccccgccacctccttgcacttggcgacccactattggttgttgatggtggttgtgggtgcaccaacctccacaactgtcattccaaccgttatatggaggctataaaaggagaggctcaactcacatccaaaacacacaactcaagtgaagtacaactcaatttcatattttaggcatcactttagtatgtggaattaggtagatagtaaggggaagctctagaaggagtgtcccaaatatcgacgttctctctgggaagtccggaggagtgccgggttcgttgacattgttccactggaattctagagaagcgcatgtgttgttggccttcttgtcaagcttgttcctcgacggatgcttcttttaataaaataagtattcgagatctccttatggtatctaatttatttgcttgagtgagacatattcacatcgttatgggttcctcgcttagttgaattattaagtgctctagtactaggactctggataaagaaggaagttcctaacttcctatgcgaggctagagtagtaatcaataacttaggcatggtgtctaggttagcggttacattcatttgttgtgtggtccacggaaagtgaggtaggtgctaggtggtgacagctttgtccgtcctttacatccctccatgttcagttacatcatagagtcataggccgaactcagattgacagactaggggagagccagtgcccaaagcaatcgatagggttttacctttaactccagtctagtaaattaacccataggaatcctctttagccttagcccatcattagttgttgtccttgaatagaattctactcttacatatacacacacgttccctgtgattcaatacccttaaaatactctgaggtcaagtgctacagcggtctccatatgcttgcggattgacctgtgccgtatcaaataccaacaaacatttctagcaccgttgccaaggaacggttgctatatcatattcgaacctgattcatcctcgtatcttttcatttctcttcttacctaccatggagcacctttcttttcaaaatctttctattccaagggccaagttatgtgagtcacctttttcttcaaaacctatccattcatctagctataaattccatactgattttatagccatggttcgggaacaatccttcttaggacgtgaaatcgaaaatccctaccatcatctgcgttagtttgagcaattgtactcatgcttgacaatcgcgggcatgacacaaacaagcttaaattggaaattgtttcccttctctcttatagagggggtaaagcaatggtacacccataccggaagaaaactgcatggtgaatgggaggaatcaaaaggtaggttctaccttgatttcttcctgttaacccgtgtagtctctatacataaggaggttctcaacttttgacagaatgagaaaaaaatccaatggtgcagtatgggctcttttgttcttgttaactcaagacagcctagatttgtctgcacccgatcatgcgttgttataacactttcactcgggtttagataaggagtctgccatgtatctcaatacttccaccggaggttcgttcgcacacaaaacgacgttagaaagtagggagctcttggattgtatcctagagaacacctccttcgttcgttgtgaaaccgtcttgaaaataaagaatacacgtgaggaaccatcgacgaccgatattggattcgaccgttgaattctcacccaaacctcgagaactgaaggtagaagaaattcaacctttgaaattcccattccagtttgatgatgatctttttgaacattatggaaacacctcaaattattcctaccaaaagagaccaccggtcccgtgtaattctcccgcaccactcgatgagaatctcttcaaagagacggtgcagaaattaactaccatcatgagtgatgagtggttaatggagatggaggtttcttctgaagtaattcatattagctcccagtccttaactattccatatctgatgagagaggccatggtgcaaactctatataatcccactgttggtgcaaacattatgtctacaacctttgcattaaattgcttcgggggcgaactatttgcgccaacaaacaaaaacttctggagcccctctagtcccatcatcgaaggttatgggattcttcgtagagtgtcgatccagcacaatgatgtcgaagctatcctcgacttcaatgttttgaaagtctcttatttcgatcttttcgttggccatcccatagagaaacttctccttgatgtgccgcataccggagtccttgacattaaactcgggaaaatggtgtttttcattttgatcttgcgattgaaaaattctatgatggaacccattcctgattccgagccaattgaggaagtgatggctatctctccttttgaggcccccgaatccctcctcgaaaatgatgccaatgcattcgtcgaggagctaggacgatcatagagagatgatcgagttacccaaaactgatccacattcatgacctccagatgagctcaaatctcttctttcaggctttccttataccttcttgcatggtgatacggagtcgcccgtcaccatcagcgacaagctgtctactgacgagacctccaacctcaaagatgtgttagaaaagcatcgctctgttctaggctactcacttcaagacctgaaggggattggactggaccaacggtcaacaataaccggagcctctttgttggtctggctggtcgaggccccaattcaattctcaaggcgcatatgcctaaccattgggattcatcgtcaggtcgcaggggctgagagatgcgcgctagctaacccaccgtctcatcgcttctgttggtagcaaatattttattaccgactatctaaccacttgaccagctaacagagagcttgtttagtttattcatcaatccggacttaataactatgatatcataaaaaacataacagtatgccacctggtgtgtatattttttagtgacagaacggtacgtggtaccaaaacggaattaacaagcttaactatgagcgattcctttcctgctagttcatgcgcacaatacataattttagcaatatatattttttcacactctcaactaaatgatccaacagaaaaatgtagataaatcacaatcatatatgcgaaatcttagtattaaatattatgatcaccggaggtgcccatgcataaataaataatatgatgaatacatcattaattgccctcaattgactgatatgtcaatttcgttacttttttggaacgagacagaaaccgcgatgttatgagatagagatccgacatgactcatgagtgtcatcagcaacaagatattcgactaaatttcaccgtaataatgatcattattacctaaactaatatatgaaaaatttcatatatataacccactaaactttaaatggaagttcatccaacacctctaaattaaaaccagataaccaacccttaaacttaataacaccgttcatattacccctatcttctcctctaactaatgagattttggacagttaaccgtgtcatatattaaaaacaaaggtagtatatttttatttgaaaaatagatgtagttcgtactaaataatttaccttttttatgtataagtgcactttgtgaatcaaaccgcctgtctacaaattactccctaacatattatttggatatttagttttccataatatgcattacttgattttttttctcaacttccaagtttaagttatactcagcatgtaactaccgaataaatatacacttggacttttcaacttgcctttgtctattcagcaataatttaattacatggaaatactatatataccaagttgttggtaaactaaaagtcactagtcgtgtgtacaaaatattctctttttctagcaagtacaattggcatagaccctaatcacatcactctgatcacactagcagtccagcacaagcattcacacgtgtgcatccttaatatgtacacgcttgaaatattgtcaagggcttagtgtgtactcctaaaaacaccccatagcttagtcatgcacatatccactgaatgcgcaggcgtgtgtactcctaaaatacatgccaaccacacatcctagctactggatataaatatctgaatttacattaaccagatttaattttcagcctttcatccacagacctcatgtgctaattgatcatgatgaagcctcccaaagtatgcaaagctgcataactaaaaaaaaacgttgtaagtttattagcgataaaaaaaatattttatgagtaaaatttttatatacacgttttagtaacttaaaagccaatgctaaattacgatgaaaaaattgaactctaaattaaattttggttgcggtcaagtttacttaagaagcaaacgatggagctgtgtctacatcgatcagtccagatggagacattatatcatgtgtacgacacaatttgaaatggaacagcgctagcggtcgacctgcaaacgaaattataaatctcatgtacggattagcacatgcaaattaagattaagaagcgtgcaattaagggaaaaccacacttaactatgtggcgaactctagaccaatacgaatctggacatatatagccagattcgtattactagaatgtagcatccagtactagtactagtttggtttttatggaataaaggaagtaggtaggattgttttttttttatttgtagtattatagaattgggatactaccataagatctggatagttccagattttacaaagtatatatttttatgtaaaatatataatatgttgtataaattaaaacatataaattgattttaataaatttaactggtttttaatgtaaacttaagtatatttattcatattattttcaatccaccttattttaaaaaatattttgtaggatcgtatggatcgtagaatcatgatactacttaagatttcgtagaatggtgtgtaaataagtagtaaatcgggatgctatgaaaattaagatactaggtgggaataatagcgtgcttagtaggatcgtagtatcgtaagatataggatacggatcgggatactgataaccttacactagacttgtcttgtcgtatgacatcattgacatggatagactaccaggaacaacagagagatttatcacgagttaataccccctgaaaatggtatatgtacctgctgcaaatgtatatgccctgaaacctgaaagtgtcaagtagcaattaagaaggtggtgcattatgtggcatgccttagaccagaacttttttttaggaaaaacatcaaacaataacttgcttgataacaatggatcaaccaagaatggtacttgaccaaaagaaaaataaatggtttgggtaaaagaaaatgctggcatatttgtttaggcaattttagttactttttttagcatactataaataatgcccgtgcgttgcaatggataaatgcatttttttagcgatacaacagctattaagagccgaggaataaattgaaacatcaatatcactatatacattataattgaaaaagtgttgccttctacctcccttcactttacttgcctctccttaacttccggaagacagtttagtgcccgtccaatgctggagcaaataatcccatcaaatctagccgaatatttctcaatctcctaaaattaattgagggcttttgatccacttaatctcttaattcagtttttcccaaatcggagtgaatccataaactcgtgataaaaatggctaagagaatatcgccggccgacaaagcttaaatctaatgaattaaagccgaattgaaaggggaaatcatgggaaacgttaacaatggagattaaatctggtgaagtaaaatggaactgtaggaggaaatcaaatgatgaggggtagtggggaatcaatttttgcaattaattagggtaggaaacgcacggagagactgatcaatgttacggcggcgctagggtttggccggacaacagcttgctagggtttggcccagcaacagcttgagattaaatcctagcgacggaaaaaaaaaccaagtggattaaaaaacttaatcctcaccgcgtgcaaaaaaaaaatatgactacaaaaatagtgacagaaaaagcttatgaaaaaaccgaaaaaaaggcgaaaaaacatgcaaaaaaaatgatgtgtaaaaggtagtggaaaaaaaagaaaaaaaggacgaaaataaagcggacagaaaaaacgaacaaacagcgtcgaaaaacattggactgaaaaaagggagtcggacggaaaaaaaaaaaggaaaaaggtcgaaagaaaaaggccggacggaaaaataaaagaaaaagggttaaacaaaaagaaaaaagagtgaaaaaatacgacggacaaaaaaatcacggaagccttacattttttttattacatttttttattagatatagaattacgagctccaatggttcggcgacgatgttccagtgtgcacaagtctattttcatatctcaattcattccctcagctcttctctcttaacttttgttttggttttcttttttacttatatatccattaatttacactaatatcttctttttttaagagtcaagtaagatgatcacatgttttaaagtctcatttctttcatgcaaccaatatttgtaaaatttagtgtaaattatacatgttaaagtgtgattgttttttatgtttaaatctttgaaaaaatattgacaatcctagatatatatatataaaggattgttttgcagtaggtagtacgcattcataatgaatcaaatctccaagatttatatatgtcatgtatttattatttactaagctaggacgctctaacatcaatagacaaaagcataaacaatatgaactgttatattaattgtaactggttgagattatgatggtgtagattataatcgacataactatacaaatataagtggatatatataataagctgaagcaagaactatgtatataattcagttatacttttgaatatatatcttcacatataattacaagaaaatcagctagttagtctaatttcaacttgtggataaatcattgaagactaaaaggatagcaaaaacaagtacacctggtatatttgttaggcctagtttggtttgttggccaaacaaaccgtatccaaattttggtatgcgaaatgttggcccattttggcatttccaagtaattttgggatgtgtttggtttgatgcagttgctaaattttggtatagttttaagagtaaaagatttcagaagtactaaattttggcatcatatatagcaatggttaatatgtgtttttgtttgttgccctaccaaaatttgatagtaccagaatttggtaaggttaattaatgaaaacatgatcattgggactaattaaccatgtttgctaagtgcggaaggatttcaatgccgatgattaaatgtgatataatgattcatccatcaagaagttattcatcccggtgattaataaatgggcgtctaagatacatactaaaggtaattatccagtcttcaacaagcaaagtgaagattaaggactcctattcactagtttaccacatcgaaggagttgggagtgatgtagtcattgaatagggttttactccaaactataaagaggggtaaagttagtagattgtccaggaagctagtgttagtaactcatgttactggaccttgggttgaagctactagcccactgtggcccatccgattggaagaatgacaatacaaaagaacaagcatcagtcagggagaggggatcgatcgatcagaagaaccggacggcggcggtggtggcgacctgaaggccggtgggctccttgtcgatttcttctccaccattcctcctacctccacccccttagttctagaaccccttctagaacttatatcccttttcttcttcccattttctccaccaaacaaagagttgtactgaatatttgttgcaatttcgcttagagaagtgggtctctaagggtctctaacagctaggtgtgatgcacactagcgccgtgtttagttccaaaataattcttcaaacttccaacttttccatcacatcaaaactttcctacacacgtaaattttcaacttttccgtcacatcgttctaatttcaaccaaactttcaattttggtgtgaactaaacatagcctaagcctttttctagcacaatatctatgctttttccctagtggagttgagccggagcaaagtttggattgcgaatcattaattgtccttgagtctcagtgtaccggacggtccagtgccacatcaaacagtccgtctaacggatcatgtgttgatgaaagcatattgtgtgtacgtgtcaggtaggccgttgttgactagatagtccagcatgttttcttccaactggaccatgtgtcgatccaggccataccgtgtgtacggtccagagaatccaactgcgtgtcagactgtctggtggatggatcgttcgaccagaccatgtgttggtcctgaccgtgtttgtgcacatggatcggacagtccgacagatgacggatcgtgtggccaaacaatgtgtttgtctgagttaagacattacatttactggacagtatggtgaaaatcaggcaatccactcaaatcacatggaggaggcctaaggattatatggattggacaatctggtatgcaaccggatagtctgccttatacatgggtcggatatatagttttgatatgagtaaattgtccggctttttatggtctaacggctagttacatgtgatgattgaaaagtttatataaagggacaaacagtcctacaatacatcggactatctaaatctatgctttttttttttttgcaacacacttgcaacgactagtttgagtggttagggttataaatacccaattgtttagacttcccctctagctttctagatatagtgttaatacaaggaagcatcatcttgttattgttggcatctcgatgcgcctaaacggttgtggaggtggttcctgtgatctctcaagaatattgtggaagactcgggtgacgtgtggggcttggagctcgctatccaaagttgagaagagctagctatctctcgatagtgctcgacttcatgaccatgagacttttgtgtacagtactcaacgaggactagtagagattgccgaatttccgatatctcaggaaaaactcgttgtgccttggtgtttgcaatatctctttttctgttcttcacttgatattcttattagtttcaatatttagcttgttctagaattgttaggatttcaactaggttgtagaacttgggctaactagcttttgaacctaggcacataagctagattttggagttgctcatattgatgtcatttcaaactatactatttttttaaaagttatcaaatatgtgcatccatttagtttttttttaccactctgttaaaaacataagaaatcataccaagacttagcaatattgccaaaattttgacaatgctaaatttggtaaggtttatttgactataatctgaacagaccctttattttctgaatttaagtttaaattcggccacatctttgatccacgtcttagagcatatatcgttattccccccctgacctacccttttctttgtacgcgttaagcccaatgtgttgggctggtccaaagttattgtaaatactccctccattttaaaatgtttgacaccgttcactctttagtacatgtttgaccgctcatcttattaaaaaaaatttgtgaaatatgtaaaactatatgtgtacatgaaagtatatttaacaatgaatcaaatgatatgaaaagaattaataattacttaaattttttgaataagacgaatagtcaaacacgtgctaaaaagtcaacagtgtcaaacattttgaaacggagggagtatattttatacacagaaattttatatgtatgacaactttatgcatacaatgtatgtataaactttgtacatatatggaaaattcatacatgagtagtatacgcatatatacgtacatttttttacgtacaaatttaaaacataaaggcacttagaaaaaaaaattaattactgtaacattatatccgaactttgcacgtataaataaactttatacttatggatcttaaaaaattcaaaatttattttgaaaaaaaaaacgcgcaggtgggctaacctccctcgaattcggtatgatctgtaaacactaaaaactgccaaaatccatatagaaaataaaaaaaaaagcttgatcgttaaacacgcaaaaactaaatgtggcccaaatagcgcgggcgaaaaaaaaagaataagttcatctgaggtcccttaacttgtcaacgaatccgattttcatccttcaactgaaaaaccagtgcagatgaggtccctcggcggtttggatggtggttttagctgacgtggcgcttacgtagctaatttgactcggtcttcatctgacgtagggttgacgtggcgcttacgtggcaattcgatctgaaaaataataaatctcatgggacccacatgtcagtttcacccaaaaaaataaattaaaaaatggtggggcccacgtggccccacatatcattctcacccctcctgttcttactcctctctcaccatctctcccctctgctccctccaggcgccacggggccacgggaaggtccggcggcggcggccggcgacgcgggagaagggcagtgggcagggcgtcgncggcgggagcgctgggtcttcgctcacggcgtcggcgcggactccgcgcgggggctcgtggaggagatcggggccgcggcgccgcccgtctccgatgaactgagctcgtgcgagcgcggtgccgggagctgcacgaccgccgacgagaagcagaggaggttcgaggtgtacaggagcaacgttgagcttgttgagaagttcaactccatgggcaatggctacaagctggctgataacaagtacgttcgccgacctgacgaacgaggagttcagagccaagatgttggggttcagacctcatgtcgcaattcctcagagcaatgcctggagagagcagtgatgatattctgccgaagagcgtagattggaggaagaaaggagcagtggtggaagtgaagtaccatgaagattgtggtgtgtgagaaatagcatggtaaagaaagattcaaacctgtaaaaatgttggagattaatcgatggaaatctgggtgttgtgtggatgcaggttcttgctgggcattctccgccgtggcggcgatagaggggatcaacaagaacggcgagctggtgtcgctgttggagcaggagctcgtggactgcgacgacgaggccatggggtgcggcggcaggtacatgagctgttagagttcatcgtcggcaaccacggcctcaccagtcaccacggaggcgagctagccataccacgccacgatcggtgcgtgccaggcggcgaagctgaaccagagcgcggtcagcatcgtgggctaccggaacgtgacacccagcagcgagcccgacctggcgagggccgtggcggcgcagccggtgtccgtcaccgtcgacgccggcaacttcatattccagctctacggcagcggtgtctatatagggccgtgcaccgccgtccgccgacgtcaaccacggcgtcaccgtggtgggctacggcgagtcccccaacactcctgccactgacgccccgcccttccccgcgtcgtcggccgccgccgccggacctcccccgtgaccccgtggcgctggagagaggagaggggagagatggggagagaggaggggtgagaatgctacccaccattttttaattcattttttttaaactgacatgtcccatgagatttattatttttcggatcgaatagccacgtaagcgccatgtcaatgctacatcggatgaagaccgagtcaaattagccatgtaagcgccacgtcagccaaaaccgccatccaaatcaccgagggacctcatctgcactggttttgatagttgagggacccgttgtatctggtttttcggttgaaagacgaaaatcggattcattgacaagttaagggatgtcaaatgaacttattccaaaaaaaaaaacaaagaatcagagtgatcgtgcgtgcgggccggcggctgatcgcgaaagcgatttcgctatttagaggctgagttggactctcttcgctaactttcagcttaaggaggtaggaaaaagtacaccgtagttcccttaacttgtcatcgagttgcaaaatcgtcccccaaacacaaaaccggatacaacgcatcccctaatttacaaaaccagtgtaaactaggtccctcggcggttttgactctggttttgtccgatgtgaaagctgactcagcgtgggacccgcgtgggcccacaagtcagggtgtccatgtcatcatcatctctttcctcatcttatctccctttctcctctctctctttcccagttttctcatacgggccgaccatgggtgcgaggaaggaaagggtcgccgacgacgagtggtgtggtggtgcggcaacaccggagaaggggcgacgcaccagcggcgagtgagatgtcaagaccgctcttggcgagatgacacaagcgacgggaagggctctgcgaggttcactggcacgggggacgacggcggcttgggggcatcgaggcgccacgctcggtcagaggccacctcagcgtgcgcaagcaggaggagcgctggcacaaggtggcgcgccgagagcggtattgcccaccactgccactcgcccaccgccgccacactcgcccgctcctctgctccacccacgtccagagccgctgcttacccaccgtcgccgctccgtagccgcgctcgcccgccgacgtcgccacttcgcccgctccggccgtgacctggcgcccactgcagctctgccgagagacacgcggtgacggacagggagatgagtggaagagcgagcccatatgagccacagtggaagagcgacccatggagaagagctcgccattgtcgtcgaagtcgagccctaatgagcagccgctccggccgtcctcctccgtccttgcgccatccctcccacccctcaagctctcagcggcggcgctgcttgcacggctccagtagcggctgctccgaccacgggcggtcctcgactggccgcgccgccgccatgttcaagcccgtcctcggtgggaagcgagcgttgggattggtgcagcgaccgacggggagagggcggcacgcttcatctacaagccggcgccgtctaatgttgtcttcctctccagttgcgctgcccgacgtcgtcctcctctcccattgcgcagatcctgttcgtcggccggcacctccaatgagggccaccaccgccgagttgggagcggcggagggcgcagcacccagggggacacgtgggcgagcgcttgagtcgcctctcatcgagcagagaggagagcgaggtgagggcgaggccatcgccggtggcgccgccgccgcgtccgtctccacctccgctcctctccccgcctgtcgtcagccacgcttctcagtcctcccacgccaccgattgccagaagagaggaaaggaagtagtcattgacatgtgggacctacgtgggccccatgctaactcagctgccacgtaggacaaaaccggggtcaaaaccacccaaggacctagagtgacccaattttgtatgttaagggatgttatatatctgatttttgggttgagggatgatttttcagtgtactttttcctaaggaggtataaataggcagcccattagagttcgctcttacttcttctgctaagaactgggccattaggtagatgggcccatttcctgtttgggcaagctgggccagacacagtccacctatgggcctattgggccttctcggggccttacctaagcctgggcctcgtctaccctaacccaccacgggcccgcctccattgcctcctcgctcgccgccgccgccggcgaccaccaccgccaccaccaccaccacccgcaaccgcagcagccgccgtctcttcacccgccggtgccgacccatccagcaaccctcacggccagccacgcgccgcaagagagtccagatctccgcctcgatccgcgcgccgccgacgccgacgccgacgcccacccggacccggatctgcgcgccgccggcacctccccacgcgacggtgcgctcccgatccaattccatctccataccctcctcactctggtgcgaccctctgccctgatggtgtgtccacgccgccaccgacgtctcccgctatgtgaatgggagaaagaaaacgggagttttcttggtctattattagttgcagcaatcagatgacagcgacctgaaactccgggaattcacacgtttttctgcagaattttcttcagagttattcttttcttttcttttcttttcttttttgctaccatggatgctggagttttttttcgctatggaagattcagtctctgcatcttaaccagttatcataccagtgcaaaaaatttatgatacacttgctttggtttggttggagaaggcatcagcctcaagccatcaacttgctgaatttgacggtgtccaagctctgaagcattctattgcttccactggatggattgatggatgg

SEQ ID NO: 71846 - DNA, 5444 bp, Oryza sativa
tagttggctgctgctgtagttgacttatggaatattaaaatgctgttaatttacttatcccaagctgtacatgatgctgttacatgatgctgttacatgtagcttcatgggttgcatgtagacagccatttcggttccccatgtctgacctttagttagttgtgtacaccgaatggcagtagagatagatgcgtaagatggtggcaaatctgatcacatgctgttcaattataccataatgacaaagcaaccattttttaattagctgttcttttttcttaattggttagcttaaagaggtttggtggtgtgtcatggactcatgggaaccttttttgattagtggaggtttggtggcctcttggcaaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctacagtgctgtcgtcgttgatgaattagaggcattattattctgctcgtaacttgaattcgttagctaaactttttgttagtgttgttgtggtgacggatctccatctgtcattctcctgatgcagtttgacaccaataggcacatattattatcatgaactgctcattggtttatcagtttaattgtgttcctcagaacctgactaaatgtatttcacagcctagcagtctttgcatgtttcttttgacatattggtcattgtgcttgtaaactgtgtatctagatagcttctattaactcaaaaatgctgcttacaagttctgatctatataattacttttagtgcttattcttcaatctcctgaaaatcagttttcattatcacagtttcagaactaagctgagaagatggtgaagatctgctgcattggagctggctatgtcggcggcccaaccatggccgtcattgccctcaaatgcccagcaatcgaggtggtggttgttgacatttccaagcctcgcattgatgcctggaacagcgaacagctcccgatctacgagcctggcctcgatgaggtcgtgaaggagtgcagaggcaggaacctcttcttcagcactgatgtggagaagcatgtcgccgaggcgaacatcatctttgtatctgtcaacacccccaccaagacccgtggtcttggagcaggcaaggctgctgacctcacctactgggaaagtgctgctcggatgattgctgatgtctccaagtctgacaagatcgttgttgagaagtccactgtccctgtcaagactgcagaggccattgagaagatcttgacccacaacagcaagggcatcaactaccagatcctctcaaacccggagttcctcgcggagggcactgcgatcgaagatctgttcaagcctgacagagtgctcattggtggccgggagacccctgagggcaagaaggctgttcaggctctcaaggaggtgtacgcccactgggttcctgaggacaggattatcaccaccaacctgtggtccgctgagctctccaagctcgcagccaacgcgttcttggcacagaggatctcctctgtgaatgccatctccgccctatgcgaggcgactggtgccaatgtggccgaggttgcttactctgtgggaaaggactccaggattggccccaagttcctgaacgccagtgttggctttggtggatcctgtttccagaaggacatcctgaaccttgtgtacatctgcgagtgcaatggccttcccgaggtggccaactactggaagcaggtcatcaagatcaacgactaccagaagagccggtttgtcaaccgcgttgtgtcctccatgttcaacacagtctccggcaagaagatcgccgtccttggctttgcgttcaagaaggacaccggtgacaccagggagacaccagccattgatgtgtgccacggtctgtgggtgacaaggcacagatcagcatctacgatccacaggtcaccgaggaccagatccagcgggacctcgccatgagcaagttcgactgggaccacccgatgcacttgcagccgaccagccccactgcattcaagcaggtgagcgtggtgtgggatgcatatgaggccaccaagggggcccatggtgtctgcatcctcaccgagtgggacgagttcaagaccttggactaccagaagatctttgacaacatgcagaagcctgcattcgtctttgatgggcgcaatgtggtcgatgccgagaagctcagggagattgggttcatcgtctactccatcggcaagccgcttgatgcctggctcaaggacatgcccgcggttgcataataattttccatattccacacctgaacctcatagctctctacactctgctggtgctgaagagagtctgcgtcgaagaggaatttggttgaccatcattttttatagctcgttgttcgtctttacatacaggagaggctaccattttgtcaaacagaaagttgatttctgttagtatctttgttcaagtttttcttgtgttgcaccattgtagatctgaaatcttcaggcctctaccgtttgagtgccaccctcaatcttgtatgatgacatgaattcttatagccgatttattcttcaaatgtattcttgtgtcgctaaagattaatgatgcaattttttcttggccaaactgcagcagtcttgtttgctctggtttcattgtttttggctcggcaataaatgtgtaatatgctgtaactgaatgaaaagattggtccaatttttttggtgctgcctctcctctgaccaaccactggagaagagagccggagatgatccggtgaccggagctagacagcgacaagggtcacaacttgcctcccaattcttgaccaggaggggcagctctggtacttaacacaaatgttttcacaaataagaaaagaaaacccggaacaaataacggagttggacggtagtgatagaaaagggaacacggcaaattcgagtggtatttaagtgtaccatggaatttcatgaaattttagttccaggtatataaggacctataaatatagaaatatgttaggagaaaaaaaacattaacggcaattagacgtgagcaggggcagtaggctaacatataaccacttgtttttttaactgaactaactgttagaataaatgggctaggcccgatttttctattaaaatctcaagggcccataataaatgttaaagaaaataatatcgccctgagaattaaaagtggagtatctcaacttaaatagagagttattggaggctacctgttaaccggttgaggtggggatcggaaagccacacgcgcgcgcgccgagccgagccgaggccgtgggcgtggcgaggcgtgcgtgcgtccgcaacgggtgcggattcctctccgacgctattaggaaatagagacccccggtcagatctctacgctttctcccatcactggttcttcctccgatcagatctctacgctttctcccatcgctggttcttcctccacgcttgcgcctgtgctgcttctgcttccccggttctgattgcttgcgcgcacgaatgatcggaacgagcagggcctccgaaaccacaccttcgcctgagatctgcaccgggtaggcgggtgatcaggtttttaaggagtgcttccgtacaactgctctctcttcatcatcgtcggtggttctgttcggtatgcgtcgcggcaatgtctactggtggcggcgtcaacggaggtgcgccaggaactggagtcgcaccgatcgacaacaccaacggaggcagttctgtctcacaatccagcggagggacctttacagggtataccatcctactgctatctctgtttttgttacatctgttagtcgcaatgttattgcgttctctaaatgatgttgatgcttattttatcttaagcatgctcctggttatgtttaattttatcactagatcacctcacattgttcatgtcatgtttattgtcttaatattttggattaaaatataccgatatatgaccatatttccaacactaacacacaaccatccgaaaattttcaatccaaattgtctcagttaggtcagaaatgtgctcacaaattacttctatagtatcctacaatcccttgaaaataatccttatcataggtcataacatgtgactttatgtgtataacacatttaaatatatataaatatttggttaccagtttgacgtgtagtttcatattaaattcctttattttaaatatgctattttctaaaacaaatcctcataagggatgtatgtaggctacgcatatagatattctttaaataattattaaatggtggctcttcactcaatatttttactttggactaaaaatttttatatgtgttttactttcgaccacctcaactttcttcgttagtgacatccactctctcctctatcaaagaattgatgtggtttgcacgtaagtgaaagacaataatgtgcaagtgttattgtactttagactgttgatgtatttgagatgagagttggggtgatccaaatttctaaaaagacaaggtactcaaggtgaaaagtaaaaggattgattaagttatgatccagagtgaaattttagctataacagttagcccaaactgcatttcgattagagtattcacacttttcatgactctggttgatcacaaagtcctagcatgtctaatagtcaataaattgtagtagtatttcatctctggaattccaaattgtagtttagatcaagttttatcaccaaaatttatccattgtctaatccttttatttcagactaggtacttttgttattttaatttactttggatcaccctgattatcgtttctaagccatatttagcaaactatatagcttgggcacataggtgaggggagctcgcaagcatgttgaagctgatcgtcagaccagtcattgatgtgttcaagaagtggtttaggtgatcagaactactaccatacatctgtcttataataattgtatttctaccatttaaat

SEQ ID NO: 71847 - DNA, 3243 bp, Oryza sativa
aattttgagcattgtcaaatcgtgctacagatattggccttcatagactgttggcgctagatgtctgtgactttgatcaaacagagctcttgtttccaatgttactgatggcaaaattttattttattttattttttccttggcaggaactttgcaaaccattttcaagtttcagaagcttctgaagatatcattgtgtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcgaaatcaatctagggtttgcctcctactctgtgctacgccgtcgctcgtagactactccatcccgctcgccggcgtgcaccagcgatcgggagagcaggtctccggaacctctaccttcgacgtcttgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagtgtattattcctaatggtatatattacaattgtctatcagaattacgatggtggcatattcaataagatcgttgcttgaggagagaactgggagaatccaaaggttcctaacgaataagttagcttgttttttatttactaagataggcatatggttgcctggtagtgatgatggttttgatgggtaggttttctctaagatggaagacattaatgctccataagcacgatgcaatagtattgtatctaatttagttcttaacgatgatgtcgatgctaaggctccagaacataatttatttatttagatttttttctttcttttacgtttttgtgcttaatacttgtgatcttgtttgaacataatgtcagaaaacttttgaaacatatattgttacttttggttgtttgctttacattataaataatgtcgtagcgttagcacggacatattactagtaaaataagtttaactaagtggaagaaacataaagcactctattactattcttctaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagcgtgcacccgacatagagcaactgataaattagacattaaactcgcaccattac

SEQ ID NO: 71848 - DNA, 22177 bp, Oryza sativa
caggagtcaagtcttcaggcttagctcgcttttaccttttccgctgcatttgtaatcctttatgtttttgtaagacgtggatctgtatgtcaacaattgtcgtttgtgtaccctggctggtcctggataggggtttaatacacattcagcttagaaattctggttcgtgaatttctgggcgtgacagttgtacccaaaaagaaggcgaggactttttcgacacttattcaccggttgctcgcttgaccacgattcgagtactacttgctctggcagcctctcatggtctacttgtccatcagatgaatgttaagacagctttcctcaatggagagttggaggaggagatctatatggatcaaccagatgggtatgtactagaaggtcaggagggaatggtgtgcaagctgttgaagtccttgtatggtctcaaacaagcgcctaagcaatggcatgagaagtttgacaatacacttacatatgttggctttgttgtgaacgaagctgacaaatgtgtgtactatcgctatggtgggggagagggagtgatcttgtgtttatatgtcgatgacatattgatctttgggtccagccttaatgtgattgaggaggtcaaggactttctatccaaaagctttgaaatgaaggatttgggagtggctgatgttattcttcacattaaactactgagaggagatgagggtgggattacacttgtgcaatctcactatgtggacaaggtcctgagtcgctttggttatagtgactgcaaggcagctcctactccttttgatcctagtgtgctattaaggaaaaaccgaagaatagcaagggatcaattgagatactcccagattattggttcattgatgtacttagctagtgcaacgaggcctgcatctcatttgctgtgagcaagttgagccggtttgtttcaaatccgggagatgatcattggcatgctcttgaaagagtaatgtgctatctaaaagggacaatgagctttggagttcactacgctgggtacccaaaagtactggagggctatagtaattcaaactggatatctgatgctgattagataaaggccacaagtgggtatgtgttcacacttggaaggggcgccgtttcctggaagtcttgcaagcagaccatcttaacgaggtcaacaatggaagcagaactcgcatctttagatactgccacagttgaggccaaatggcttcgtgagctcctgatggacttgccggtggttgaaaaactagtaccagcaatcctgatgaactgtgataatcaaacagtgattattaaagtgaacagttcaaaggacaacatgaagtcatccaggcatgttaaaagaagactgaagtctgtcagaaagcagaaaaactccggagtgatagcattggactatgtccagatggctaaaaatttggcagatcagtttaccaaggggctaccacgtaatgtgatagactgtgcatcgagggagataggcttaagacccacttagagttgcacaatggtggaaacctgtccattgtgattggagatcccgtgaatttggatggcgaaacaaactattgggtaactgagagaagagacccaaaaatgagcttatcttcatgatgcacttctcttctaatctgtatggtaggatggtatacaccttaatgtgatccgagtggcttttcataaagcagagatgttggcctacagaacatcttagaaggaacacgcctatatgactccgactgctagtcacagtctatgagatctgggtgatctctagatactcatgaaaaggccaggagtatgacttatacgctccaaacagaggggatgcaaacgacagcccaataccagttaagggtttgagtgaaacctgaatcgcacaaaactgacaattacaaggcataatccattgttcagttatgatctggtgtaactcttttcctaggtggaagttcaacctaacagtctccatcaaaacactggtataactaacaggttcagttttgagaacatttcttgtgagccatgaaatttggtggggattgttgaaataaatgggctaggcctaatttaatttaattaaaatctcaagagcccacaagtaatgttagagagaataatactaccttgaaaaattaggtggaagaacctcaacttaaatagggtgatattggagattccctgttgaccggttgaggtgatggttggactgccacacgcatgcgcacgcgctgagtcggcctcggccatggacgtagcgaggcgaggcggccgaccgagccgagcctgcctgctgctcttccgtttccgttttgtaacaaacgagaatgaagtcaccattaaaaaatgaaattcacaacaaatgagagattcattgtgttgtaacctccacaacaaatgagagattgattgtgttgtaacatccacaacaaattagatttatttttgcggtaatggagatctctctctatatataacgcaaggcagaggctctcaaagtgtgtgtcttcctcctgtattgttccttagcgatactctcgttctgttcctgcgctgtctctttgtttccccggttctgttcatcccgtgcgcacgggtgatcggaatgagcaggtgcctccgaaactccgtccgcttgagaacctgcacgggtaagtgggcgatcaagtttttgggtagcgcttcaagcgcgactgctctgcatcatcttcactaacatgttgacaaccggcgacaacaacaacactagagacaaggagaaggagcttcccgtcaacaccaacggaggcaatactgtctcaaactccagcggagggccattctcagggtataacgtttcactcttaccgttcgttctttgtttcctacaactgtcggtcgcaatattattgtgttctcttgtctatgctgatgcttattctatattaagcatactcaagttgtatacatgtagcactgtcactatatctactaatattgcaaatgttatatttattgtcttaatattttggattaaaatatgccaaattatgactaaatttccaacaccaccgtcatttaggaaacttcaattctcgagttgtggagctaggttgagggtatttgattatttaatctttatagggttctgtagcgtgcactcagcccttaggacttaacatgacagtacatgagcaaatgggaaagcagtgaatttttgcatcaggctggctcaactaaatgattgttatgtccatttggttattaaaatagaattttctgttgtataccacctcacatgctattaagatacattttgatttacatagcaattatgtttctatgtgaaagaaactaaatatatatttggtcattttggtaactgttagtatctcaagcagtaccacccccattcacttcccacagataatcactctccactgtgtactccatttccttctttttgatctgctctgctcgcttaacttgcatggcatgttggctaacccagaattggcaactggaggggggcagttgctgttcagtggctgacttggctgaccgtaggtacacgtatctatagtcaactaataaacggtatacatctcttcatgctaaatgtatatccttttcatgacagaatttattcaagaacgaaatgaaatctgcctatagtcagtagcaactaaatttacatttttagcatgtaattaataatgtattgtttacaggattcgctcgaatgctactctcaagttgtgggcattcgctacaatgccattttcgctgtctgttgcatttgcaaaatactatttttcatctaaataattatttcttggccctttttgcccctcactgccatctctctctctaaaccacgcactcacaactgagaccgagccgagtgagaggataaaagggcaaagggaggggcaaccatgctggcgccgccgccttcccctaccatccacgacattgagggcggttagaatgaggagcaggcagcagcagttgcgatggcgcggctcggtgtggggaggcggcgcaaccgggaaggcggcggagcaggtggtgggcggccccggcgaggttggggaagaagaagcggcatggatggtgggttaaggcgacaccacggatggcgagaaaggcggcgcgaatagcgggggcaggtggcgcggtcaggaaggtggcggagtaggtggtgggcggcgccggcgaagttgaggaagaagaagcgacacggatggtgggggaaggcggcgacgcagatggcgggggaggtggcagcaccagtgtggtcgcctctcccttcgctaggggtgcaagtgggcctgtctgccacatcctgattttcactttaggattcataaattatttaataaattatttttagaatttatattaaatgttcattaatttacaagtaaagttaaatgtgggaaataaaatttcctaaatataaagtatggctggatttaatttttattaagttcgcattatactctctggaattttctttgattttttcggagctcaattcttaattttaataatacaaacaacatttaagtaattattcacatattaaattaatcattaaatggtctgattttaattttgttaaatacttatagtgttcaagtactttcaggattttttttgaaattatttgagcaatagaagtatttttaacaattcaaggatcatttcagtgattaatttaattggaaaagtaattaaaatccccttttccttttcgggccgaaactggaaaggttcacctttagttctcggcccattctccctccctttcggctggccttatccctcctccgaagtccatttcaggtccctccttcaatccggcctagtagaggatgctctcggagaaagtctgctttacgtccctcgctactgttcatcttcaacctcaggacagccgaactgagaccgagttggctcggtttttctcctccgaatccggccttatctctcgtgttttccgaaaattagttgaggggacttgtttccttatcctcctctatctctttccccaaaaatccggttttatccctttgaattcgacgcgaatttggattcgttttcgagtttatctctccaccaaaccctaggttttcccgacgcgattccttgcgttccaagcccgatatctctctcccgtggctataaatagaacccccaagctctcctctttcgtttccaacccctagctcgagctcccgtgccctagccgtctctccctgcgagtccctctctctccagcgccgccaccatctccagcagcgccgcgccgcctctctggtcaacgccgccttgagccgtcgcctccctcggcttcgcaagggtcagctctaccccggccaccggttcttttgcgccaaatcccgccgggagattgccgtcaccgtgaaccagtgggttgccgccttgttttgatctccggcgaagcctcctcatcgaccccaaggtcgccggacctcgccgcagcctccctcggcatcgcagctgcgaggagaaccccgtccacccctcggttgtcgtctcccgtcgctgaaactccgccgccaccatcgatcggtaccccgtcgtcactcccgatctcatcgccagccgtttttcatcgtcgtgccgcccctcagtgagttcccctcgtcgtgctctttcttctggtgcctcggcttggccgcctaaaccctccatcgccggcaatgatgtcgtcatgacattgttaatcctgttctgtataaggctaaaatcatatttatcttgtaaaattgataactaattcatatgaagtcggaattaagtggttcaagtctctaaattcatctaaaatcatgatctacatgtttgtctactttttatgtactgtttatttggtttttattagtctttttcttcgtttttcgtgttagcttgttgtttccgtcgttgcgaaggttcgtgagtgcgtcggaagtgttcaagaagattaattgaagaccgattattgcaaggcaagtcacacagatctcaaacaaccctttgagcatgttgaacctatctaaagctattgttttatttcaacttatgcattattttcgaatgtcatcgggtggtgagccattcccaattaattatggccgaagatgactttattttcctatgggtaataaattgattagcttggactttatatattggattggttcagctaaatgctatatatataattgcttagccataaatgagatgaatcacactacattgttacttatggttatatttaatggtagctcacgatggttaattgtgttatgataattaattgataattaaaacttgataatggtgggttgtgagcacatggttttgaaggtcgtgctcatgacaattaaggaacggttcacgagctattgttgtgaaatatttaccgtgccaagcacaagccagcgtgggcaacggatttacctttcgtatagcatggttcattgcggggcaccagactgagaagcggcgagaagtccatgagggtcgctggggagtccatgcctctggttgtagagggggtgattatgatccaggaatggtgcactgtggtgagttgtgttgtgcgaggggtactgtcacagttcctttccaaggtaccgtggtggtattgaggcgcatggtgacatgtcgtggagctgtgtcttgtgggtacagtggtgatacacctctggccagagtaaaactattcgaatagccgtgcccgcgatcatgggcaggttgaacaatgtttttcgtgattagtctcacacctctcacagtaattattgatgctataactggtaataatttgcttagctcctggtttggagttagatctatacagccgggtatggttgttcaggatggttgggcctgagcagcatgggtgtgctgttcagtgttgaataacattgattaattactctactatttttcaattctcaaatgtgagctaaatgctgctttcgcaaatgagtctatattatgccatcttttggtatccttgtgcacttgcatatttgctgtgtggcttgcagagtatgtcatatgctcaccttgcaataatcaatcaacctcagttgaagaaaaggatccagaagaagacgtttggcttataccccagttgagctgcctgtgggagtggagctgaagccatcgctagaccgttattccgctgctgattttcttttgttttgtaagtatgtaacgttattattatgatggatttctatattaaattgtcagtttgtgtacctcggctgattcctggacgaggattctatacacaaattagttcggaaattactagtgaatttctaggcgtgacattgtccacgaacccgcttataggcaaaattagtacgtaacctgcaggtttgaccaacgggttacctatcaatttgatctataaatgagttttcatatctatgatgcggtaaactggaccgacgcgaaaacccataaaatatgatttatttgacctataagtgaactcgcgggtcggcccgcttgcatccctaccctggcggggaagaagatgccagtaagcttcatttagttccttttttattcaacttcttttcaaatggatcttcagtaacatatcatatgatcatttgttttgaatggttcctctcttttttgacatgaagttgaaactttgaaaacaccctatggaaaaaggtaagattctgatctacagagggaactcaattgcaagctgatagaatgtacttacgaactgtgttctcttgtatattcatacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattctagcattaacattaatataaatgtgagaaatgctagaatgacttacattgtgaaacggaggaagtagatgacaagcctttactgcgactagattggtttttatggttcatgttatattaaggtttttgttacaacaaatttaggctcaatgattatttaacagcattttacgcattttacgcaatgtaatttaatatgtctgtttatttttttcccgttgcaatgcacgggcacccaactagtagagataccaaattaataatgtgaacacatgttggggaacatgttgttggatagacccaacatgagacaccgcaagagccatatgtgttgtgtcatcagtgatctcatttagtgttggtgttgaatccttagacctgagattatcatggttcccaacatgtgtagtagcttacttagagactgataaacgctactccgtaattgggtagttataaaagtagtttccgggtatgctgtgaaacatgtagtgtgatatgaataatcaagatgggatttgcccctcctatggagagatatctctgggcccctcgatgttgtagattatggaaatgcatggccatgccaaaggtgattgatgagtcaatcacaagttatataatctatcacaggttcgagtgaatgattgagcgattagaggatagcacatatctagccttgagcttaatcgatatcgtgaggcaaagtggatcatacaagtatacactagaggttcagccaatatgatctttatgtatgcccggtaggtcaatacgttctgctagggaccgctattgtcacgtggaccgaaaggagttttcgggttacagccgagtgtacatgaatctacagggtcgcacgcttaatgggccggaataaggggattggatggagatccaatatgagtttaattcggatagggattcaaataggagtcctatgggccttggaggcccgaatcatggatcctatatattcgtgaggggtgtgatcggcggaggtattgcatcatgtgagaaactctagccgccactcccctccccgagcaaaaccctagccgcgagcgggtgctagcacatctgcgcgtggcgttccgtccctgtacgtgtggataccggtagaggcgccgttggtttgcggtgctggtcgacgtgggagtacggcgaggagaacgcacgaggaggagaaggtcaagccggtgcgatcgactacttcctctacatcaacgcgcgctacttcgcgaaagttccttcgacttcttagcgctttcttccgctacgcagcgtgtcgagtggtaacgatttatgatctaatacttgcatggtttctggtttacgcggtagaaaattttgatttatgctatcgtagcctacgcgtattccatcaggttgtgcatcactgcctactccgctgatagctgctccacttccacgaccgtctctgaaccaacgcagctccacgccctcggctaatcatctggaacatctgcctgaaagcaaggtaatccctgtagatattgcgatctactaagacataagtgctaagcctaacatgatcaccctaatgcggaatttaggattactgaccgttgtttgaagccattgcaattgttctcgcttggtccggagtggatgtagaggatgcagaacctcgaaccacctcgcgaattgtcggtgtaggagaagtggtcgtagcagtgagtacaccggcttaatcccgaagaggtcgccggtgatcacctgcggggtggcggcggccttccggtcggcctaacatgatcaccctaatgcagaatttaggattactgaccgttgtttgaagccattgcaattgttctcgcttagtctggagtggatgtagagatgcagaacctcgaaccacctcgcgaattgtcggtgtaggagaagtggtcgtagtagtgagtacaccggcttgatcccgaagaggtcaccggtgatcacctgcggggtggcggcggccttccggtcaccacttacattgtcccggaacagcactacgaatcccttcctgcgcaactgagaatcgggaaattagggttttgggatgtcggggagattggaaccgtgagtgagattgtcaccttctcacgggccggcctccccttttattttgcactgagggaatcgggggctgctccaaaaggaaacgttggttgcgctaccgactattgcgcgtgcatttaaggaaatttaatcgtgagctaatcacgctggtcaacgggtggaaaacaggatcgcgtgattttctctcggtttccttagccgagagattatttcccaacaatcccttgatatcatcttgtcacatacaactatatatgtaaaaatgaaaattggatggtttgcattaggtcctttgaataaaccatgtttcttgttaggtcctgtagcataagttgtactttaattgtacttcaattgatctctgtgttgtgctttaattgtactttttattggaaagaacatgctaccacaatttttagtagatctaaaattttgagcattgtcaaatcgtgctacagatattggccttcatagactgttggcgctagatgtctgtgactttgatcaaacagagctcttgtttccaatgttactgatggcaaaattttattttattttattttttccttggcaggaactttgcaaaccattttcaagtttcagaagcttctgaagatatcattgtgtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctacgccgtcgctcgtagacaactccatcccgctcgccggcgtgcaccggcgatcaggagagcaggtctccggaacctctaccttcgatgtcctgcacggggagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttactatggctggttttgccgatgcactgaggccggataaattcaccggtgtgcactttaagagatggcagatcagggtcactctgtggttgacagctatgaaatgcttctgggtgagtactggcaaacctgaaggagttcttactgctgatcagcagaagcaattcgaggaagccactactctctttgtgggatgcattcttagcgttcttggcgatcgtctggtcgaggtgtatatgcatttgactgacgctaaggagttgtgggatgcactgaatactaaattcggtgctactgatgctggcaatgatctgtatatcatggagcagtttcaagactacaagatggctgacaaccgttctgtagtcgaacaggctcatgagatacaaaccatggctaaggaactcgaactccttaagtgtgtcttacccgacaaatttgtggccaggtgcattattgcgaaactacctccatcttggagaagtttcggtactgcactcaatcacaagagacaggaatactccgttgaggggttgatagcgtctcttgatgttgaggagaaagctcgggaaaaagatgctgcgtctaagggcgatggtgggcagtccagtgccaatgttgtgcacaaggcccagaacaagagcaaggggaaatacaaagctcaatagaccaccaacttcaagaagcagaagaagaacaataacaatcctaatcaggatgagaggacttgctttgtgtgtggccaacctggtcatctggctaggaagtgtccacaacgcaaggggatgaaggcacctgtagggcagacttctaagtctgctaatgtgaccattggcaacactggagatggaagcgggtatggtaatttacctactattttttcagttaattagtctactaattggtgggtttatactggggccaatgtacatgtttgtgctgacatctcattgttttcttcttatcaggtcgcacgaggttccaccgtcctaatggggaatgggtcatatgcttctgttcatggtattggcacggtagatctgaagtttacttcaggaaagatcgtctagctgaagaacatgcagcatgtctcttctatagataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaattgaagcaacctcgcaagcctcataaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaggcatggtggggggaggcattgttgacctcgaatcatgtgttaaacagagttcctaatagaaataaggacaaaacaccatatgagatatggattgggagaaaaccatcactttcttatttgcgcacatgggggtgcttggcgaaagtcaatgtaccaataacgaagaagcgcaaactgggacctgagattatggactgtgtctttctgggatatgctcatcacagcattgcctatagatttttaatagttaaatctgatgtacctgacatgcatgttggtacaattatgtagtctcgtgatgctaccttctttgagagctttttcccaatgaaggatacacatagtagttcgagccaaccctctgaaataattcccagttcgatcacaccaccagaacaaactaaacatacacacgaacatgtcactaaggaggatgtcagtgaagctcctcgaaggagtaagagacaaaggacggctaaatcctttggtgatgatttcactgtgtaccacgtggatgacactcctaagtcaatttcagaagcatatgcatctcctgatgtagactactggaaggaggctgtccgtagtgaaatggattccattatcgctaacgggacttgggaggtgacagagtggccctatgggtgtaaacctgtagggtgcaagtgggtgttcaaaaagaagctcaggcctgacggtactattgaaaagtataaggctcggcttgttgctaagggctatactcagaaagaaggcgaagatttctttgacacttactcatctgttgctagattgaccacaattcgtgtgctaccttccctagcagcctcacatggtcttctcgttcatcaaatggacgttaagacagattttcttaatggagagctggatgaggagatctatatggatcaacctgatgggtttgtagttgaaggtcaagaaggcaaagtgtacaaattattgaagtctttgtatggtctgaaacaagctccaaagcaatggcatgagaaatttgacaaaacattgacatctgcaggctttgcagtcaatgaggcagataaatgtgtgtaccatcaccatggtgggggtgagggagttattctgtgcttgtatgttgattacatactgatatttgggacaaaccttgaggtgataaatgaggttaaatcattcttgtctcaaaattttgatatgaaggatttggaagtagctgatgttatcttaaacattaagctaattagaggtgagaatgggattacactcttgtagtccccttatgtggagaagatcttgaatcgctttggctacattgatagtaagccttctccaacaccttatgatcctagcttgttgcttcgcaagaacaaaagaattgctaggaattaactggaatactcccaaatcattggctcgctgatgtacctggctagtgcaactaggcctgatatctcctttgctgtgagcaagttgagccggtttacctctaatccgggagatgatcactagcgtgcgcttgagcgagtaatgtgctatctgaaaggtactatagaattggggcttcactatactgggtatcctgcggtactggagggttatagtgattctaactggatctctgatgtggatgagatcaaagccactagtggatatgtcttcacactgggtggtggtgctgtttcgtggaggtcttgcaaacagatcattttgacgaggtcaaccatgaaagcagaactgacggcactggatactgctactgttgaggcagaatggctgcgtgatctactaatggatctgcctattgttgaaaaaccggtgccggctatccttatgaactatgacaatcaaacggtaattgtaaaagtgaatagttctaatgataatatgaaatcgtctagacatgtgaaaagacgattgaagtctgttaggaaattgagaaactccggggttataatgttagattacatccaaactgctagaaacctggcagatcccttcacgaagggactatcacgaaatgtgatagacaatgcatcgaaggagatgggtttgagacccatgtgagttatacaatggtggtaacccagtctatgtgatcggagatcccgtgaattagaacctgggaagaacaaaccattagtaaactagaggagagtaccaatctataccctctctaagtgaagatgcatgtactctcgtgagctgcaaggtaggttggttatggcttaatgagttctgttggctttaattagcgaagatgttatcctgcagagcattcttgaaagaactcacctttgtaagcttgactattgatcgcagtctatggagattttgggtgaatcttctaggaagcttactaaagacctaggagtatgacttatacgctccacccgaggggtagtctacagacggtatagtactagataagactctgagtgaaacttgcttgcacgagacttgcaattcaaggcgtagtccattgttcaagttgtgagtaagtgtagtttggagttctaggtggatgttcaaccttaatcggtctccatcgaaccgctggtatataaacagtacatttgaaaaggcaaatctcagtgggattttgagatttggtgggggattgttggaattaatagatgggctaagacccattcgaagattaattatttggaaaatcacaaaagcccacctcatgggatggcatgcatgtggagtttaggaccaccttgcttattctaggagaggaggacctccttaaaagggaggatgccctcctagccacttgaagcatgtgtggtggagagaagagggggaacacacgcgctcgcctcgcctcgcctggcagggaagggcaggcgcgtcgtgctcctcatccttgcgcagatgcagcctccttttgcagttttgttttgctgcggaaaattcggatttgtttttgttttggaaacattccgaaaaatccggtgcgtgaaaacggcgtgaagtccggataagttacgcgcgacttatccggttcggttacacggagtagagatcgtgcgggcgccctgatcaagcgacctatctctatataaaccgagccgccgccttcacgtaacatacgcgaaatcaatctaggatttgcctcctactctgtgctgcgccgtcgctcgtagactactccatcccgctcgccggcgtgcaccagcgatcgggagagcaggtctccggaacctctgccttcgacgtcctgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagtgtattattcctaatggtatatattacaattgtctatcagaattacgatggtggcatattcaataagatcgttgcttgaggagagaactgggagaatccaaaggttcctaacgaataagttagcttgttttttatttactaagataggcatatggttgcctggtagtgatgatggttttgatgggtaggttttctctaagatggaagacattaatgctccataagcacgatgcaatagtattgtatctaatttagttcttaacgatgatgtcgatgctaaggctccagaacataatttatttatttagatttttttctttcttttacgtttttgtgcttaatacttgtgatcttgtttgaacataatgtcagaaaacttttgaaacatatattgttacttttggttgtttgctttacattataaataatgtcgtagcgttagcacggacatattactagtaaaataagtttaactaagtggaagaaacataaagcactctattactattcttctaatatacactcaaatcttagtttacatctgctaatatacaatcatgtggccaataccccctaacagtgtcctcctggtacttcgagagaccacctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagccgtgcacccgacatagagcaactgataaattagacattaaactcgcaccattacacctctctggtaggctacccacacaattcatataatgcagatataaagtaagaccagtactaagactaagcaaagcacgaagatatataaagaagagtatttcattaatacggaaagtattacagaagagattacaagagctgctagagccataccgaaaactcttccgaagactccgaggactccgaacactattctatactactacacttagcattataccactaatactaatgtatgaagaggaattgagcttgcttgagtgtgttgagaagtgaagtgaactcctccttttatagggtcggtatgacggttactgatatgcgaaatgtcgattttacccctgtaaccatcatcagcaagcaatcttggatatccacgtgtaaggctaggctgattggacgccgccagggttcggccgaacctgggctggcccaacaggcctccagcttcggcagggtggctgacaggtgggacctcatggcgattttggcagttaaggctgtttccggcggttacacttgacatgtgggccctccgtatccatttgcttgtttaggagtgaggttttctccaatttctctttattttatttgataaattcctgcaacatgttattctccaagtacaagtggaaatatattatttgaaaacaaacatgcattgtaagcatagctaattcttcattattttagttctattggcagtcaaatattgtctgtaacaaccgtcaacgaaacccccaagcttaaacctttgctcgtcccaagtaaaggacgaaaggaaaataaacttggttgttgatcaggagttgctaccattgttatatttaaaatgtacaagtgcatagtttgagtactctctctctcatgttaagtaaatgtgcacggaggcttacccttacgcctaaaaattgtagaacacccgcttctcaccaccttaggcaattgagagacagaacagatcaactggagcagggaactttatactttgtaaccattgcctactcataggttgcacaggagaaactttaattttactagatgctagggcgcgccattgcgcgctgcctgcatacactaaaatacgtccatgtactaaatcaatcaattgataaatatattagtaacatcatatattctatattaactctcctgtgtatatcaatgacaccagacttgagtcagtaatccattctatgtaacaaatatcccatgtaactacaaagtaatgggcactttattatcaatgcaaagcatcccctactaaaacctcagtttgttacactattagttcaaacatgaacacaatgctttcattatataaaaaatataagtaattccgcgtacaaattgctttggtacatacaccaagagaatgcattggtgtcataaataattgatgacaaatttaaaggtcataatctttgcaaataggacaattgaagaacaaagggctcgactttccaatattagattcagcatcgcatcacatcctgaaaaatgtaaacaggttgaaatgaaagcaaacattagctaattaaatcacattcaaaagaacctgcagacctgcaggtacatactaataccctaatagtaacatcttatcatagtgcgcacacactaagggaaaaaaggacaaccttgtttctaggcctatcagtgctagaggaacattgatccatggatgtatttttatgaggtagcagcaatatataggagtattttgcaaaatcacattcatcaagttataaaccaaaaaaaaaaaggattttacccttgaagtaatgccattctatcttctcacagctgcagttttgtagccatatacaggatagtgtaagtggagccaaaattgtagcatatctattgtgtcatttgtggaattactaatattagtatccttcaagctgaaagtgagaaaagcataagtaacttaataactaataagtctccaaaggctcatccatcttttactaatataaaaaaacatagtggcggtgatggtagcattctatgatgaataatattgtactatctttttggtaaatgagtgaatcattccattagatactcatctgtatatgcatgaggccatttcatttaacgtgaactcataaggaaatattttagatttggggataccattttttttctagtttagaacttttgatatatttatgacaaccatcgacaaaatactgatttcaaccaagtataacttcccaattttttgctgaaaactaatcaacgtctagcataagatgcagggatacgcaaacatgatttacatatttataaaaatagtcatgtgcagagcacccacacaataccaagtgaccgctggcccttttgaaagcatgaaagagcagggaaaatagatggctaaatccacaatatatacatgcattttttgcgaggattatatacatgtaatccatacacctttcttaaatgaaatacataaacaacttgcaaaccaaaaataaaagcacaaagggacgcttaaatacataaaaagaagatatattgacatttaaaagaaatcttaatcgtatgagtaaaagctagagaaatactacct

SEQ ID NO: 71849 - DNA, 12816 bp, Oryza sativa
aatatcgggtctagtacctggactagcctcatcaaaagaaacctcgcaagtctccacgattttgttagtccccaaaataagtacacgatagccacgagtatgtgcggggtaaccaagaaacaatccatcggtagaacgtgcctcaaacttatccaaatttccagatttcaagacaaagcacttacaaccaaaaacacgcaaatgtgaaactttgggttgatgaccaaatcgaagttcataagaagtttttctaagtttagatctcaagaaaactcgatttgaaatataacaagcaatgttaatcgcctcagcccaaaattttcttggagttttatactcatccaacatcgttctagccatctcaaccaaaacacgatttttcctttcaacaacaccattttgttgaggaacacgaggaaaagaaaattcatgttcaagacctctttcgttgcaaaattgttcaaaagaagcatttttaaattcaccaccattatcacttcgaattcttttcaaagaaccaggaaattcaagatccaatcgaagaaacaaaccacgaaagtgttgaaaagcttcgtccttagttgccataaagaaaacccaagaatatcgagaaaaatcgtcaacaataaccaacacataccactttcctccaacagattgcactctagctggaccaacagtgtccatatgtaatagctgtcccggtgcatctgtcatcacagaaacaataggagcatgtgaagtagaaaccatcttagcattacgacacggtgtacaaaccaaatcaagatctttcttaagtttaggcaaaccacgaacaagatccaaaccacttaacctagtgagataatcaaaaccaacatgtccaagtctacgatgccaaaacatcacatgtttatcaaacttagcaaccaaacatgttatcacaggtgaaacaggattttcaaaatcagctttaaacactcttccatagcgagaaatattcaacacagaatcaccacaagaatcaaaaactttacttccagttttcttaaagtgaacctcaaaattttcatcaacaatttgtgaaactgaaagcaaattgtattttaagtcctcaaccaaagctacattctttaattcaaattttttatttactttaaccaaacctgtagcgagaacggcacttgtagcagcatcaccaaagataatcgattcagtcttggatgccttctttagggaggagaaccaatttttatcaccggtcatatgccgcgaacaaccggaatccacgatccacacgttctccttctttgccaccaaagcctacacacaagcagaagtcgaaccctcagtactggggttagatgataataaaaatttagaaatccagtactgagacacacgaccagaagatccaataggcatatatccacgtgcaaaatcaattttagaattttcagaaaaattcctctgaggccggtctgatcgaggtacagtggctggtctgaccgagggtattcagccggtctgaccgcgggacccactgcggtttgaccggtttcctcgagggaaaacccgatttttgccactttgattttgcaaaagcaatttctctctcctttttctgtttacgagctaatctgaaacaaaaaccaacaatatgtccatctttgccacaaaaagaacaagtatatttttcacgatgattagacacattgatagcattagaagatttagcaacacaagcaacaacaggagattttccatgcacaacattggattttgaagaagatgcactcatagtagacatgataccagcagatttaaacacagttttgttagtatcaggtttaaccaaaatctcaccacttctagcaccagcacctaacacaacaggaggatgtctagaattatgagcataaggattaaaacctaaaccacggttatgtgtgctaacctttgattgatccaaaatcatgttgaggttctttttaccatcagaaaatcttagcaaagaatttttcaagtaagaaatctctttttccaaattagcacaattttcacaatctaccatgacacctttgcttttacgacatttagggcaagaaagcacttcattgtttttcacaatatcttccatgtactcaacacgacctaaagcatcttttagtttcatcttattcaaattacatgttgagcaatccaaaacatcatgaggttgttttaactttttagccgaaatcatgttaaacatcaaactagcatgaaaagcaatttgatatttttgcaacaattttttggttaaaaacaactcatccaaagtgcgtgtatgcaaaacaaaactacaagcaagagaagatctatttttcaaatcatgtgcagcattaacatctctaatttttgaaatctcattcattaaaacctcacaattttcacaatcatcatcattaggaataagagattttaacctatcaatttcaaatttaagagatttaatgataaattcctgttttctatacatcttctcacacttcttattttttgcactcaaaatattaatagcttcctcaaaagcactcacctcattatcttcatactctatatcagatttaccacgcgccatgaagcaaacatcggagacgttatttcccttatcatcatctccactttcaccatctatatcacttagtggctcgaagacggcgcaaacttgttgaaaagccttcctaagattctccatcttcctcccttggtaagaacccttcgacttgttgttgttgggcttgttgttgttggtcttctcactatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaagccaaatcctcctcctcgatttgttcgagttgatcatcggatgtggcattaaaaacagcaagaaaagaggacttagatgaagaagcatcaacatccaaagaggaagaagaagaaaccaacgcactagacttagaattagcttttcgagaaagaacattcatctcatgtgttttcaattttgtataaagtgaatccaaagtcaaagtagacatgttaacagactcctgaatagatgtaactttcatctcccaaatagacatgtcgagaccattaaaaaagtgacgagaaatctcagattgtggataattagcatcataaaaagaatcaacagatctaagatcactcaaaattttattaaaccgagaaagatagtcatccaaagcttcttcaggtttcatctcaaatttaatatactcctttttgaaaagatctcgacgaagctctttaatgttatttgttccttgatgaaaattactcaaagcaacccaaatctcatgagcagtttgaagatgagcaatacgatcataatccgaacgagaaataccactcaaaagaatgttacgagctttgcaattttgttcaaaagcagttttttcagcagtagtattaatagcttcaggaatcacataagcattagaaacttttctccaaatatcataatcttcagccataatgtaagattgcatcctactacaccaatgagaaaaatctgttccatcgaaaacatgaggcttagttgaaaacctagcgggagtagccatggcaaaaactctatatcgataaaaatctaaagaagaaaacaaggctctgataccacttgtaggatcgaatcacaagaactaagccaaccagaggggggtgaatggttggtatacccaaaaaccgaaaacttttagcggaaataaaagttatcctcgaaatcgatggatcgcggtctgactgaagtagttgcaccggtctgaccacctgatgaacgtcggtctgaccgatgtagatcgattggtcgaacagcctgccgcgcctgtcgccgctgccggtctgaccaccgtgtacccgccggtctgaccatcggtagatcgccggttaaaccgccgaaatccggtaaacacaaatcgaagaactcttaaagtggatgacgactttattgattctctctgtgtttacaaagtgcaccaacaacactccttacaaaaatttctgactaaactcgaaaccctaactcaaaactcaactcaattgctctctaaagcgataccgggaagcctcacgctccccctctatttatacatgaggtaggcagcctaaagccacgaaccatactcatactaggagtcctaaacaccttaggaaaccctctagtacaagaaagaaactttacataaccaatcgtaccaaatttggactccttccaaattcgactccgcatcccatatgcacacaataactccatcgtatgccatatggaatctccatcaaccacgtgcatcaactctagccttagtatcccacatgatctctgaccaccacggacgtcgtcttatccccaagtcgactcccggtccatcaccgcaaatactctcccgagacatcgagtcacctacacatggaacaaacaaagaaaccatattccgagaccaagctatctccaacttgactcattagcagcaaataatagtattacatacgtatagtatccatctaaaagtcataatcatgaaataaactcggatatccaaataaacaacccgaaaccgaaaccgacacagtgtcggtcggtcagaccgtgggctggccggtccgaccactcaatcaccgccggtccgaccggctaccagagcccagtctgaccggtcacatgaaataataaacctgcgatcacctgtgaaatccaatcatctccaaaaccacttcgtgaataaattccaaataacaaaaccaataatctccaatgcccaattgttcatcacagaatagtaataaaaaactcctttgattttacactattgaccgacgtacatgtcccttcttcttttatgtgttcatcatcgtcaaccattcgtgacatggccacatgtcagccagtaccctccatattttaatgtatgacgtcgttgacttttcgaccaacgtttgaccattcgttttatttaaaatttttgtgtaaatatgaaaatatttatgtcatgcttaaagaacatttgattatgaatcaaattacaataaaataaatgataattacataaattttttgaataagacgaataatcaaacattggacaaaaagtcaccggcgttatacattaaaatatggaggaagtacaaaacaaaacacctccgagggatttttagcacaaatgagcagttttaactggatcaaattgacatgtggttccaaaatgacatcatggtgaaagttcttcaaaaatggcatgtggttatttgaaacgatcgtcatctttgtgggtagaatgcatgcttggcttcgaggctaataagtagagacgattggttaaatatactactttttgtgtatatttgtctattcgccctccttttcttatcgaactctattagtctccatttggttgtttcattagaatgtaaaactgtttggattagagaaacttccttgccaatgcagactgaactaatagtggtgagatgccacactctcgcatctagagttttgaagaaaaaaaaatgtgatccatttggaaaaccggtaaccagataaaagtttcaatccaaattatttaataataaaaaacggttgcaagaggaagttcatatcttcagtggcggagctagaaaatttatatcttggatcaattatcattactgaatatttcagtgggatcatttatgcaaatttgaatggatttatatggaaaataaaacaaaagattctcaaaggtgattgtgaaaacgctatgggatcaaccggcccgacatcataatatggattcaccactgcatatattcttgtggaatatatacattattatatctaatcttactgtttcaccaaacatcgattgggctagcctcgaactaaaggtgacaagcgcacaactccattttttttcaatcatttttcctttttcgccactgactgtgtgtgccacctttttcttttgttttcttaattactccttttctccattataaatgtactactacctatgtagtgcgattttatatttaaatttgacttattgcagatggtacgccgacggatctcgaccaataatcggcaggatttccatcccacagctcgcatctgtataatctgcatatcttataggtgtagtatgtaggaatttaaaatgtgctgcatttaatttctacgtttttcactttcctgcattttgtacaaccagtgtgctctaaaaaaaaaactactgttcctgctttgcggaatcacataatgtaatgcaagatgggttcgtcgttcggcgaacatagtagcacacaggaaggtgtttcaaacaattgtatcacgaccaggatttctgtccaccgggttttcttttgtcttgctagtagacgattgtaaagagtttgagtgactcctagctttggtgtgtaaccctaaacataatacatatggctcaatgttgttgcatactctctccgtcccataaaaaactaacctagtattagatgtgacacattatagtactacaaatctggagataccactgtccagatttactgtactaaaatatgtcatatccagtcttagacattttttcgggatggagggagtatgttgccatgctacacgcacgaccaatataaatgtgtgtatttgactctcctggtcggttagtaactatgctactgtaacaatattttagtattcttatgcatgcacctgaatagtactagcaatcagattgattcatgtacatatgggccccatacaaaggacgtacacgtgatggagtatttccaccgcgcatcacacaatggcttctgcatgtctgcgcccgtgtggaggagggtgcatgcgtactgcggtgccttgcaggggagcgcacggcgacgggatcttcgtaggtatcgcgccgatcccgtcgcgatggcggatggtgtaccgatgtatagcattcctaattcaaaatagcgcaatgaccacgatgaataactcattatggatagtttgattcttggaaccaaacaatgcttccacacgccactagcccactagctctaggtgtctccctccttactcttaactattacttccctgcgcgtcgctccaaggcaaggggcgacacgggaggcgattcttcccccccccccccaccaccccaccacacctcctcctcccccgcctcaccaccgctagagcagccgccggaaaccgtgcggctgcaaggacggcggctgcggggcctcaccccttctccatggaggccacggaggtcggcacccacgaccagtctggggacgacggcggccgcgaggggggtgagctggagctggcgcgcctcgtcgaggtcgggacgcctgcggcgaggagggatgcagtttggcgaggaggggagaccgcgacggtcgtggtggctggctggtgccggcgtcaagctagagggctgccggcatacctccttggcgtggcagtggctaggcgccgtggccggcgatgggtgacgccagggtggtgtgggaagcagcggatccggagtcccctaggccggatccggccatcctcgcatagatctggcgtagcagcggtgcgacgcggcttgtggcggctcggcggcgtttgcgcggcagcaaggcgtgcggccggcctggaggtgagtggcggcggcgtgcgccgagccgggcggcggcggaggcggctcggaggttggaagcggcggtgacggcgacggctcgggggcgtggcctgccccggcggtgtggcccaccccatggtgctggcggtggtgctgcccgggggcggtgcgctgctgtgctgcctggccgctcggcggtcggtgcagccctttggcgcggctaggcctcggcagccgggaagccgtcacggtgaccttaaagcgggcgccggagccagggcggccgcgtttccggtgtcggcgcaggcccagatggtagtgcaaagggagctggcagcggtgggtcgtctttctcgttgccggtcggcaccctcacccttcctagagctcctccccttctttgcggggagtttctaggctggattgaggggccagcttgtcagcgggggaagctcaggctgccgaagcaatgccacctagtccagtgttctccttcggccagatctagcgaagaggccggcgggtggtggaacggaagggtcctgggccagctctcagcgatggtggtttgatgaagtcgaccgacggcggggcgtcggtgcggtgtggtggcagtcttgttgttggcaggattggatgctggctggcggatgggcgtcggtcgggtgtggcggaagccatgtgtcctcggtcggattgggcgacggaccacggcggtaggggttccgagcgagagcttagcccaatttctttgggacaaaagtgactacaccttcgggtgtggtaactctcctgagggcattgttgaggtacccctcctcccgcggcaaggagctctgggtgaaaacctagtccagttttttggacggatgatgacggcgtctttcggcgttacgaccctcgtgaaggcgtcgtttttgagtcttcgtgtcatggtggtgttgttggcccggtggcgatcggtctagcatagtgatggtcggttcgatgcttagcttctctctctgtagcgtgtgtttggtcggttggcacatggtttggagcgtgctctggtgcacatccttcctcgacagccagccgtcgatgtaaaactttccttgtaacatttttctccctatcttaattatattgaatgacctcctttggtcattccggcaaaaaaaaaaaaaactattacttccccatcctaaaatatagcaacctaatattggatttaatataacctattactataaatctaaatgggatatacttaggttcgtagtttgagattatatctaatccggtactaggttattattatattttagaatagatgaagtattagatagtctttgcctctccttaccgtcaatcctccctacttacccattggcattcagctgtcagcacagcttagcatccttgaagtgaaagtaggtggctccaaatcagccggacagcgacttcaactgataaggtacatttgtgaaaattacaccaagactaccaactgattgacctttagcctcacatactctacatgcagtaatcaagtattaactgtattatgtgtctaattatggatttatgttaatgtaaaaaactgcgtggtcaagttatgcctgattgacttaaaaaaaagtctgaattgataatagcacttatatttatgacaacgaatacatacgctgaagctagctcaaactgaattctacactagataaattattttcatgaaatgtgcattaagcttagcagatgaacaaaaaccacctctactgaaggttggatggatcatggctggagtgattaatcaagactgttgcaggagtcaaacggaggatgatatcagactgattacaagtttctttgtgtggtccagttcctggattattagttacccttcaagcaaatggcattcaaatcaaacgggaaccattttcagatagctcaatctttttgcatcgtatattgacgtcgcattcacctttttattccatgatttgacagaatgagtgtttctgtttctattgttacaagattcaggcattccgcacacatcgtggataattatttatcaacacactataagtttacaactcgatgacaattggtgagcttgtcagatcaacaatcctagccatttcgccgcctccttttctcccaagacgacgagcaattggggtaaccaagtttatcacatctttctcaaggaagagaggagcagggccactctcatctgacgatgaactcctcccaacatatggaaatggagacgaaatctgtcctgacacaccgtctagtattcttccaccctcatcatcactggacaaacccgacgaacatcgaggcgatgttgccgatccgtccgattcccttgtcgtctcatgaattccactccatgacatgtaaccaagctcatcagtggaacattcagcatcactaactgcagaggctgcagttctggtttcatgttccaatggttgtgcttcaaacaatgggttgtcttcttgtcccatccactcatcatgttccgatgattcgtccaatcctcttgcttctgctgctccaaacacactccaatcgatcggagcgaaatcgtcgtaatccgattcattgcctgcatttctaatttcttcttcaggcaattgaaccaaaccatgctctgaaactgaaagttcgtctcttgcaggcgcatgcgcatcatcaggttcttgatgattcttcttcggaggcggctcgtcgacgttgttatcctcctcagaggaaacaccatcggtgcagtactggagatcctccagcgagcagacggccgtcttcatgtggcccggcagcggcgggcagccggcggcgaacttggtgttcttggtggagaagaagttcaccgtcaggttcagactgaacaaacacaatattcagcaacaacaacaacaaaaaaacattcagctacagtttggttgcattcagttcagagacagccatgatcgcgaagaacaaagtaaggaaaacttacttctcccaggaggggaggttgagcatggtgtaggcgagcttgaccttgctgccgacgccgccgagcgacttgaagctcgcggcggccttgcgcacggccagcgattccgtcgggtgctgccacgcccactcgaactgaaatcacaccataagattttaatttgagcaagaaaacattggcaaagacaagaacaagaacaagaacagctacacctatctccatgattgatctcccccaaaagacaaatgattggattggatcggattttggctggattacctggagggcggcgacgttggtggggaagccgtagatgcagaggaccatctcccatgggcggccgcgcttggtctgccacgcgccgcaccggatctcgccgttgtgctgccggatccgccgccgcgggttcaccgtgaacctgccatgccagccatccaatcccacgtcaatcgcaagaagaagaagaaggaagaaaaccgcggcggcggaatcgcgagacgagacgaggagccgcgtcggatgtcgtacccgatgtaggtggagcccttgcggcgcgggcagagggaccggagcaggtagcagcagaagaacctccctcctcctcctccgccgcggccgccttcctccgccgccgccgccttgcgtggcctcttcttacccttggccgcctccgccgcccctcctcctccgcggcaggcttcctcctgcccgtccacggcctctgccgccgccttgcgtggcctcctctttccattggccgccgccgccgccgccattccgccggtgtgatgtgatgtggtgtgatttgctccgctctcgttgattttgaccgttggaatctgtctgggggaaaggggaaagagccgttggcggatgcggggggcaggacacttgtccatatatgggccgggccgtgttaagttgggcttacgaggtttcggccctgatcgaaatgttttcttgtgggacaaaaagttttattcgtattgcaccctcctttttttctgataaaaaacaccgttaacttccaaacacatgtttaactatttgtctaatttagaaagtttatgcaaatgtataagtgtcgacgagtgatactcgcggaccggatgagttgagtattagagtacgttggaacgagagtttacgtagtatgacatcaagtagacaaaagataaagattatactggctcagaccccttgtcaggtaatagccttaatccagtttatatgggattgatgatgatgagaacagattacaaaggaagtagacgaaacagatggtaccgatgggatcgtagtcgatgagcttgacgagatctcctggcgacttggctccgcgtactccggcatcgtaaactatgatgggtgtgttggcggtgaaattcgatgccttacactcctccctgggggtctctttaataccgtggatcatgttgaccccctaagaaagatctaagaatatttgatctgataatctgatacagtataacagaaatcatatcccctccaagtaagactttggaaatcgcttatcgcttaattcgtagagatattttccataacttaggacggattcctaacggcgtacatatataaagacgatccgtgtacgtgaaagtataccttatcggtatattccataagtcgtaggatagaaggtataccttatccataaccctgacaataaggtataagtagaaaaactcacaacaaaattaataattaattataattacatatttttttaataaaataaatagtcaaatatgtgataacaaagtaaatggtgtcatctattaaaaaagaagatataattactttagcagctgtgatatcgggcgtacctcaacatactcatccaagccccttctcacaaaaaaaaagaaaaaaaaagaaaaatactactcctcgaaacttgtaaaacaaaacaacttattcgtacctgattaattaaatattagttcaagaagatttgaaaaatatattaatataatattttaaaacaactttcttatataattttttttaaaaaaacatatcgtttagcaattcagaaaagctagcgcgtgaaaaatgagagtagaagttgaaa

SEQ ID NO: 71850 - DNA, 44349 bp, Oryza sativa
aaaagggctaataaactaattaatggatatatgtttgtattattaaaaagtaaccatagtaaacatagataaatgatggcccaaatgaatttccatgtatgtttaggatggattttgtgcgaatctgtgtttaccatgttatgccattgttgttataggtaaaacaatgtagagatagatttaaagaggtcgggggcgaaaataaataacagttggaatatgagttaagaaaagtgctcagttaatttatccttcgatataaacgacataaaaagtgcttttatttttaaagtaagggtagttttttttattttggtttcattttttaatatctaagttaataagatatccgtgtaatgtttagctgtgctatgtataactgcattttttttgcatttttttatcattgtgggtaacagttgtcgttgtatttgcgcaggagataatgatattagattgcatgtaaaaacatggatctatggttagattacctagtaaaagatgacttgcgtgcaataactccaagatcttgcaatagacgaatttttacatcctgcgacataaaaaatatgatttgtcacttatctgtaagttgaaaggtaataatagaaaagggtaaaaagaagaacaacaaattatattagcgttaagataagaggctgtgagatggagtaatgatttatgggcttggtttggcaagggtagatctgtgagtgggaaagcgaagggagggattggagagatgcttaaagaagcgattaatcagtgttcagtgttgattttggtgatggtgttacgggtgttgtgattttaagcagatgagaaggatggcttgccgcggtagctgaagtagcgttggaggtaggggttggaggaagaactcactatttttttttttggagtgcgatggctggcgaaagagacttttcggagaagagatttcggatgcggtggagatgaatgggaagaggtgaggttgcgggcgttgctgttggtggaagagatgagaggagcatatactccctccgtccaaaaaaaactcaattcctgtgtttccgtgtctaacgtttaaccgttcgtcttatttgaaaaatttatgaaaaaaattaaaaagataagtcatgcataaagtattattcatgttttatcatctaacaataataaaaatactaatcataaaaaaatttcatataaaacggacggtcaaacgttggatacgaaaaccgaagaattcgttctttttgggacggagggagtaagatttatgtggatatggagaaggagaaggtaacggataaggataaggaatcgaatatttttttagaaaaataacatctgctgcgtgatttcgatgcagaggaccggtgggtgcattgatggccatattggtcagagtataaactaatttgtgcagttctaaatccgtcctaaaatatagaaaattttaattccttatctattgcatgattagttgtatttttgttttgcatttaggaaattctgttataggatgccgtgattttatggttctaattgcaacttactgtacaaagtttttttgggaaggcattttttaaattagaagtctgcttatgaacattacatctatcagtataatagtttcttattaaataaggaaaataaattttgggaaatgttggaaacatccttaaagtcaaatgttagttttttttattctctctttttatacaattcagttatcaacacgaccacacatcctaataatttgctggtacttagtggtttttattatttcacgagtgccttcttcgatttgaggtggatgagcaattgctacgagtatgtggttgagttgtttattgtacgtgttgaagtcgaacttgacgggtatgcgcattggttttaattaaatatattattttttgagacaatgattttaaaaatggcataaaaatcatccgaacgtgagaaaggggcatgacattattggaggtcatctgatgattgattaacttgacgttaggaagcgcttttatatgtgattattgtctgtggcgaaagtgacagtcaagggaatggcgttagtaagtagcgtgggaagagggaataaagagagaggataggtgggagagttagcaagcaagacaggtgaatatttctgacaactaatatgtttcttaggctgtatttaattgggtattattattttaatggatatggtgtttattaattaatgtataatctttaatattgtattgttttagaaggtgattagcaaacacatttgcaatgtagatgcaaaatagtagtggaacatggggttctgcatatttgtattgtagatgcaaaagtagatgagaaaaaaatatcccgaacaatgcttctctcacatccacatttcacattcacattaggtgcacgaaaagttgaaagccaaaacaaacctctacgtacttggtaaaatttcctactgtttctatagctaaaactgcttactgcagcgataacactaactaacataactaagaaacagagacacaaagataatagaagttgaatgtagaataagcatatcatctttgttccagataaaatggttaaactctacaggcactctcagtagcttataaataaacaagctactgaaaatagagaatgaccttcagaaacagaaacaaaactccctctcccattgtcacatccattggcatgttcaccccttgcattcttgaacctcttgatcgtccctctccatggttctgctgaacaagaagtcaattaattaagctccatgacatgttaaagctagctcaccgaagccatgtttagaagataccaacatgtcacgtgtgaatcagttagagaccatgatttataatagcaaagcattttgcattgataggatcagtgaatgtgcattgcagaatgccagtatgcaagaaaaaatagggacaaaaaaaccgtactgtactgcttaacaccttccccagaacaaaatgattttagaaagatttaataattatcaaagttagtacatgtgcttcaatgtgtgcctttttgttttcctatatcagtcattttagagtgtggggagttcatgcatgtactcattcactattttatcccaggtgagaaaccatatctgaacacacacttgaacaaagttagataactatttatcgggaaattgatgtactcaatcactgttatgaaaagcaagaaatcactttgaaacttaattcaagtaaaaaaagttctatgttgaatactttaacttggctttacacatcctaaaagttcaacaactatttgaacatatatcacaaaaagaactcgttgtaattttattgctgaaatatcaccttgtcaagtaagaaatgccgtaaaagtccatggatgacgtgctgcttaatttctcatgctaacaatgttaatagttgatgaaactacatggcgatatttgcaattaaaaactcatatatacatgctgacaaaacttacatggtcaatgcaagtcctcatgttgtcgttttctaactaatggctaacaaaactacactctgcaaacaaaactaacatattttagatgattgccctcatgctgcagtcatctaactaatggctgacaaaactaatatcttactttgcaaacaaaactaacatattttagatgattagaccctcatgctgtaatcatctaactaattaatggctgacaaaactaatatcttactttgcaaacaaaactaacatatattagatgctcaggtcctcatactgcagttatttaactaatggctgacagaaataatttctcagtttacaaacaaaaccagcatattttagatgcttaggtcctcatgttgcagttatttaacttatggctaacaaaactaatttattattttgcttacaaaactaattgctgataaactaacaaaaccaggtaataattgcttacaaaactatgttagtggatgacaacaatagtatatcacttccaacttccaagttaacagaatggatcatgagttcagaacaagacaaaactaatttggtatttaaataaaaaattcgcttgtttccccatctaatgtacaaataaccattattaactagaaaaatatcaaaatggtgttcccccagctgcaaatgttggagtcacatgaacggtaagcatagcatactatggagaccaacattctgaaatacaaaaaaggggctatttgtgtccttgtcggtgaaagtgcatctaggcccctaatgattttaatgattgattacaatgcgattggagaggactaacattttatttaagcaagtgtgaaggttgttatgtcctcaatgagttgcagagtgatgcataccccattgaaagcgacgtcatgatgagttacggcaatgagcaaatggtatattgtgtattttactttctttgcatcttagaaaagccgtactattaaggggggtgatgcattgacatataaggagtgatgtgtgtgctcaaaatcaattttttggaagcatttctccttgcttgtgtgttctggaaattttcggaagttccgaaaatacacagaaccaatttttcgcttctggaaatttttggaagttttcgaaaaagattttcgaaagttttgaaaatgactgtgaaggcaaaaacggctcagtattttttcggaaatgtccgaaactgttttttggaatttccgaaaatgtctgcgagtcaaatatgcttctggaaaatttcggatgtttccgatagtgtttttcggaagttccaaaaatctccagaaggcatttttggttctagatattttcggatatatccaaaaatatttttcagaagttccaaaaattggcattgactttgtgattttctgttctggaaatttttggaagttccgataatgattttcggaagttccgaaaatcgcaattattgtgctccaacgggcagatctggagcagtagctataaataccccctctctccttttgagtgggttgttggtgacattggatattcttgtgtccttggcttgcttctctctctagtcatttaagccttgctttcttgtttcccctctccactcgggtttgattccaatttggtgtgtgtgagagagtgtggattcgagtttgtgtgggtgcttcttgtggtcttcgtgaagatttgtaagcacttgcatcatctccgggagttctttgcatcatcttttactcttggaggttgaggactcctagaggagttctggctaggtgtcgctcctgagccaccgatctacttgtggttggccgggagaagtttgtgaaggccggatctcgcctccgcaaggaaagagatacccttaatggaaggaggagtgctttgtgcaaccttttgaggaaagggttagcaaagaccctgctctttgtgagctcctcaacggagagtagaatcccctcaaggatttgaactccgggaacaacttcgtgtgctacatctccggtgatatttcttcctccatctcctctagctttgcttgtttgtgtcgctataggtctagttgttgtttgtattttgattatcatgtggtaggcatctagatctagaatttacctttgttttcgactgctctgagatttttcggaagttccaaaaattcctgcttccgcatttacttatgttttaaattagcctattcacccccctctctaggcctaattgaccctttcagtcggaaaacaactttgtttatagagagcgaagctgtgcccacactcagtgaatcagtgaatatataatgcagtttctgcctccggggcgaaaacctatcagcactatccgacaacacatgtttttgagtattgtattaatatatcagttattatataaagtgagcgtagctcaactagtaatgttcctagtggtggaactaacccacccgggttcaagttctagacttgatatgggcgtgcacatttacgtttaatcattctttcaatggtaggcgacaaacccgtcggtagcgaggcaccatggtgacttcgttagtctcaaactatgctgactcggtctttcggatgtgctgaaagagttgagtgcgtgcgtgttgtgagcgcttgcaattgtactatgtttctcaaacttagggtcccctccaaatatatactagatgataccccgcgcgttgctgcgggatactatgtgaaaacaaatagtatgatcgaagggaatatattaaaataaagccaatctaccaaaggaattctacagtaattctacagtttgattggaatataatatgtctgccatataagttcaaatgacatttatgttgttcagagagtatatacaatatagcctgtaggaaagaaaaaaaaattgtatggtttgtttgttagagattaaagaaaagtgcttcttgctaatctggtataggaagtgcataggcaagtgaactgataattaggtttcaaaaaaaaaagaactgataattacttgaaggtgtgtcaatccataccgtgagcgagcttgatgataccagctagtgatgttcccttcgatttgctgtaaacattaagaaaacatatattgactctatttataagatgaaaccaagtttttatatcagttagctcatgcaagacgaaggccttagtctgaagggactgaatttgaatcatgtcttccatccaatggtctggtgctggactgaaacgattcaagttctagctgaataaacaacagtgcacatatatagtagattggggtaatgaaaaacggattcgatcccccaaaaaaaaagttaaccatcaaagatggataaggtagtttttacaaaatctctatatatctgaatatataataaaataatgatggtcagcttgacaaattgcaatttcatacattcatatatcgatggaacacaaagtactgaattaccagattgtttgctccgcaaaaggagatggaaccctaaagtactgaattgcttgatcgattgatccagaacgggacaatatatatgcctttccgcgtgatacttcttccacctgcagtaaatttgggcatcataatcataatttacacacagaaaccaacaaataaaatgtcaagtaaatttccacgggcacattacattccgaaccaaacaaacaacagaaacagcaagagaaaattctgataaaacgaaggagcgtaaagtagatacacaaataagaaacggtatgcgaggaaatgagggtgagaggaataaaaatggcacctgccaggtcgccaatgaaacggaagagtgatgatgatgcaggtatatgcccatggaagatgtaatcacatatgtaggagaggatatgaagcaatccattttaatggcaaacgttatcaactatcgaatgaggaggcgagtagaccgggaagcaacgggataggaagctgcgccatacattggtgggcgccggtagtttcctgagcggcggggccgaaccaatgtataggaagcggagtggtggggggaagaaagggtgctgcatggggggtgggaggtggggagtggcggcgattcccttgcccggcggcgcgagaggggagatgcgggagaggagaggagtcggagcgatgcggtggggccattcgcgcgagagagaagtcgttgatgcgggagcgctcgcgcgggggagcaatgcggtggggctggagaagcgagattagatccaacggttaggaaaagaatgatgacgtggaggcaccagaaagcagagaattcagtagtggggatgatttgtataggtatatagatacaggattactcaacacacacacacacacacacaaaagaatcacaaacttacccactcatggacaccattaataaataggtagaacaaaatcaacacacctctatcaaattggaaaatgaaaaaataaaatacattcccacgaagcaacaacaaaatcatataaaaaatgttgaaaagtgatcctgcaactccacttgatgtaactctaatatcctatcgatcagtgttatatctgcctgtagccatgttggattggtgagtgaagaacaactttactgtaagcagatgcaagagaaatatgtaatattgagcactgcagttgtctttttagaaataatacttttttaatagggaatcacaaaaatagaggttgtcagactaaaattgcaagtataacaccctatcgaacaaccaatgttcgacaagggtacatattgaacaactataatttgacaagggataaaaacataaaatagaaaaatcactttgcgctactatgcgccactgtagcatgcaggacctatcgaacatccccatttcaatagtccacctctcttccatgtactttttattttttttaagtggactaacaaccttgtcgaacaaccgcagttcaacaggagttcgacaggtacctatggaatggttttagccaatcaacttctatttttgcaattttttattaaaataatattatctctaaaaaagtttccattttttttgtctctatagacgatctggactgcttgacaaagcaaagaacttcattgaggaaaacaacatcaatcatgtggcttttgtttggatggggctactgtcagcttgccgatttcactagcacaaggactatgcaaatttggcttgtaaagatttgcttcacttggagcaatatgatgctggatccaagctatacaaaactgcattttatacattcaacggtgacagatccaaccatttacacattcaaccagtgacagatataaaagaactaatacctgatagtcatagaccgacaccaccggcctcaaatgcgaccataacgatagtgtgcatgacgagagaggaggacaaaaaaaaaaggatggctcatggaggataactagagggtgcgattgcgcatgcaaaggtggagaggaggaacgatggtggctcatggagaaagagcggtggaggtggtggtagggatgaaaacggatcgagtacggtcgaaaactagctctaacatattcgttttcatatttttttctcagaattgaaatcggaatcggaaacccggatacgaaaatggaatcgaatattatcgaatacagacacggagcgaatatgaatcgaaacgaatacggtaatgaataattatcaaaatatcaagacccctcaaaataagcttcttaaaacgaggaagagatatagccattagttttcaaacacaaaacatcagtattttcaaattttatctctatttataagggcaagggggagatagaaaatgttatgtttactttccatacaaatttatgttatcataaaacaaataaattaatgtgtatcactcaaattttcgtaggcacattgaaatttttaaaaattggttgaatattttaaattttgggttgaacatttcaattgaaagtttttaaaaatttgagtggttatttttcagaattgaattttttcatttgtttgtatgtggaccagttaagaaagtttttaaaaatttgagtggttattttttagaattgaattttttcatttgtttctatgtggaccagttaaggacccgcatggaaaaattgattccatacgggtgacttaagaatccatatgcaaaaataaattttgaaattttgaaactaatttatctcactcatatgaactccaaattggatgattcttttccctaaatgtttctaaaatcatgctctatcatgttattgtgttcttatcttctattattttggccatttttctcttgtgactttgttttatcaattaaaaatttgaatttctaaacttcaaataatattttgaagctataattaatttcagctgaaaaagtcatgaacataaaagttgtagagctcatcaagacatacaacttttattttggtcatttcttcatccgataaagtgatagtaacattgttcacaaagtttacttctctcttatagtttatagaaccaaataagatagatgtaaattttatataagatagatgtaaattttatgaacaatgttactatcactttgtcggatgaagaaacaaccaaaataaaagttatagatcttgatgagttataaaactttgttgttgataactttttcagttgaaatcattaatattttaaaatattgtttgaagttgttatattttgaaattcaaattcaaacggttcaaacaaagtcatatagaaaaatgaccaaaataaaagttgtagatgttgatgcgttatacaactttgttattgacaatttttttcatttgaaatcatttactacccgaaaaattatttgaatttcttatattttaaattcaaattttatatagtttaatcaaactcggatggagaaatgaccaaaataaaaatgatagatctcaataagttatacaaatttgtatttgacaacttttttcatatgggttgattttgtgcctttaaattcattttaaagagccacatgttaaaaaaaaaaatcgatttttacactgaaaaaaatccaccatttttttcacctcaaccttatcttctctttgactcttcctctcttctctctcacacactttctactctctctctctctctcacttcctctcatccacagggcgcagggcggggcgagtggtggccggccaagggcggtgcaccgcgtggcgggtgaagcatctaggcccccggtgttaattttggtaattaatgacaagcgctaattgtggactaaccgctaattgtgctaattttgttaattttgctaatccaggccgatggggccctctgacagcacttcaatggctagttttctagccgttgcagagtagcacggtctgaccggccacatatctccggtcagaccggcagagcacaaagttgggggatttcgcccccaaaggctagttttgctgggtgggagtataaatactcccccaccagcagcaaggggaccctcttggcatctaattcaattgcatacaccctttgcacctcactcacactcacttgagctttgtgttcatccatctagtgtgttagagggttgattagccaagagtcaagtgcatttgcttccattgtagagctagtgtggcacttgatcatctccacgccgggttattgcttgttactcttggaggttgccgcctcctagacggtttgtggagaagttgcccggtgacctctccgagaagtttgtggagaaggcccggtgctggtttgtaagtggtttggagttcaccaccttcggagtgaaggaagaactaccctagtgatcgaggcttgggtagtcctctccgtgggccagctcccgccttgtccaccccttgacgaagggggtgtgcggtggcttcgtggttgagcggtggagttgggctcgcctcaatggggagtaggaaaccggcgagtttccgaaccttggtgaaaaatctcttgtctccctgtctcatttgattgtcacatttacatttgtgcaatttacatttctagagacaaacttgagatcatatcaccctaggattgctaaacattgacataggagtttgatttactttcctagagatataattgagccactatcaccctaggtttgcaaaacataacttagttgcttagttagagttgaccctcaccaagcctagcaacttaggttagttttgattaggtgtcatttagttttaaatcgtctattcacccccctctagtcgacatctcgatcctatagcaggcggcggcggcggcggcgggcggcggcagcgggcttgactgccgcgacctaggaagcggctgcagcgacggcttcggtgggcggcgacggcttcggatgggcggcagcggcaggcggcgagggcggcggatccggcggcatcgccctcgggaggggccggatccgctgccctaggaggtgttcggcgctcggccccgcgacggccggcggcgggcgggcgcagcagcgcggatctagctagggtttcgggattttttttgttttttttttgctgaaaaatatctccggatatccgatgaaaaattccagatagtttccgaccgatttacgattccgtcggataccacccttactgttcgtttttgtatccgagaaaaaacccgaattcgtttccaaatccgagaaattccggatagttccgaccgaatttttctgaatctgaaaattggtccggacggacggaatctatccgaaccagtttcatccctaggtggtggtggcggtgcgtggagtgatagttaggctgtgtagcacgcaaaacggagcacacataattgtatgattaattaagtattagctatattttttcaaaaatagattaatttgattttttaaacaacttttgtatataaacttttttttttgcaaaaaacgcacaatttaacagtttgaaaagcgtgagtgcggaaaacgaggggaggggttgggaacttgaaggaaagaacacagccttaagggtttattgttgacatgatcgctaaccaagtttgttaattttttatacgtgggcaactagtcattagtcattataaagattataaagaaatagctagatttaaagtagtaaaaatattgagataaaggtgagagtacttgtattaactttttttgtcactttagtgataaattcttaattattaatagtaagtgtgacaaatagtaaaggtggtgtttggatcagggacttaattttagtctctgtatatagacactaatttagagtattaattatagactacttacaaaactaattacataatgaaagctaatttgcgagacaaattttttaagcctaattaatctataattagaaaacgtttactgtagcatcacaaaggctaatcatggattaattaggctcaatagattcatttcgcgaattagtccaagattatatattttattaatagtatacgtttaatatttataattcgtgtcccgatgtgacacggcttagtcccattattctcgagtagaatatgtcccttccttagcggcgtaaagaaagaaattcgtctcctccgctcctagcgccgccgagtcgcggctgaacagaacaagggagggaggggcggcgatctccatctggcgagcagagcaggggaggggatcctcgtgagcatccacatcctctttctgattcatctctctcccatcgggacacttgatatttcttgcgttcttcgttaaccctagcttctcttctagatctggaagaggctcttctttttaatttcagagccttaaccttaatacaagtaacagtttgtttgttccccgatccgcccctgctgctggtacttgggctatttgattcctgcatagtttcagagctagagctagtgttgctctttacagctttgggcggattcgcgatggcggatgaagagtcgtctgacttcaccttttgcaaggttttatttataacttgcctccctattgcttctatgttcagctacttgttatttctacaatcaatcagtcatatttttttttgacttatgtattactttcaattgtgtaataaatctgccgatcttctttgactgatttaatcacctgcttttaagcgcaatcttggttctggagatattttcttgtacaaagttctaccaccacaaattcttggaagaagcaatatgttagggatatattccactaacattatcttcatttttggcgctaatataaacaaataggtagtatctgactaacatgggatggtacaaacaagtgaaaaaaatagatatgaggaaaaggaaaaagggtaagatgtaacataagaaatcagggagactgaatggaagaggaaagaaagattcatctccgctgtatagaaatctcatatagtttgtccttgttgctgctgtaccaagaaatccaccttttgttgttgatatacatgagctttagaatttcctatttcataaaaaaaaagctatgctgatgtagtgagcttaagctaactaggtaagcacagggtacccacttgtgtatatagctccattttcatgaattatttgctactcccattttatctgcttttcttcatggtacttacattttaaatctggaatcatgagtacaagggacatatatctagattgtttgccatcttgaatctaccggatttattaaattttcatggatacttactgtccaaatggtctaaatttaaacttcctatgttgattatataatgaccatattcttttacaaacaattgaaacaaatcttcagtgacttgatatggtaacttgctgatgttattctacttatgtttttgttgtgtagatgtaacaaattctatattcaattttgttttctagatcgattttgagggagatggtggtctggagttccctaaagctatccctgtggcaagtacacctggtgatgctggtgcagataacttaaagactaagaagatcgaaggcaacatgcaggcaaacaattcaattaaagatcaaacatctaattctatatctagtagcatcaatcgtgtatcactcgaagactctaatggaaaagagtcagttcttagcagagagaatacacagtcaaatttatcatctcaaccaaaatcttcaaagaaacctgcagcgcgtgcaaaagttcctttcgagaagggctatagccaaatggattggcttaagctgacccgtacacatcctgatcttgcaggtaaattgtagctgctactgtttcttcatctctgtatgtatgattattactggatggctagtgtacatttgaaaactttcttagttaatgtattgttactgtctgaggcactataatcatgacaactcaggatatcttaatatggtcatagttaccataggaaaaacacaagcttaagagtacacacaatttttggtttcattgttggataggtgaggtcaaatgaatgagtttgcagactagtatgcaccatgttaaatgtcttcaaaaggtcctgaactacattttctactatatcagctttcgtttttcatgtggcattatcaaaactgatgaggtcagaaaagaagagggggggggggtatattttttgggtaatttgtttctagctaatacctcatggacctaagaattggtttgaacttctagctattcataagacaaaatgtcatttaattaattaattgtggtatgaacaaaaatattatgtatttcatcctcagataatccatagtgattttttttctataccattaggattcgtacattatttaagatacaggattcctgcttgtgagatcctttagtcattagtcactggattgcattttagatttggtatgcaaaggtgagaaaaggaaatacaggtgggggatgcacaatttcagcatttaggggaagagcgcgtgaacagtggcaaaatctgaagaagtttgtgattccagcggcattgaacaaagaatgcaaaaagcagtgccaagtaccaatggtgtagactgatgttttcctaatttaaagcataaatgattatctacagatgttgaaatctgaaaatgtaaatgcaattttattatttgtgactggagcatcgcccgtgagctatccaccttttttgaatataactgcaaagggggaaaatatgttggtgtgtcttgcgcctgtctatcagctgtaattcatgaacctgtttatgcttgactgaagcatatgcgtccactgttgttaatatttttattttactccttttttaactgtgtgttacttgtaatgaattgatgtttgctggtgaaataataccgatttcctttcatttggtgtggcatttttatagggctcaaggggcagttaaaccgaaggttgatttctctagaagaagttaaacagcataaaacaggagatagtatttggactgttttgaaaggtcgtgtgtacaacattgctccgtacatgaaatttcatccgggaggtaaccataagttttaacctgatgtggaatacttgtttcagttcttttcgtagctgctgttcaccttcacaatttctgcagacttcagagtgctatatgcttctattttatgtgtaacaagtacttttatgggcatttgcaggagttgatatgcttatgaaggctgctggaaaagactcgaccgctctgttcagtatccttctattattattgttcaaacatacttttaaagttgcctgctgcctgtcgtagaatttcaactgagttttagttagaatcaaaatatgctttgacatgcatgtttgcatgctaactatactcatgcatgctttgttcattatattaggtcgactgttctgtgcttattgtgaccgttgaacttatgtgcaccttgaggctagctagctgtcatatctgcagggaggttttgtccatgaatatataattcttgatatggttccttcactcccctatagacaaatatcatgcatgggtaaattttgaattcctcctggagaagtgccttgttggattcctcgatcccaatgagtagatgcgccattgagcctgaggccagaactccacttcctctttcttgtccgcgacactagtccctgatgcgtatccatcacatggagacagtttaaggaatgtaaacaagtgttttgcttcattgctaaggagatatagatgctgctgaacattttagaaaaaaaagaaaagttagaaacttgatcaccattgttatgtacaaattccttcaccattgattgctgaagaaaacaaagaacatttccatccatatgaatgtaatgtcaagaagatacatgtgttttagatgaagggatactgtggtgctgttttggctctttgcagccaacacatagtgctctgtttctttcacattacaagacgttttgggctcatgcatatattgatatatgtgcttcatatatttatcccatatgagtgtatgaccagatccgagaaacccaagcgcaccatcgtcgtccatccgccaggcgatattcctaacgacgccatccagattccgcacggagatgcgacctctccaccggccggaaagcacgctgttgccgtcgtcgccggtctagggaccgctgttaggatcgacctgatctgatgcgatcgatcccaaaatattcagcgaaattcagaacttggctggaagctacctattaggaatcctaacacggcaaggaattgaaataactgctgaaattaacttgattaacgaaatatatgagtaggccgcaagaacagaaaaatggaataaaaactatgattttgatcttcgatatagttctaaaataacacattggcttatattgagtatatcacgagtaaaagacaaaaagtgacgcctatagtaccgtaaggatacacactgcagtctatctcggtgctcttgagcaacacaatcttcatagaatctcccctccatctgttatatttaaatctcagccatccaaccaatattagcatcctcctctgcttcctcagtattttggaactctaaaactctaaagaatcaagtgctctctatcttcatgtgcctctcaaccacaccccagtcgtgtcggtcttagcctctatgcttcacgactacacctcccatgtatccgtcgttcctcgatgttggtgcctttatcaaccgaccccgccttcccaaaaccaccacttttgctgctcgtcactatcaacctttaaattctaccccttcccttgtcataatgaagttgtaggaggatagcagcagaaggtagcggtgaggtaacaggaggtggcaacggagctgcaaataacaagacaacggtgggagctataggatctggcgcccccttggccagatctgacatcctcccgacaagatctggggcctctccaccaagggagactagttgaggtggctctcaacgataatggtgggcacagtgtggtggcctacagcaacgcaggtgcagtggtgagacaacgttggtgccctcgctatgggtggggactaaccggcgatcggacatgacgtggtccgagagaaggctatccatccgatgaggatgactaacggactggaggtagagcccttgtgggaaggcggcaagaggcgtggggatggctgcgtgctagcagtatgttgctggtgttttgaaggcgatggagctgcaacatcaaggttgagggaaggttggtgccaggcgaaagtcttgtctgatggtagtcaggacacaataattgtgacgctgcaggcaacacgaatcccctcggggtgttgtcgtggttgtaggatcgaaggcatcttagaggggagggggttgaataggattcctaggagacttggctgaatttaaacttaaatttcagaagataaaaactaaccaatatgcctaggtttaagactactgtggcccattgtttaaaattaaagctagaactcctaacagttctagagcaaaataaatattgaaaggaacaagaaactcaacataaagagaagaaagttcaaacaaaagacttggcatgttttaaccgaggtatcagatattcaacaatctctactaatcgtcattggaaatctacacaagagtatagctccctcccaaggccatgaagtccatgggcgctctcatcattgtggttcttctccactcctgaaggtgaaccccgaaaccttcaccatcacgccgagtctcccacaatcatcttgagacatcactggctaggcacgctaagatgccaagagtaacaggaagaagtcttcacttgaagcccttaagaacaaggcctaaacgagtaaagaaaattatcacagatagctgaatggcgctcttggactctcccttaggttgcttagctcaatagagttccaaaaggcactaggtagtctaaggcaagaggtatttatagccttaatcgagctcattagctgtttgctaccattggcaaaaaccagctgaagttacataggatcggacaatctggtactagacggccctttatactttccaatagtaacaaggcatatagccgttgggctataaactgtcgggcaatccagaaacacgccacgttcaaaatcaatatctggtagtagccggacaaacatgtgtccaaattgttcgacaatgtgtcagaatgtcaaacaattgctagatcagcttgattatctatcggataatctggctagttcatttacactgtccgaccaacatatgaccacagttggacaacgaactagccagaaaatccgacactgcaccggattgtccggtcaagttactctagcgacttgaacaagtactatctcggattgttcgacacaacttggactattaaacttgtacatgttcagggttgtaggaagacctgcacactgacaattgtctgaggtttttacccacttgatttgagaggccacaacttagtatgcaccacaccttaaactctagcatttcccaaaaacttcaagctactagttttcaacccctctttatagcagtctttaacttaattctactacatttgtcccaactcctcaaatacattaccgatgtttcagttgcagtagtatgatctcgttgatcttatcttgactgtcttttttgggtataggcaaaacgtccacacttccatcgccggagccctaatctttttttaatacttaacaactgagattagttttcatgattatattgtcattaaccaccaaaacatcacatggggtctagattcttttagaggtgcccctccttccttcaccaatggatttctctatgttaaaatcttatccaagagtccttgagcagcggtggtactctagcgtctcaacctcctatgacaccctgtgtcaattaggatgtgacttgtgtggtccataaaagctatgtgcgcatgtttagtacagcgttgctagtttagcaagggtgaaaccaatatataagggcttgttcctccaaccatagcactttcgggttaaccgttttacatgaagcgaagacgaaagtgtaagtgggtggtatatgtaagtgagcccgctctttagatgagctgggctacacggttctggttgacgggttgttacatctccttggaggcatcgtctttggagatcccctttgcctttccgctttgaactgttggtcctggactgctctggcgctctttgtttgtcatgatggggtgggtatgtgtgcgggaagagtggatcttattctctgcggctctcttcctcctcaacccaagatgtttggtgatcaactgcctagcaaggttgatgttgtttaggcgattgcaattgctcatgtcttcatgttggtgatgggtctgtatgagggacgagcggatctttcttctctctcatgttctccctatgcaatccaattttgggatgttaattgggagcccatgcaccattttagtgttttgactttgtcggtattcagtggagtggctatgttgtaggctagtggtgaccgggtcttacatagcggcagtcagcttgatgctaggtttcttgcgtagcgttgtcagcgcatggttaagctagctgagttttttttttttcctgtcttcttctcttttttttttggaacttctgtcttcttcttttagttttctttgtgattataacctctctcagggctctagtcttatactactttttttctctactatattaataaaacattgcaccatctagtgttgttcattttttaaacaagacaattagtataagacatcgttttccaagattcaatatgatatgtttatgttgtagatttagagtttcctatattgcaacgcatcaatatttttctagtatatattataaatatcaaaattttaatcatatgttgatgttattttttttatcatggacataggttaaaataaatatcaagctgaaatattcccataattcataaatacaaagaaatttgattgcgaggtgattgatgggacatgtaacattgtacaaatgcttataatatatggacatagtgcttataaatttcaaatatttgaactaagttaacaaaatactaaattaaaagtacaatatctttctaatcaatatactcggtggtcagatccttctatttatcgtcaaatttttcttaaagtgaatttggtcaaatagcacagttaaatagatcatatatacaacagcaaataccagttgtttctggtcaattcgcaagataaagttataattcataccgataacaatgtaattctctgcaatctgggtcgtagcaatagcggaagaagagcaacagatttggacacttgcaaaccgacacggtgactggtaacgaaccgcctgcgaaaatcgtctcgacaaacaaaaaaaagattgccgccacccccacccgtgcccctacccacctccggccgatctagggttagggagagggagaggaagggccgatctactgcaggggcgccgctgcccccgccggggtgggggcggatctgggagggaggggaaccgctgccgccctcccccagactccctctagctggatctgggagggaggcgaaccaccgctgccgccacaggtcctcccccctctcccctcggccggatctgggagggagccaagcggccccgagtatcaccgtcgccgtcgccgtttgctgccccgacctgcgtctcgctggtgccgccgccgaccccgcgcctctccgtcgcgtgtggatcccgctgcccctgctcgtcgccagtcgctggttcccccgccgcctgtcgctgtgagggatctgagggagagagaggtgagggagaggagaagtgagggagagaatgctgaggacttagaaaaaaaatcttctccagccttgtctatttatattccacactcatttttgtaggtggaccacataagaggtttgccttcaaaaataaagagtatttttgcaggcggacagcgagatttaacccggtttacatttttgtaggcgatcatttgggcccgaaggttatatccgcctgcgaaaaataaatacgtacccaacgtcggcgcgaaaatgctttttctagtagtggtgatacatctccctagcaggttaggaaggactttaatccattcctaattcctgatcgttgattgctagtaaagttgtatatatatgcatttaatagttaatattacatgtgcatgtaaaatctcatcttcaaactcatcacacgtatgaaaagaaaattatattgttacggttaaaatataatttacccaatttaggctaaaactttacagaggtataataatattagaagtacatgtacattttttaaagtatgcataaataattatattatattttgaaaccgatggagtattttgtatcaaacctttttatccatttaaaatggacacttatcctttcagcaatgttgagatagacaatagtggatttcatgtttgtgatcttatatacagctttcggccttcaccgagaggtgaaaatttctcgtaaacttccacatacaagttttacagtataaattaatttggttcctaatgaagtcttataactttatgcattccaatggtagctaggactttccgggttcgaacagagatgaaaatttcaaataaacttcaaaaagaaaatcatataaattggttgttagattaatgtgctatacccaattaaatcctaataaattccattggcccacattaagtgctatgggtaataacaccaccttgcaaatctgagtgcagaggtctcaacttaaatacggagctagtggagagtctctgttgaccggttgagatggtgcgcggacaaccaggcggggcgaggcgaggcgaggcagacagcagctgctgctgcgctctctcgttttgtaacggacggtaataaacacggagaattgatttcgtatcaatgattccgtcagttacggaattaaacgtcgtgaattgattccgtcggttatggaattaaacgccgtgaattgattccgtattaacgagcgcgtcggttacgaaattaaacaccgcagttgatgactccgaacgttactctcgcgcctgcatatatatactccgcagcaaccagaaggacggacgaagttcttcacgactattgcacttcgagttcctcctcctctgttcctgagctgcagaatccttccccggttctgttcacctgcgcgcacaggtgtacgggacgagcaggtgcctccggaactccgtccgcttgagaacttgcacgggtaggcgggcgatcaagttttttggtagcgcttcaagcgcgactgctcttgttcttcgcggctactgctgctgcatcggcgccttcaccaagatgtcaacggagattggagacaataagatgaacgacatcaacggaggcaatactgcctcaaatccagcgatgggacgttctcggggtatactttcattctcccgattctattagaagtttctttgttaatactcttcgcaatggtagcattgcgttactatgtaaatgttgatgcttatttcatattaagcatactcaagttgtatacatttagcactgtcactagatctactaatattgcaaatgtcatgtttattgtcttaatattttggattaaaatatgccgaattatgaccaaatttccaacaatccaaaaacttgatgggtcttttttggtagttggctttgctgcatcactaaaaccacgtgctttcgatggttcaaattataaaagatggaaagcgcgtgcacttttgtggttgacggtgatgcattgtttctttgtctcatggggcaaaccgagtgaaccgcctctctctcctgaggaggaggctaagttcgaggctacggattgcttgttccgtggagcattgatcagtgtgctcgccgataatattgtggatgtgtatatgcacatacctttagggaaggacatgtgggatgctcttgaggtcaagttcggggtttccgacgccggcagcgagctgtatgtcatggagcagttctatgactacaagatggtcgattaccgttctgtagtggaacaggcttatgagattcagatgctggtaaaggaacttgagaacaacaactgcgagttgccggacaagtttgtggctggaggcattattgccaaattgccaccttcttggtcggactttgctacttctctaaaacacaagaggcaaaagttcagtgttactgatctcattggctctttgggtattgaggagaaggtgagggcaaaggacaaccagggcaaaaagatcgagggaggttctagcgctaatttggtgcagaagaagaacactcacgcatcccacaacaacaacaagaaagtcaaacctgacatcaaatccaaggctacaaccaattttaagaagaaaggcaaaggaaaggcaaaaggagattgctttgtgtgtggcaagcctgggcattgggccaaggattgtcctgagcgcaaggacaagaagtctgcaaacatggttattagtgagggcggaggaacattgtggtatgataaatttttagcaacagttctctctgtctgtcactcacctgattggtgggttgatactggtgctaatattcatgtgtgtgcggacatttccctgttttcttcttatcaagtcgggagaggttcctcctagttgaagggaaacggatcacttgcggctgttcatggtgttggtacggtcgatctgaagtttacttcgagaaagatcgtgcagctgaagaacgtgcaacatgtcccttcaataaagaagaatctagttagcggctctctactatgtagagatggttttagacttgtgtttgaatccaataaatgtgtcgtatctaaatatggaacgtttattggaaaaggttatgacagcggaggtttgtttcgcttttccttggatgatatgtttaataaagttgtgaaccatgtaagcgatgatgatgatgagtccaatgtgtggcatttgtgactttgtcatgtgaattttggttgtatgacacgcttagccaatatgagtttaattccaaaattcactttagtcaaaggctctaagtgccatacttgtgttcaatcgaaacaacctcgcaagcctcacaaggcatctgaggcgaggaatttggcaccactaaaacttgttcattccgatctgtgcgaaatgaacgacgtgttgactaaagggggaaagaaatatttcatgacactgatagatgattgcactagattttgctatgtgtacttattgaaaacaaaggatgaagcactgcattactttaagatctataaggctgaggtagaaaaccaactggaaaggaaaatcaaacggttgaggtctggtaggggtggagagtatttttccaatgaatttacttctttctgtgaagagtttggaattattcatgaaaggacacctccctattcaccccagttaaacggggtagccgaaagaaagaactgcactctaactgagatggtgaatgccatgttagacactacaggactttccaaggaatggtggggtgaggcaatattgactgcgtgtcatgtcctgaatagaattcctactaagcataaggaagtaacaccattcgaggaatgggaaagaaagaaattaaatctctctcacctgcgcacatggggctgtttggccaaggtaaatatacctatagccaaaaagcataaatttggaccaaagaccgtagattgtgtgttccttggttatgctatccacagtgtgggacataggttcttaatagtaaattctggagtacccgacatgcgtgttggtacaattactgagttcagagatgccacattttttgagaatgaatttcctgtgaaaaatgcacatagcacttctagtcaagaacctattttatcccctgagcactttatgccgatagaacacattgatcaaacgcttgaggaaaatcctgaggaggataacattgtggcaactcgaaagagtaagagacaaaggactgcaaagtcttttggagatgactatattgtatatcttgtggatgatactccaagaaccattgaagaggcatattcatctcctgatgtgactattggaaaggaaagaagcggtacgcggtgagatggactcaattatgtctaatggtacttgggaagttgtcgagcgtccatatgggtacaagcctgtaggatgcaaatgggttttcaagaaaaagcttaggcctgatggtacaattgaaaagtacaaggtaaggcttgtggccaagggttatacccaaaagaaggcgaggattttttttcgacacttattcacctgttgctcgcttgaccacgattcgagtcctactcgctctgtcagcctctcatggtctactcgtccatcagatggatgttaagacagctttcctcaatggagagttggaggaggagatctatatggatcaaccagatgggtatgtactagaaggtcaggagggaatggtgtgcaagctgttgaagtccttatatggtctcaaacaagcgcctaagcaatggcatgagaagtttgacaatacacttacatctgttggctttgttgtgaaagaagctgacaaatgtgtgtactatcgctatggtgggggagagggagtgatcttgtgtttatatgtcgatgacatattgatctttgggaacagcctcaatgtgattgaggaggtcaaggactttctgtccaaaagctttaaaatgaaggatttgggagtggctgatgttattcttaacattaaactactgagaggagatgagggtgagattacacttgtgcaatctcactatgtggacaaagtcttgagtcgctttggttatagtgactgcaaggcagctcctactccttatgatcctagtgtgctattaaggaaaaaccgaagaatagcaagggatcaattgagatactcccagatcattggttcattgatgtacttagctagtgcaacgaggcctgacatctcatttgctgtgagcaagttgagccagtttgtttcaaatccgggagatgatcattggcatgctcttgaaagagtaatacactatctaaaagggacaatgagctatggaattcactatgccgggtacccaaaagtgctggagggctatagtgattcaaactggatatctgatgctgataagataaaggccacaagagggtatgtgttcacacttggaggtggcgctgtttcctggaagtcttgcaagcagaccatcttaacgaggtcaacaatggaagcagagctcacagctttagatactgccacagttgaggccgaacggcttcgtgagctcctgatggacttgctggtggttgaaaaaccagtaccggcaatcctgatgaactgtgataatcaaacagtgattattaaagtgaacagttcgaaggacaacatgaagtcatccaggcatgttaaaagaagactgaagtctgtcagtaagcagaaaaactccggagtgatagcattggactatgtccagacggctaaaaatctggcagatcagtttaccaaggggctaccacgtaatgtgatagactgtgcatcgagggagatgggcttgagacccacttagagttgcacaatggtggaaacctgtccattgtgatcgcagatcccgtgaatttggatggtgaaacaaactattgtgtaactgagagaagagaccctaaaatgggcttatcttcatgatgcacttctcttctaatctgtatggtagtatggtatacaccttaatgtgatccgagtggcttttcataaagcagagatgttggcctacataacatcttagaaggaacacacctatatgagtccgactgctagtcacagtctatgagatctgggtgatatctagatactcatgaaaaggccaggagtatgacttatacgctccaaatagaggggatgcaaacggcagcctagtaccagttaagggtttgagtgaaacctgaatcgcataagactgacaattcaagtcatagtccattgtttagttgtgatctggtgtagctcttttcctaggtggaagttcaacttaacagtctccaccgaaacactggtataacaaacaggatcagaaccgagagcatttcctgtgagccatgaaatttggtggggattgttagattaatgggctaggcccaattaaatcctaataaattccattggcccacattaagtgctatgggtaataacaccaccttggaaatctaagtgaagaggtctcaacttaaatacagagctagtggagagtctctgtagaccggttgagatggtgcgcggacaaccaggcggggcgaggcgaggcgaggcagacaacagcagctgctgcgctctctcgttttgtaacggacggtaataaacatggagaattgatttcgtatcaatgaacgcgtcggttacggaattaaacgtcgtgaattgattctgtcggttatggaattaaacgccgtgaattgattccgtattaacgagcgcgtcggttatgaaattaaacaccgcagttgatgactctgaacgttactctcgcgctcgcatatatatactccgcagcgaccagaaggacggacgaagttcttcacgactattgcacttcgagttcctcctcctctgttcctgagctgcagaatcattccccggttctgttcacctgcgcgcataggtgtacgggacaagcaggtgcctccggaactccgtccgcttgagaacttgcacgggtaggcgggcgatcaagtttttggtagcgcttcaagcgcgactgctcttgttcttcgcggctactgctgctgcatcggcgccttcaccaagatgtcaacggagattggagacaagaagatgaacgacatcaacggaggcaatactgcctcaaaatccagcgatgggacgttctcggggtatactttcattctcccgattctattagatgtttctttgttaatactcttcgcaatggtagcattgcgttactatgtaaatgttaatgcttatttcatattaagcatactcaagttgtatacatttatcactgtcactatatctactcatattgcaaatgtcatgtttattgtcttaatattttggagtaaaatatgccgaattatgaccaaatttcccaacattggtctcattccaactacagtctaaaaattaattgattcgaatggtagagctttcggccttcatcgacctgtgaaaaaaaattcagatgaagttagaaaaaaaggtcatatgaaagttccttatattccaatcatctcatgataaggttagtcagtcttggtagtccatctttaaaaaggatcctctgacttaacatatactccctccgtccatataaaaaagagaaaccctgaatttccgtgttcaacatttgaccgtccgtcttatttgaaaaaaatataaaaaaaattaaaaagacaagtcacgtataaagtattaatcatgttttatcatctaacaataatgaaaatactaattataaaaaattcatataagacggacagtcaaacattggacacggaaatccagggtttgtttttttttttaagggcggagggagtacgcggttgagccactgtcacgtaggctgtagcaaagcgagattcatgtgtgtcagtgagttagctgtacatgcagttaggaggatgaactttctccgtctttatacctgtgaagaagagcagaggaaggaatcgaaatcaatacgatctcacggtctctcactgttggctacttgtacagttccaactccactaactcaactggttagaatatttgacagaataacgcgtggctaagtcgtcgatcggatctggaaaaccaatgtccgtaggccggtagttctacaactaaaattttcagttcggtcaggtgacatcactgttagcataacaacgaaaattcaatagcataacacaatgaaattcaatagcatataacacaatgaaatcaagtagcatgtgcctgagcgcatgtttgtcatttggaagcccttaagccctagtgcagcatttactgtaccacctccgtatcatagtatataactacctcttctattgaatagttacattgtgcgtcttaatagtaatgttgaattaaaagcataagttggcaaaattacttctgaaaacgatcgagcaggccgcgcgaaatcgtttaacgattttcgtacaacttgggagaaatggaaaattctgagcaggaaatgcggatgcatatttttaaacagatggaaaggtgccagtagaagtattatgaatttcgtccctctgggaaactagtttaatattcttcgcatttaattttgttataggatatcatgacttcgtggaatctaatattttataacagatttgctagaaaactaccacaagtttttttctcccaaaactttcagatttgtgaccattggatcgccaagaaatttgtgcatgaaggaaaaaaatgctaaaagtttttccacagatgtcatacgtaagatcctagtgtgaactaaccaaaccataattgaatgtaagttttatataagttatatcacagttacattacagttacaataccgtcataatgcaatgtagttataatgtaattatacttcaattatgctatatttacatctaaaaatttttgactcaaaaaacctacagcagtttttagagatactcccctgtaataatgaatgtagtgtccaactgcaaataacgatattttaaaagtgtattacctcaaagattgatttttaccggctaaaatcgcgaagtcgtaatgtcctaaaacaaagtttgcccaacattagcaaaagaaaaatgggagaggtattagcataaagtatttaagtactaccataacaacgaaattcaatggcataacacagtgaaatcaaggcctaaagggaagagattaattcgtaacaaaatataaccaaaagacataatatttactcctttaaatgttccttggggtggtggtggacgtggtgaggcactcactgatatttgggccccacaaaactagctcagtaaacaaaagtgttctatggaatttcaccgcatcttcctccctctgtctttcgatttgtactggtccacttaaattactgagtcattttcgttctactgaaactgtctcgtttagggggtgtaaaattttagcgtgtcacatcaggtattatataagttgtcgtatgaggtgttcggccactaataacaaaactaattacaaaatccgtcagtaaactgcgagacgaatttattaagcctatctaattcgtcattagcaaatgtttactgtaacaccatattgtcaaattatggagcaattaggttatgcaattagttacttttttagcctatatttaatacttcttgcaggtgttccaacgctcgatgtgacagggccttggtactatgcaaaaacattgtcgtgacgaacgaggcacctaccaaacagtattttctccgtttcacaatgtaagtcattctagcattttccatatatatattaacatcaatatgtatgtgggaaatgctagaatgatttacattgtgaaacggagggagtactatttaatagcattcatccaggcaatgctccatgcatcacaattcacaaattgaatgagttgatcacacccatactagcacgcaacaacatgatgatgccgctcgttgccctcctcctgatctcttccccaaagctgttggcagcccaacagcagctacccttctgcagcagcagcagcagcaacgcgaacaccctcgcctacatggcagagggcacctacaagaccaacctgctcaacctcgccaaagacctgatcgccaatgtcaccaagacggggtcgcactcggccgccggcgccacggctgggacgacaggtcccgacatcgtctacggcgccgtactctgccggggagactccaccaactgcagcagccgcttacagagagtgctcgacacagccagcatcagtaataatggatctaccagtagtgagagtgactcccagtcccagtcgcacaagagtactgtaaccttgtacgaccatgagttccaggcgctgctaagcttctctgacacggacttcatctccagcttcagcaacgcgccggcgtgcatagtgagcaattacctgaaccctgctgtccctcagagggatgctgatcgcacgcggttcagcgagcttttctctgagctcatggagaggatctccgacgccatggtgagtagtcgggccagctacttgacgggcaaggggaaggggtggttcgacggccaggagagtcagccagtagtatacgggctggcgcagtgcatggacggcatgccgccggagcgttgccggagttgcctgggcggcatcaccgaccaagggaaggagatggtcagcaatggcctgacggaaggcatggtgctcggggtgcgctgcagtctgtggtaccactaccagacggacggagaattcttcgccggcgagccaggggtgttagcgttcctaaacatgccttcttctagagacggtactatacatgcctgctggtacttaattaccttcaccttcaataatttgtgttttgttgatttggttcaattaacccgtctttcgtcgtcagttttcaccgtctaagaattactgctcaacagagacattgctttcatctaattcactagtttccattaaactagccgtgtttagattcaaaattttttcaacaaactttcaacttttccgtcacatcaaatgtttggacacatgtatggagcattaaatgtggacgaaaaaaaacaattgtacagtttgcatataaatcacgagacgaatcttttgagcctaattacgtcatgatttgacaatgtgatgctacagtaaacatttgctaacgacagattaattagacttaataaattcgtttcacagtttaaatgcggaatctgtaatttgttttattattagtctacgtttaatacttcaaatgtgtgtccgtatacttaaaaaaaaattttggcacacgaactaaacacagcctaactttcataccttcaaagtgtcatgtcatgtggcctcttattcaaaaaataaaataaaataaaaagtgtcacgtggccttagcttatccttatcagtcaaaattcgaattttcaaccttatatttgaaaccaattttgggtttcttcatcgaagtttatttttcagcctatgctttaaatcgctaagaacacatatataaaagttttattcacaaattatttttcgtttacaaatatgccgtttggctaatttcatgaataagccaaacgatagggcctagtttccactagttataactcatatcaatggatgtgcagaaagcaagttcgggctctgggctacaattggatcgttcttcctcatggtatcattttcatgtttctttgtgtatatttggatcaaacaggagagaaaaagaggtaaatatataactaaatattagactcacaacgttcctcgtttgtgtaaggatatatgcatctgattcgattatatagctaccagctactgtgacaagaatagactgtttcactgttttcttttttcagaagcaagatttaaactacgactgatatcgatggcaatacaaaatgtgataaatctttggaggattgaagaaggcaactcaggattttcattgtataatttctctcagataaaagaagctacacaagacttctcaagggaaaacaaaattgggcaaggtggttttggatctgtttataaggtaattgactaattgtatacttgcattggtattcaacatttttaatatttatattgtatatttttcaaatgaactttgatttttttaatcagactatttctgctgtaattcctttatctttttttttcaaaaatatttatgttacatgccaatgtggcactcaacatcgtaattgtataaatgtcagttttttaaaattaaaaaacaaaaactgtgtcctccacttaatatatgactctaatgttctttcttttcagggcctattacctggtggtcttgaagtagcagttaaaagactttcagcatgttctgtacaaggtttattagagttcaaaaacgaaattcagctgatagcaagacttcaacacaaaaaccttgttaagttgcttggctgttgtatcgagggagaacaggaaaagatgctcgtctatgaatacttgcaaaacaaaagcctggacgtcttcatatttggcatgtctccaataagactagatatttctacatactacagtttgaagttacaagtattttggcaattttcaataacctcattcatattttgcagattttgtgaaaggagcacaattaacctggtcaaagcgtctacatataattgatgggatagctcaagggattctatatcttcacaattattcacgattatgtgttgttcatagggatttaaaagcaagtaacattctcttggatagcgatatgactccaaaaatttccgatttcgggatggccagaatattctattcaaatacaattgaatcaaataccacgagaatagtaggcacgctgtaagtacaaatgaatatacacagttatatatgttctccattttgcgtctaattattagttcctacaattccgtacattgagaaaattagaaattttctcctggagaagcatgcatataagttaattatgaaatttgtgtataaaaattcctatacttcatgtgccttggtaatatataacaattctacttctgtaatattcagtggctacatatctcctgagtatatttttgatggggtttgctcgatcaagtcggacgtcttcagttttggcgtcttggtcttggaaatcataagtggaaagaggacttctggattctatccttacgatggcaaactatacaatctcatttcatacgtgagtaaaatgtactacagattatcctttttgaaatggacagtggaaccgggttggtcccgatatactccaaattgagaatcatttgctttcataatatcatcattctttttttttattggtgtttttattgacagaaatacacattcatatattgttttctaataggcttggctactttggagatctggacaggggcatgagctgatctgttgctgtatagaaaacaatcatgaatcgatacaaaggtgcattcaggtggcacttttatgtgttcaggagagggcagatgacaggccttgtatcgaccaggtggtcactatgctaaacagcgagggaatgaccttgcccggaccaaatcagccagcctacttctatgtccgctctagtggcagctcagatgttttatcatgtgacagcaatataagcatcacattagaaagatagattaattgtcatcatctccattcaatacagaatgatatccaaaactatgctgtatacactatctttttgtcttccttccggagtttaatcgaattgtgttcagaacttaattattttttttctatttaataatgtaaattagtgtgacaaaacattgtgctcctatatctgatgatgttctcttgtgattatcatattacaataaataggataaacctggattgtagagtatttggcgcatctgcatttttcgaagggtctcattgattggcttattcttatgcttataagtcaaaatttaaattttagaacttggttttgattctgatttttttttattatagtttattttataacatttgcttttgagtcgctagacacgtataacaaattttacacacaaatattttttatttattaataaacgatttgaatttaacatatgaataagcgaaacaatagggctgaaaatctaaataggaaatctaaatgcgagccgtcagccaccgagtagcatcgattcctaatttcttcaacatttaaccaaaaactttccaatcaggttccaaagctttctgatgggggaaacaagaggagctttcaagtttcgagcaacaaatggagaaatttgttgggaaacccaatactggaatccctaaactttcatcacggaaaactaaaagttttagaataatctcacctcagatccgaagatgttttcaactcctcattgcacgcccgtactcgagagcagcggcggcctcgccgacggcggcgttggacgcgacgggtagcgtggcgcggctacgattcgccgcacacgggaggagagagaggaaagaggattcgcgctcgcaccgcccttcggagtcgggagttgggccgcgccgccgtgtgctgtggtgggccgttttgctggctcgcggagtaactggcccagttttactgttgaccaccgtagcaatattttagggatagatgtaggacttcacccagcccaatccggcacacgtttcgctcgaattttttttatttacaattttttttattaaaagttttacaaaaataattttccattttgaaaattgacggaagtagtcgcctaccgccctctgggagggcgatttttaaaaatcgccctctccgagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgggggggggcatggaattttgcaggcggcccccttgccgccctccgctagggcgattttgtactgtggggggggccgcctgcaaatgggcggcgagggggcatggaattttgcaggcggcccccttgccgccctgggggagggcgatttttgcctccccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtatacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtagaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctattgcaaaggcctggagagccaaacaaaagatcattgagatgaggtatggcacatttgaagcttcttatgataatttgcctcgtttgttagccaccattgcccagaagaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaatggttgggatgagaagggacttccagctaagtggcctgatgttcggagtcggtggtgcatgcgtcacatgggtgcaaatttctacaagcaattcaagaacaagcatcttatggagctctttaagaggctctgtgcgcagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttccggtacttccattggttggtattgttgaattcatccttcacggcacgcaagcgtactttaaggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcacgttccttgctcacacgttcttgctgctgccggtgattgtggcatatctcccaatgtgtacgtctcaaattatttcaggaaagaagcaatctttcatacatggagtgaggagatatatgagttcaggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgctcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaatttgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctatagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagattgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgatgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagtagagggtgaccttcgaccggatgcaggagaagatgcgtccggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaacacatcaccccgtcgtaacttgatgatccatcctcgcaggacctcgtttgccttcgagcgcccctagctttggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcaagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtatgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgattgtcttgtcacatctaatgaataatgtatctcattgagttcacatatattgcagtgaaaacgacgctatataattgacaatctgaaggcaacctcttcatattttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctagcggagggcggcaagggggccccctgcaaaattccatgccccctcggcgcccatttgcaggcggccccccgcacagtacaaaatcgccctcgcggagggcggccaggctgttcaacgcaaatttctgagccccggcattcatctattaccaacggtggagggataaacttcactatttctcactggatctgcagctttatctaacgttcatactatggactgcctttcaggtagagtccacatatctttatcacacaaaaacgaacacatccaactgaggttcaagtcccactctggatcaactactacaggtccaaatactctacttattacttccaatgaaagcctttcgatgaaactcattaattattttttcttctattgagagacaaatgctttatccactttttgtcccgcggtcaacacaaaatgcattgctaaagatatgtgctgctataacaaacggatgaagctatcaagggaagtggagaactacgt

SEQ ID NO: 71851 - DNA, 2350 bp, Oryza sativa
ctggaattccaaattgtagtttagatcaagttttatcaccaaaatttatccattgtctaatccttttatttcagactaggtacttttgttattttaatttactttggatcaccctgattatcgtttctaagccatatttagcaaactatatagcttgggcacataggtgaggggagctcgcaagcatgttgaagctgatcgtcagaccagtcattgatgtgttcaagaagtggtttaggtgatcagaactactaccatacatctgtcttataataattgtatttctaccatttaaattttatataaaaaaagcatttgtaataagatgaaacccatccaattagtcagatagagatatcctgccttctgtcctaccatctttccatccccattggcgccaacctttcttttattcagtatgttattatagttatccgtgtttactaaattttataatgcaaatattttagaaaaaaggtagtagaaaaacagcaaaattatctagtttaaaagtgaaaagcttggataaatagtaaaattttggtaacgaaaaattgataacaaaaatgacctaaactaattgttgttttttttaataataattaaaaaagtgctgagttgccgagcagtagtaagctcccagtccaaacatttctcctcctcggtctggagccgctcccccctccccgccgccgctgctctcgacgccgacgccgacgaggcagctaggccggcgacgaacctcgatctcgatccgctcgccgccgtccgtcgccgatccgcgcgccgacaccgacaccgaccttgatcctgatccgcgctccccgcgacgtacgccacggtgggctcccgatctgaccccatcctccatccaccctcctcactctccgccgtcgtagtatatctcaggagggctaccagctgagccgagggaggagaactggatgcctcgtgcgcactcaaaggccgcagctttagcctttaagcttcttttttttttctcttactatggggggctagttgtttatagttagttagttagctcgaagcctctcctgcgtctgcggttgcaaccgattcgatttccaggttggttggttggttggttgtttgcactgatgggaataaacctttatgcataaatagctttgcgtgacttgcactttgtgcagctaaatgtgacaacctgctgttgctgttgctgttgatgttgatgttgctgttgctgttgatgtgcgttgtgatctctgaccaacctgaaattaccgggaggccagggtagatccagttgttttgtggtgagttgtgtggttgtggagaggagggcgcatgatataaagagcttggggtttgctcccctctgaatacaaaagtgacaacttggggaactaggcagtgcctctgcatagcatagatcttcctgtcctttctttcttgtctagtggtgagatctggtgaggattttctcctcaagatatcccttttttcggtttgtagtttgttctgaacatctgtagtttggcatgtccttccatgatctagctgttcgttctgaagatccataaagatattgatacttactgtcttgggaactgggggatatcatttccctttcacccatatgtgaatcaaagtttattttatttagtttacctcttagattcgtcatttcgcttgctgtcgattttgccttctttagctgtgtagtcatgatagaatcgttgcagcaatggatttggtattgtgtccttaggacttaggagtagtttgaccgtcttcccagaactactgctgtttctttctccattcagttgggtggtagctttctcagaaccagagttcacagtcctgcactcttcacatgtttatttcgggatcctggctggtgtgcttgtgatctgcgaaacacggctgcttatgttcactcagaaatgcgcacattcctttcagtttactactctgcaatctccctcaaaatctaatttatatggcaggtttgcagtaagcaggaaagatggtgaagatctgctgcatcggagctggatatgtcggcggcccaaccatggctgtcattgccctcaaatgcccagcaattgaggtggtggttgttgacatctccaagcctcgcgttgatgcctggaacagcgaccagctcccaatctacgagcccggtcttgatgaggttgtgaaggaatgcaggggcaggaacctcttcttcagtacggacgtcgagaagcatgtcgctcaggcagacatcatttttgtgtctgtcaacacccctaccaagacccgtggacttggagcaggcaaggctgctgacctcacctactgggagagtgctgctcggatg

SEQ ID NO: 71852 - DNA, 1166 bp, Oryza sativa
gttgtgtccagtgtggttttgacgtgagatgcacggacacagcgcacgctgaacatgtgcacatccgtgcagggcttcgtacttgtagaacgcaaacctgttcgtccatgtcgcgttctcccagacatccgagccgtgtcgatcgcgtgagctgccatggccggcgaactcgcgttctatctgctcctcgtaggtctcgttgccgtgccattgctcatcttgctcggctccgagcggcgcacggcggcgaggacgcggctgccgccggggccgtgggcgctgccggtggtcggccacctgcaccacctcgccggcgggctcccgtcggaccgcgccatgcgcgacctggcgcggtggcacggcccgctcatgctgctccggctcggcgaggtggaggccgccgtggcgtcatcgacagacgcagcgcgggagatcatgaggacgcacgacgttgcgttcgcgtcgaggacggtcgggcccatgtctcggctctggtccagggcgccgacggcctcgtgttcgcgccctacggcgaggcgtggcgccgggtgcggcgcgtctgcacccaggagctcctcagccaccgccgcgtccagtcgttccgccccgtccgcgaggacgagctcggccgcctcctccgcgccgtcgacgcggcggcggcggccgggacggcggtgaacctcacggcgatgatgtccacctacgtcgccgactccacggtgcgcgccatcatcggcagccgccggctcaaggaccgcgacgcgttcctccggatgctcgacgagctgttcaccatcatgcccgggatgagcctcccggacctcttcccgtcgtcgcgcctcgccatgctcgtcagccgcgctcccggccggatcatgcgctaccgccgccgcatgcgccggatcatggacagcatcatccacgagcaccaggagaggagagccgccgccgacgccgccggtgacgacgacgacgacgacgacgaggacttggtcgacgtcctcctcaggctgcagaaggaagtgggcgcgcagtatcctctcaccaccgagaacatcaaaaccgtcatgatggtaagctcgacgccgccatggccgaacaccgaaagctcgacgcgcgcgccaaagatgtctccaccatttttctccctcgcttctttcacagga

SEQ ID NO: 71853 - DNA, 16014 bp, Oryza sativa
  unsure (1)..(16014): unsure at all n locations
tggtctgctgagctctccaagctcgcagccaatgcgttcttggcgcagagaatctcctctgtgaatgccatctctgcactatgtgaggcgactggtgccaatgtgtccgaggtggcctatgctgtggggaaagacaccagaatcggccccaagttcttgaatgccagtgtcggctttggtggctcctgtttccagaaggacatcctgaacctcgtgtacatctgcgagtgcaatggccttcctgaggttgccaactactggaagcaggtcatcaagattaatgactaccagaagagccggtttgtcaaccgtgttgtggcctccatgttcaacactgtctctggcaagaagattgccgtccttggctttgcgttcaagaaggacaccggtgacaccagggagacacctgccattgatgtgtgccatggcctgttgggtgacaaggctcaaatcagcatctacgacccacaggtaactgaagatcagatccagcgggacctttccatggccaagtttgattgggaccacccaaggcacctgcagccaactagccccacggcttttaagcaggtgagtgtggtctgggatgcgtatgaggccaccaagggagcccatggactgtgcatcctcactgagtgggacgagttcaagaccttggactaccagaggatctttgacaacatgcagaaacctgcatttgtcttcgatgggcgcaatgtggtcgatcctgagaagctcagggagattggcttcattgtctactctatcggcaagccgcttgatgcatggctcaaagacatgcccgcggttgcataattctgaatccccacctggagcgctctgctggagctgaagaaattcgataaggaaacagaaccggtcgaccactattttctgtagtctgtttttgcaggagacagctaccattttctcagtcgtaagttgaatatctgttagtatctttgtcgaagttttcatgtttgcagctttgcgcctttgtagatctgaaatcctcaagcctctgatctaagagtgccacccaaaatacctcttgtatcacatgaacttcttatagccgatttattctcgtatttcaaagacgctacagattaataatgcattttttttgccaaataaaggctgtgtttagatccaaagtttggatccaaacttcagttcttttccatcacatcaacctgtcatacacacacaacttttcagtcacatcatcttcaatttcaaccaaaatccaaactttgcgctgaactaaacacagccaaagcagccgtgtttgctctcatttcatggtttctttgctgtcatttcgtagttttatgcctgagcaacgaatggcagcagatataaactggctgtgcacagtatgctgtaactaaatggaaagagattccttttaagttttgatgctgctaattgctgtgtccagccagttttgtgctgctgtgatcttgccgaccagctttttgtaaaaatttgtgcaagaggaatggatggtatggtaaaaatttggttacagtggtctgctgaatcggttaaggttttgcatttgtgagcataaggtgctggaacttttatcctctcaagaattcagtgccaaaagctattgcaaccttcagcggggccttcacacttctacaggatttattttcaggttgatccaaatatgggaatatattagatcacacatgtttcaactgcataacatgtctgttcgatatgtaaagaaagagcatgctatgcgggtgttttctgttgtgggactggcatagttctgcagcttactgaaaaaaaggggataagcagttttcctttgcgtgtaaatgaattatgcgcattttgtttttgtttgattttcttcaatgttgtcatgctgccctatatgagagcaccacattcacgtgtatcagattttgaaggactggtcgatcaagatgaccacacgtaacggaaaacacaatgtcaacgattagttcaattaagttgctgggtaaacaagattctgaaccaaacaagatgttacttaaacattccaatgtcaagatttctgacaagcagcaaaactgcacggtaaatagatgtatgtgtatcatgctttgctagtatgaaaactgcaatacatgtctatggtgaatcaacggcttcgccagcaggaatgaatgatcacaaccgagatccgttacagatcaatagctgcggccccagaatgaccatttcttcgcaggctttccagaagcaaagcatgtggttcctgaattttggtgcaccgcatcagaaaaggttagttacaagtgcatggaagaatacgttgcaagaaatgcagtaaaagaccgagcaaaagagattgtgaacccaggctatttgtggcattttagctattgcctgcaaagcataccttctgggagatctggctgttcaaatggtgtacacaatgtcttggcagctcccaggtcaccttttgtccgagccttcacatccttctcaacttcctgaaccagcacgaaaatggaagatgcccatgttgagtagaaaatgttagtaatccagtgtaaatagttcataatgttatgttaataactagtgcaacacaggagtatatttggtagtaactaacagaactccagatatcacagtgcaataaattattttgcaggtactattgaatgtgaccctcgaccaagacattgcaaacctcattgagtctccttgctatcccatttcgttctccattctacttaactcccatctttgaactaagctcgacggtgctttaaacttctattggtcactggtgttacccctaccttcccattctccctccacaatcaacagatataataaagatatacaaatacgccttgccccagcaatcaaaagaaaactttgtagaagagaacatgaacacactggatattccaaatagttaactagtgctaaaaaaataacatggtgagagggagatctcataaaaaggtctcacgtacctcttcatcacaccatggagccaggatcaattttttgtcattcagagccactatgaattcatcccaggtgttaacaaccttaaggcaggcatctctcttttgtttcgccgtctcaaacaagtttttctgaacctcatcaagtaacccattaactttctcaaccaagtcagccgtaggaatatcagcttttgcaccattgtctcgcctaacaacacgggcctgaaaagcagatgatgttttcattaactccctccatttcataatataaggcacaactactttttaaagttgttccataatataaggcatgcatgcatgcatgccattaactaacccatcttctctactaaaatattattatttaaattctccaccatcaagatctctaattttattgggtgcatgaattacatttattagattaatccaaactataaggtgataataattatttcttggtctttgggctaagggtagctgtgctttatattttggaatggagggagtattagttggaataaaggttcagggaatagtagcaaattaaacagcacaacaaaatgaaagttactccatccatgccaaacctatatgagaaatggttgagggcaccattcagtcactggaaaagatgtgaaagttgcttaattgaatcaaattaacatattttaagtagaaagaggagaaataggttattaaatgaactagccaactcatgcattgcaacgatctaggataaatataaaatctgaactcaagaacaatatatagacttcggattgatcatcagttcacaaatgatcctattattacgaaccacatgtgcaaatgatataattattcagataaaagaaacacacgtgcatgtatgcacagaacccatggtgatggtggtggtatggcagacttaccatcaccaccaccaccactagctctttttctctaacagtaaagatatagcagttttcaggaaaatgcatgataacaaaggtgcccttagtttatatattcattagctacttactgttttgatgccattaattaatcatattttccatagggaatagagaacaaagaagccatttacacttcatcttatgctaacaagaaaaaccaatttatacaagtacactgatctactaataaacttgtggattctatcatggatatggaaggcattattaatttatcattaactactttatgaagagtcctagaagcattatagtaattaatgtgccactgatcaatgaagttaataaattaaatggtgtgacctctgtacctgattgtttgccatatcttttggacctatctcaattcttagaggaacgcctttcatctcccagtgggaatacttccatcctggagaatagttttcgcgggtatccaagtctgctcgaataccagctttctccagtgtctcaacagtctttttgcattcgtttacaatagctgttgtgtcaacatctttgtatggaacaggaataacaatgacctgcagaggtgccacccttggtggaagcactaaacctttgtcatctccgtgtgtcatcaccatcaccccaatctgcaaaacaagcatagggtcaatactacaaatgtgaacataatttgggtagagaactcagcaactggaaataacagatacatagaattaaagtaaaaataataatttaaaaaactagcgcattctgtattttaaaattaccagagagcttagcactcaaagctagctcctcattcacaataaaagcctcatttcttttgtaaaacattaccacttcaaaagggcaaaacaagaagaaaattccaggtacattccaaaatttaacaatatatgagaattaccgagcgggtggtgtatgcccaagagttctgccacaccatggatcttgagcccttatcattctcaaaagtgatatcaaacatctttgcaaagttttgaccaagacaatgtgatgttgccccttgtacaccacgtcctgtgtttggaatgaaggcctgcaaatatgataaaattttattattactaaatataaagataagtactcttcttcatcagggtaactacagaaaaactaatcgggtggaatgaagcaaacatttcatattaatacctcaacacttgttgtatacagtccaccagcaaatttttccatctcacttttcctccctttagaaactggaactgctaaaaattcttcataaatccttcggtagagttccaaaatttggagaacctgaacattgtcatggattaaaataactcagcatccttttaaattaacaacacgttactcattatttctgttcgctccatcagatattctacaaaatagttttttgtgccaagcaaccactggagataaatacaaccttttcacattcgaaaatgtaaaacaaggttcaggaagtgtaatgaaattgaaatattactgatgtcaaaacgactatttacactagcagtataatatcttcttcctagaatactatgcattgatattgggccagctgttgcttcacactagccaaaagcaggacaatagtacttaaagatagtttacaacagaaacaccaatatttgttaaacaaaagatgctgcttatttagaaccaaaaattccctgagcaagttatggccagctgcaaatggcagcagattgcccattagggaggcccatggattatggagattgctcatatggcaaggcagcagcaaaaatgctagtgctggaaaagtagcttaaggttaatttagcacatcttgattggagagctaatttcttagtgatcatttagttctgacagggagaataatggaacagtattctcattttcctaagaatccccccttcatccatgcattcgagcccacttcaatatggcagttaaccctgatgaactgcggttgcaaaaacaagtacagtacctcttcgtcagcctcctctttagttgcaaaagctgtatgcccttcttgccaaaggaactcacggctcctgcggagaatagttacagaatgtgtcagccagagatgatgaatatatccctattccctagtgcataggtcaaccacctattcgccatcatggaaacaggtggtgtatgataatgctcgtatttacattcactaagaaaattgagatcatcctgactcattgttatgaaactgatgaatgacataacatgcaggtgacaacacatgagcagtataggaatatatacaatattggatatcatggatatcatgcagaaccatgttggagagtgggacatgtaagaaaaacctaacctaaaaattcatatgaacaccaaagttgcaaaaacaagattcccttatcttcctttgtcccttttgtttcaagtaatgtcgagcacaattagaaaagagctatttcatgattttcttgggaaaagagaaaatgataacccttgacccaggattacagaatatttgaaagcatatcatgccactcatttcacataaaagaatccatattcttcctttgcaaaaagtttttcggatttgttaggatgcaggcaatcaggcactattgaggacaaagcttgcaagccaggcactagaggaaatagggcagggaggggtttataaacaattgactaccttatgaatggagttggattgctaaactcccatcgcacgacgttacaccactggttacacctcaaaggtaagtcccgatgacttcttatccatttggagaagtatggatacatgacagtctcacttgtaggacggattgcgataggagcttccagatcagattttcctgatttagtgacccatgctacctgcaagatgaattacaaaagactatgttactgtatcaagttccaacaaatagcctaaaagtaaaatgtgtatgcaacagtttataacaaacaaaacagatgctattgaacaaataatagttgtcatcagcactaccacgtggcatgtccaatagatagtacctctttttacttgacattttagacatcggcacagttctaacaactatgtcaactcaattattcagtctcagtgattatgatcatactccaggaaaaagtgttgcatgaaaggcagtggcctgtgccaacaaattgcatgactagcacaaaaatagttaggtggtcatacaacaggtttacaggccatgtggttcatgtgattaagagcatcatttcatatggcttgggtgcttgaatttgaaatctatccagaactaacctttaggaactttataagagaaacagggagtttcttcaggagaaattatgggtcaaacattcaaagccctgaggtctagtttgcctcaataatcaaataagagaatgaatagtgtcatagcttcataggtcagatagttcgcatgcctatgaatttatgtgctatctcacaaattaattgagaaatattgtgggttatctcacaaacgagttgagaaatattgctcaggtcaagcaagaaaaatcttttgagtgttcagacttcgggctgaaaagggaatcgttacaaatagtttttgctagcttcatttcatgaaggtttgtcaacatgctcaaatgacagacgtacatcctaatgggtaaaatactgaatgatggagtaaatagcatgggaaaatacacacctctggtgcaaagccctcaatgtggtctttctccttctgtaggacattctcagtgacaaacaatgggaaataataaggtttcagcttcagcttttttatttctgcatcaaagaattcctgcaccaaaccgcataggacttagggaaaaagaacatgattatagtaatgccattttacttaataaactgcaaacaaagaaacaaaggcaagatccttgatgctaagaacgacacttttacacaactcaatcagaagttactgatgatataaaatagacatgttgagataaacttattagtccaaaagggcatcagaattagcatttgaaaagctgatttgttaatgtgatgtttgcagtaactgtcaatcagggaaaaggagtgcataaggttgacaagataaatacttcaggcaacactctagaccaacttgtggacagagattactttttgttatcatcactgatgcttaggttacaagagtacaacaggcaacaatgactacttacatttcattgcaaagggaaataaataaaaattagcatcttgattaattgaatttaagcaggcattgagaaaaaacttactttaagcaattcccagatctccatcgcccatggcctcaagatataacaaccggatatgtcatagtactcgatcatttcactgttaacgacaacctgaaggaacaaaaagtaaaaaaaaaaaaaaacttctataagccccctagcaagaatgagatatattttgaatttgaaaaaaaaatgtttgagcttgttgttttgttttggatggcgattaataaatggataaatcaaccaataacagtttagaaacagaatctgtgtgttccattctccagtaacagctacgaaataacttatatagttaacataacagtatcatatccttggagattactaattctctcttcagcaacagcatttgaatagagtaaattgacccagaacagtttcagaaaaccagcaatagcaatagcaactaacagaaccaccaacatttgcactgatgcagaagtaaatctctgttaataaaagttcaaacgattagctaccaacactccctgccagaacttgtcacacgcatctcgaatacatcaccacctttaaattcaattccacacatgaacacctcatcgcacccacattacattaaaattcacccaaatctaccaacaaaacctcgccaaaaactcatgaaaggaaaaggcgagaaaaaccaacctcggagtaccactccccgaagttgtcatccttcttgtacgccatcccgagcttcgtctccttcttcacctccttcttcttccctgcaactcaaccgccaccaaaccccccatcatcagttgaagaacaaaacgcaaaaacccacccaaatcttcaacccaacccaacccaacccaaccacgccgaaccttcgccttccttgccggcggctncaccttccttcccggacgacatggctccgccctgcacggacgaagagacagacaacacggaagtcaaatctcaaaccccggaaacgcacggagaaatggagaaacagcttcggtttcgtggatccgggcgctagctaagcttgcctgctgctacgacgcggcgggatcaggcaaggcgagcgagggcgtgggcgaggcgagcagctagggttttagtagtggtggcggcggcggcggaggaggaggaaggagatgaggggagtaggcggagtagggcgcaagtagccaatggggacagcgtggcgggcgcgccacgtgacgttgctgacgtggacggaggaggtcggggatgggcccggcgtgtcagtgagtctatacacggggttaacgggagtagacgtgggtgtactgctcgtacaattgtggaaaattggtggcctaacacaaaaggtgctttttttttcaaagaggtgatttaattttattaattttaaaatgggcaaaggcacctcaagttcggccgaaattttatattcgaatcctttagcaatacttaattcataaatatacccctacaaaaattaatttatgagggaatggatcacacgtttagctgctactgtgtatagtgctaatggtaaacatcacagcaacaatggtcttatttacccctgatcccgatgcctagagccgaagcagctagcaaactgatgtggttgtgtcaaggttacggatcagacatacatcctatcctatggcttatggaatatacgagtattgtataccttcacgtacacgggttgttttcgtatgcgttgtaggaatccatcatgaattatggaaaatatctctacgggtcgagtgattaatttacaaagtcatactctgtagggatagagtttctattataacatatgggatccgatgtctccaagtcttacttggagatcaagatgatccacgatataaaaaggacccctgggagggatgcaaggcattgaatctcatgccaacacacccaccatagtctacgaagccaaagcccacagagccaaatcgtcgggagatttcatcgagtctatcgactatgatctcgtcggtatcgtcggatccatctactcccattgtattctgtggcttttccatattaatcccatataaactggattatggctattacctgataaggggcctgaaccagtataattcttgtcttatgtttgcttgatgtcgtaatatgtagatcctcgttccaacgtaccccaataccctaatcatctgttctacaagtatcactcgtcgaaggttgacaataacatcaacgaacctattattgaaccattgattccaaaccctaaatcctgaagttagatatatcccagatcttcaatttggtctcaacatgtgttgtacaggggtatgagcaaaaatggagaagctaggtagctactcttctgatgagaaataagacaagggtggcaatcgatgatgttaataacgacatttttaagcctaggaggggattgaggcacaaggccattattgtaggactaattgataaggtgaatatgagaagtcgagcacctaatatctcgatgtacgccgatgacgcggtcatcttcctcaagtcgatacaaggcgaaaactgtgctgatcaaagcagcacttgacctatttaggattgctactaggctacacgccaacttgtcgagaagcgccatcacacatatccaattctcggaagaacagagaaacttgttcagaatgtgctaattacatatctgggcttgccattatgtgtacgtgaaccaacaaaacttgaattacaacccatcctagaccggttggcaaagaaagtggctgttgggaagttgaagttactcttgccagatggtggcatgtgcctgatcaagtaggtactgatggcaatccctatgcatgtattgtcaatcatgcaactaccaaagtgggctattaaggatgttgagggaatatgtagggtttttctgtgcaaggggcaagaggaagtcaatggtgggtactatctcattgcttaaagagcaatctgtatgtaaattgagaagatgtctatatataaagcatctagctctttttggaaaagctcttagcttaaagttggaagtcaaacgaactgagcagaaggggaggccgtggaggatggtaggatggaaacgaaataaggatctccaagacatatttaactcaacagtgatacatgtggtgggcaacggccaagatacaaacttctgaagagggaattggttaccaaacaggggcagcatcactggtaacatgtcgagaactggctaccgagaggtaacatcgttggtaacatgcctacgctcttcagctttgtcagtaggtcaagactgatagtgggacaaggaatagttggctacagatgggggagagatctccaaggatcgctctctaacagagccttggcagagtatttattcctttgggatgaactctagaatgttcacatccaataggggatggaggattcaataatttggaagctgacaagtaatggctagttcattgtctacgctgcttacaacctattctttatggcgacgatgaaatgtccttatggtgaactattttggaagattagagtgctagcgagggtcagattctttatgtggttggctgtaaaaggatgatgcttgatggctaacaatcttctcaagagaggatggctgttcgttgtgccaatctgagatggaagattgtgaccatatgttcatcaagtgtcgtacaccaacagagtatggacaatgctacgagattggatcaatgtggcctttgacccacctagtcagcaaggtcttctatgtggcataatggtgacagcaaacgcaatcttgttttcgagcgagctacatgaacatgctcgatatgcttttcatgatggtgtgctggctcatttggaaggaacgcaacgggatagttttcgagcagaggttaaaacaattgcagagaagctctggagatattaaagaggaaatagccatttggagaactgctggcatatttcaatattgttatgaatagtccgttttagctaatgtcatgatcaatcgctataacatataacacccccttacaatctcaatgaaatttgattggccaatctttcagccgacccgcgaaaaaaaactccaaatacagctacatcaacagtatcatgtatggtgaataagatccatatcagggagtaccctggatacaatatcgaggcataccacaccgtgaccaaatggtacctacaaatttatctgagttaacctaagtactggtgaatgtgatacgcaactggtaaaagaaacgttgtgtgaaggtgatgcggcaagagatgaaatgtaggatataatagcctcgcactttgacccaaccccaagggcattatttcagttaaatctgagtatggaaactgtgaattctaatggccaaagttcaatactaaagaccatgtcaaaaactaatcacttggtattttccaacggagggagtaaccgctttgactttggcaaaattagcatagggcagtttcatcgaatctgtgacagaattaaacaaaccacaagaaagcaaaaaaaaaaaacataacatcataattaggaatttaggatatgcattatgcattcagcaccatagtaacaaaatagctgaatgcatacagataaacaccgctttactgaacattggtagcttgctttgcaaagaatgaaaattcctgcgactcctcgaagtagcttcttttgaagcaccacaagaccaactcatacagcatcaccaactgccagcatacttgacattgagcaaaaataacacgcatccaaaccatcagatttgcagcgcctttggaagtctttcagctgagagacaaggaacacctgcatcagtgatcacaagtagtctgaaggtatatggctgcacaaggtatgcttcattgtcctctgtcgactctcgcaagcatatgtttcgcatgctttgcatgggaaagcatactagcgccttcaaggctgcaagtagagcatcatgaatttaagaggcttgacttgcacaatcccaattcatgtgttaaatccacccaaaagtttacatgaaaccaaatatacagaagaaacattttgcatttcgattggtgatggtaggatgcaacatactactacattaaaagaaaattccaagatatttactcaatgaaacgaaaagacagaacaaaatgttctacggtgcatcaaggttgccagctaagaatcagaagtgggaaaaacaaaaggagtgattgatacttagacagtccactgcaatgagtaattgatctaacgaagcagcaacccattagtaaagcagaaacagactaatgattaagaatgtgtagttttgctttggagtacagaagctccccaacttatctttattggaatattaaatattactaccagcaacaaatcgccaatcactattaaggacctatgttttctcacatttttcttggttctcatacacaatatgataacaagggcacgtgcaagtattagtgaaggtccaatatactgagtaaaagcatcaaactacttatcttttggcatgactattcaggttttacttactttcaacatctccctgcaaattaatttgctaagctcccaaattgcctgttccattcttcataagttcccagttcacttgaggaaacagaaggtctaacctcctgcaaagcagtctcaaaatcctacagatccaaaattcaaaataagcttttaaaatcggaatgctacattttgggaatgattcatcgcaacaaaggacacacttatttgacaatgcaatagacaatgcaatcattgtttatccttttagtgatcataagtgcctagctatctagattccagcacttatttgactagaatagtagtaccttgagcatcaccggccgcatgtcctccttgtttagctttgttatgccaacaccctgttgaagagcttcccttagtggtcccattgaggcatctttcacaagatttttcatgtcagatcctgagtaacctgcagataaccaatgatgcagaaatatccagaaagatggcatgatacctcagaattagcagcaacaagaagaaacctggatgattatgagtaccttctgttaacttgcaaacaatatttgtttcttcctctgtgagcttgaaaaggccatccttctccaatagattgcgaattatccaggcccgtgcctctttaaaataaaccatggaacaatgagattcctgaagttatccccataagaacagaaatagaacattacctgatgaaggaaggggaatatatagacgttttgtaagtcgcctccgtgctgcttcatccagttcttgaggtctgtttgttgctcctgccatcattttttctccatgacatcagcccaatctaagttccaccattggttatgaccccacatttaacatccacctcatagactatgcaacacaacttcaaagcataggcctttaggcaaagatggatatgcaataatgcatttcacaaggacaatagaaaagcacatactatgttgatgctcaaacctcatacatataaatatcctgtaattcctaccatgacatacattaatgcatatcacacttgatattttcatctttttaacgcatgaggtacctataagtaaaatttgatcatttccactgtcaaaaccttccatctcgattagaaactgtgttttcaacctcctacttgactcatgttcaccatctgatttgcgctgaaatcatgtgtaagggtgttaggtgtcaactgatgcaacatgtatgtgcataacaaaaacaattcactaagaaaaacctgtgatagtagtgaatcaatctcatccacaaatatgacagctggctgacgacaacaggccaccccaaatagtgctcgaactagcttttcaccctcgccaatctgcacagcaggagaattaacaatcattatcaatctaaaggtatgccttcacattctatgtcataatgtatttttttttgaaaaaaaaagattgcataattactgtgcacaaaatgggcaaacatagtttgacagagattaggatttctactttctgaggagagggcatataaaggctgggatgagagaattagcaagtgagagagatcacaaacaattgtagggagtacaagcatgttccacgcttgtactaaatcttggttctaatccatatagactataattctttgaaaacattaataagatggatttattagcatataaacaaatgaatttgttttccgtagcacctttatgattgattaaagatatgcagaccagaaagatgtaactagccttgactttataggatacaaatggaactatgttgaaaattaaaacaagcagcagacagacccatttgcttgtcagtgaacttgcagaaatgtagaaaaatgttgccttggcttcaccagctattgcttttccaatcatggttttgcctgttccctgtggaaattaatgcacttatctttaaattgaataaaatgggggaagagcaacataacgggatcagataaattcgacctgcaggcatgcaagcttatagaagacctcttccaggagaccgacaaccgtgaaagatgtctggacgtagcagtggccatatcaccatttccgtcacgcacttctttgcatgttccaaaccagctattgcaggttggcatgaattagctacaagacacaagttctgaaagtactagaatgcaattatgtacctatgtcatcccagcggacattaggatctttatccattatttcattactgacatgctcaattaggcgaggttccagatttctcagcttatcaggaagctcaccatcaggtccaca

SEQ ID NO: 71854 - DNA, 2192 bp, Oryza sativa
ctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgccatgtccgcaggacagtctcagcgcttggtcgcctcgagcgcgcggctccggcaggaggccgagttcaccgcggcagaggaacgcgagcgagtggtggtagagaccgctgcgacggcagcgagggcgtcaaggctggcggcagcaaaattggcaacggtaagggcggaagtggaagcggcggcggcggcggcacgacagtagcaccaacagctctatctccgcctacggcagctccgatgatgagctgacgagggaggcagctcgtgagcgggcggagcagtgggcagctgcgcaaccccacgcgcgcaatggcggcagcttagattggcggggatgcatgtggcggcggcggcccagacgggcgtggacgcgcggcccggttgggtcgacggagatcgcagccgttgcaagtggcatggctctccctcaccggaccggtaccatggtcaccacaggatttaggccgtcatcagggaagtcggccctggcggtgtgtggctaaaccctaccctcaccaagaccaactacgtcgagtgggccgtggtgatgaggataaggctccaggtgcgacacatgtgggagccagttcggcacggcgacgtcaactacgacgaggatcaacgggcgcccagaagcggactgccaaggaggcttgggacgccatcgctgcggcacgcatcggaagcgaccgcgctcgcaagtccacattgcaggcacttcgcaaggagtgggagaacctggccttcaagcccaggtgaggatgttgatgactttgccctccgtctcaacactctgctgtagaagttggtgtcgtatggcgacgacacctacgatgaggagagagccgtcaagaagctcttccgctgcatcccagagaagtacaagcagattgctcgctcgatcgagtctctgttggacctctccacgatgtcgatcgaggaggcgataggtcgcctcaaggtcgtcgacagcgacgagccacagcctctctcgaggcttatcaccattggcaggaagcttcatctcactcgagagcagtgggaggcctgccagggtgacgggaagaagagggagtcctcttcctcgacaggccgcaagcgcggcaagggacacgtcctgcgaggacgcacccagggtggcgcccgcggaggcgcctaagccggcgcgagatgacgcctgccgcaactatggcaagtttggccattgggccaaagactgccgacagccacgacacggccaggccaacgtcgcacaggtggaggaggaggaagagtcggctctgctcctggcacacgcaagcatcgagctatctccagcggcaccggccgcagcggctttcctccaacttgatgagccgaaggtacgcgccttcctcggagatggctccagcaacgacaagactgatgagtggtacctcgataccggcgccacccatcacatgactgaccgacgggagttcttcaccgagcttgactccagcgtctgaggttccgtcaagtttgggggtcggctccatcaccttcaccgccaaatccctgtgctcaccggagtctactacatccccgctttgaggaactctatcatcagcgtgggacagctggatgagaaagattcatgcttgttggtcgagcacgaagtcatgaggatttgggattgccgtcgttgccttcttgccaaggtaacctaaggcaccaatcgactctacgtcttcaacgtgcaagtggcacaaccggcctgcctccacttcgaggccctgaacggctcagtgccaaggagatggtgcgaggcctgccgtgccttgaccacgtgaagcagctctgcgacgtctgcgtgttaacaaagcagaggcggctcccctttccccagcagataagcttccgagccaaggagcggctcg

SEQ ID NO: 71855 - DNA, 1101 bp, Oryza sativa
agacgtcaggcaggccgtgaagcaaacgagtaaggcgattgccgggacttctagaaagtaaaaaaaaaacaaaccccattgataatcatattcgatttttaaaatctcaatgataataaaaaggagaagcagcaggcggggtgtataagagtacagttgcagagctgccgacggttaacaggacttctagaaaataaaaaaagaattctagaatcacaatgataataaagagttggcggcggacgggctatagaggggcatagtggcatcgtttgatgggacttctaaaaattataaaaaaataaaactacaagtccaatttttaaaggttttgaacttctaaaaagtaaaaaaaacccaatgataatcatgttcaattttaaaatctcaatgccaataaagaagggagacagcgggcgagccgtagaggagtacaatagcaaagccgctgacggtttggcgggacttctagaaagtaaaaaatgaacccaaacgataattatgttcgatttttaaaatctcaatgacaacaaagagaaaagacagtggacgggccgtagagtagtataatggcaacgtttgatgggacatctagaaattataaaaatgaaacccaacatgacaataaactctaaaaactataaaatccaatttttaaaggttccaagaagaatgaatgaaaatagtggtagatcgagcaagcaaataaataaggagatgacataagagttagcaactggtgtgacttttaaaaactatatgattagaaacacggggatagtaaggtttggtctttcaaagtcttaaagacaatgaaatagctagatagctatttaataaattttaagtaaaataatacttaaaaatatatgattttgtttaggtgctagccgcgcaattgcgcgggccacccagctatttaatatgaaatttgttttagaaaaataaatgtacatcattaattgttcggaaaacgttacgcatggaaacgagaaagtgataccatctaaaacgttgtacgatttatgctaatgaatactcgaagaagatgataacttgtaacccccatatggcgccaaagcgaaccgacgacggcaaact

SEQ ID NO: 71856 - DNA, 551 bp, Oryza sativa
caagtcactgagtcatgcctccatctcctccagaccgagtcgcccaactccacacatcactctggagctgaagaagtcgagggagaggtcctcagcctctccgtcatcctcaacctcgccgccggtcatagtgacgacgaccttcgccatctccgtttgagtcaaggtcacctccatctctttcgcgttcccatctctccacacaatgccgagcatttcctcttttgacctaaacccctctcgtgcagtgcatcgctgggaacgcaagccacgctgacaacgccctggagcacgcaccggagcgccgccacttcaaccatcgtcgtcgtccggccattctcgaccacctcagagcaagccactgcgccatcgtcatcgcctcatcctcctcttcaatacgcctcaagaaccccagccggagatgtgaaggacttggagaacacatcttttcttcaccggcgccgatctagaattgcctccgccgtcatcatcgattaccgctgcctcggtgagccattgttcgattccttgcgcatacaccatctccttga

SEQ ID NO: 71857 - DNA, 2440 bp, Oryza sativa
ccggttaaaaaaaattacctatattttatctattttcactatttatataccccgttagtttaaatttagacatctgtatcaagctaaatttgattcaaatcaaagtaaaacaagtaaatggaaccccttcgttttgttctagctccgccactgtgcgtcaccacatatggagtaggagtagatggagaaggttgcgtgctgcttcgacctcctcaaactcaaagctcacgacgaagctgaccgcggcaaaggcggatgacgatgaggcccgagcagcagcggcctccatctggacatgttccgtggctcgctctgccaccgcatactctcgtttactaacgctttatttagtcctttaaattcttttataaggttttttaaaaaataattaaatttataaaaatatagtaatatgtacaaaattaaattaatcttattaaatataccattgaatatatttttgataaaatatttgttttgtattaaaatattgatatattttttctataaacttaatcacactgtaaaataattaaaataacttataatataaaatggaaggagtagtattttttttctgatttactagtgataaatccctggccataataactttctattaaaaatgcatcattgttacgtaatattaatagaaatcaggattaatttaaagcttggtgagtcatataccacgactccattaccgtttatgtttgtactttctatctaagttttaattttcatttgtgataaaaaaataattttcatttgacaaaatgtaactcatctgctttgaacagaagacagcagcataagcctctaaacgtggaaacaaatgaaaatattaaattccattgacgggagaccagaaattagctctccgcctctccctccgtccttgaagttctacagctcaagttttgttttaaaatgaagctagatcacctaattagcttcattttaaaacagaacttaagcggtataactacgattaattaggggattgtgattggccgagaagagaagaggaagtaggtgaagaaaatgagtgaaaaatggttataattggttgcatgatccgctcaccattagtcgtagttgctgaaccgactttaccaatcattgaccaatatttccgatcaaaaccgaagtcgctacacatgtagcaaccaatatccaattgcaaacaacaaatatcaagcagtaacaatgtgcagtcaccagcaaggacgaagtgctactgtgctagcctccttgattcgccaccaccaagcgaatgggagaaaccatccctgctactaccgcagccaatggctgcggcggcaatggaggcggagtagataaggtgaagacgatgatggataggccaggttgggggtcagcggcccatgaggttcggaagtttttatgttcgattagtatcgatagacatgactccatagaacttatatgtacaccctcctagtcctctatctcctttctccagccaaaactgagccctggtccaagtatagatggccatatgatctgaggcccatggcttggcccaagcacggcacagcccgactagggtcgtaccgtgtcagcctggcccgacagccggaccgagcctgggctgcaccctcgaaacggtgggccggccggcacggcatgatcgaagaaaaatagtagaggaatccaaaatagacttaaataaccatataaggcaaggcccaaagacaagaggagtataaaacagacttatttttcagccattatggacatagccacagagtcgagggatgagaaatagactaattctgtggagaagcacgatggacccgagtcgtattggaccgtgtgtgtagcccgtgggctggcacgacacggcccggcgtgtaggtcaggccgtgcgggcccgaaaaggctcgaaaacctcggcccagacactgccgggcctaggccgtgctgtgccagacggcccatttggccatctatgggcccaagcaagccagttcaaccagagcctccctccacacatcagttgtgccctcctcatttgctggtttatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttagatcagtccgcggtcaccgaagaaatcgcggaaactcggcaa

SEQ ID NO: 71858 - DNA, 9598 bp, Oryza sativa
atttggtattgagtcgatgctctttttatctcagtgccgaatctgcatgcctggtgtgatttcttcctccttatacattttctccctggtaatggatggccagttaattggtgttggatgtttgcttgttgttcttcctcacttgtcgctgcatatcagagcatggtacaaatcgttcagggtgcccgctcacaccactcaagatgctctgattgggccattgtggtgtatgccagtcgagtctcgtcgctgcgggaggatcccgccagtgcggccagtgtcaggtgcactcaccaccactcgtcgttcgagggcgggacggagagctcgagcatgcctggtcaatggcagccggtcgtcggggctgccaggtggttggtggtgtctgtgcgtgttccggcgagtggtcggtcccacggctatagccaatcatgctccgctgctgttcgggccccacgtagtcgtggtccatgccaattgcagttggccgctgtagtaggctccgccgatgtgccctttgtccggcgcagtgttactgctcggcgttcgaggcgaacacggagagctcgaggatggcctccgtcagagcactgatgtgttacgtcgtatgctgtggttgaccgatggccctgtcatctgtggggtcctattgacagcctctgagtatgttgttttttatgttacatatttttttgttttgtttaccagtataagtagctcattgcctgccaatcttctctttcccttctgctttttcaccatttcctttgcattgccttttggtgcccgttcgctgttcttcttgtcgtctgttctagcccattctccgctgttgtgctttcttcgtttgatcatggaccctggggggtgaacgcgtgtgctggtgggttttctgtatctggcctagctgccttcctttctgtctgtgccgtgtgtttcctttttatcctgtgattaggcttggtgcatctcaggtagccatgtactggcctgtttgttgcacgggatttactgtcacagagtttttaggttttaggcgattttccccgtgttcatgtttcccttttgacagtggatcattgcttatctttgttgttcttctttcagtatatacttctttcagtaaatagatggtggctattacatagatgaagcacacggtcgttagttaatgacaaatatcattgcttttttttcctggttctgattcattattggatcatgtttcgccattcagagtgtgtcccgtggtgttttcttttcgtgcagaaccatgtggttcatttgtatttttgagtctttccttaagtgcatctctgtacgtttacatgttttttttcccttcatatcgatttttttttggcgcaggtgcttattgtcgcggtcaggtccgtgcgatacgttcgttactgttgtgctgctgttccctttaccatcagctcctgttcaggtgagctttgtttctttgctatttctttggggctgacatcctttttgttttgtagtttatttgtgccttgtggtttggtgtatgttctttcttttatctgatatccagcttaaattacattcttattccctgcaggttgcggaccacatcttctgtgcccgtacatgtcggctaaggtataacaattggcctctgttgcttcagctatctatacattattcgagctgcgcttttccttgtgggttatatgttctatatgtgtgcacgacatttctgtttttctgtgcgtttagttcctatatggaagggggttgtgtggttaggcctgctcgtcgacgggatcgccgattgctagagcgtagcagcgcttctcttagatgtatggtttgttgcggtttgtttttttagacgctttagattttatatcttttcctgggtggaaagattaaatcgtctgttgcttgtttagcatcttcctctaattcagctgccagcgaatatgtttgggagactgttgctccaccccgtcagggtatgtgatttactgatctgtgtgcgactgttgttgtggcttgtttatatttatgtagtcgttgctcatatatttttctcgctttggtagacgatggatttttccctatctaccctgcatggtattcttcaaaaagacggcaaatgcgttcaaaaaaattggccatgaaacgattggtggctgcaggtttttccattggatctttggttttctgcatatgttcttgctgacatggcttacatggacgttatgtctccttccctataggcaaaaaaccttgccgtattgctcctgtctcttgcaacaagtttgacagtgattatgccaagtttttgagaggttgctttcatctctgattcgtttccattcccttgtttgcaatgccagcatgctgggtttaaacataaatttctttttttgaatgcttgcacagagacttcaaaggataggtgtgattatggccctcctgagtatcgctgccgtttgtgcgctgctcagttctggtaccaggaacggtgcaagaaagattctgctattaccaagcgccgtgtctgttacaacctttgttgcaaaggtgggaaaatttttgtccctccatttgcgcagccaccagaacctttgaattcacttcttaaatttgatggagatgctcgaagtaaacattttttgcagcatatacgtcagtacaattcgctgtttactttcacttcgatgggtgcagatattgacgatagtttaaaccagggtggtggtccttatgtctttaaaataaatggccaggtctatcaccgtataggttcgctcttgcctaatgaagataatccaccaaaatttgctcagctgtatatttatgatactcaaaatgaggtccaaaacagaatgcttgctgttcttggtgaagagaatggtagctgtgatctagatcctgagatagctgctgaattgctagacatgctagacaattgtaatcctttggttaagcagtttaggctcgcgagagatcggctggctgaacacggtgatgaacaattagcaattaagattgtaggaggaagggcctgttcagtatgaattaccaacagccgatgaactagctgggttaattgtaggtgatttttcattggaaaatgcaaaacgtgatataattgtgcagagcattcctggtccactccatcatgtatctagcttgcatcctgcttacatggccttacaatacccactgttattcccatatggtgaacgtggttttcagcttggtataaatttgaggggggttgatttaaatcgcactgatatacgtactaaggcttccatgcaagaacattattgttactgttgccactatcgtcgagaccagttcaacccatatttatgttgcggtcgtttgtcctcccaaagtcaagttgatggttttgcgtgtgttgacgagggtagattgacatttatagatgaacaccagggcgattttagatgcgaacacgttcaaggcattgcagatgcagtcgccaaaggttgtttagacggtaatagtgttggtaagcgacgaattctccctgcaagcttcactggcgggagaagatatatgtaccaaaattatcaggatgcggttgctatttgtcgtgtgtatggcgcccctgatgtgtttaccacttttacttgtaatccgaaatggcctgagattgaagaagcattgcgctttgagccagggcagcgttcgacagatcgttctgacattgtttgtagagtttttaaaatgaaacttgatgagatggtttctgatattatggctggtgttccatttggtcgtgtgcgtgctggttagtgctcttttttttgcccttaacttagctgtgctctttatggtctattgttttattgatttttatttggttgttttgcctatgatatgtttgtagtactttatagcgtggaatttcagaagaggggccttccccacgtgcatatactggtggcgtgatgcaccaagcacagacgccacaccatctgttgtggatacatacatcagcgctgaacttcctgatcctaatgaaaatgagcttgattacttacttgttgaagaatttatgatgcatggtccttgtggtgatgccaatagaaagtgtgcttgcatgaaaaatggggtttgttctaaaaaatatccaaaagattttgcttccgagacaactgtagatgataagggtttcattgtttatagacggcgtgacaatggtagatttgcatataaaaacaatgtgaaacttgataatcgttcagttgttccgtacaatatagcgctgctgcgtaagtttgaggctcatataaatgttgagtggtgcaacaaatctaaaatgatcaaatatctttttaaatatgtcacaaaagggtctgatcatgccaacataaagtttaccaaagtgagaaaaaggaagttagggcgtgttgcagttgacgatagtggtacaccaagctctagcaaaaagatgcgtggtgctgatttcactgttaagccgccaagggatgagatggctgagtttattgcgtgtcgatatttatgtgataagcaatctatgtggagattatatgcatatgatattcattttagaaacccttctgttgaacgtttagcatgccattaccgaacatgaacgtggtctcttttagatcagacacaaatttagcatctatggtttcaaatacatttttacaaaaaacaacattgactgagtggtttgtcgctaatgatctattcccgcaaggccgtcacctaacatattgcgaatatcctacgatgtttacttgggaagatgatttaaaaagttggaaaaaaaggcagcacgactataagattggtaggatgtattacatccatccttctgcaggcgaaggatattttatgaggatgttgctcatgtacgtaaaaggcgctagaagttatgaggatattagaacatatgacggcgttgtttatgatacgtttaaggaggcttgtgctgctagagggttgcttggtgatgatagagaatggtcgtatgcatttgatgaggctgatagttgggcatccggcggccagcttagatcgctttttgtgttgatgattgttcattgtggtattgctgatgagagtgcgttttttgagaagcattggcatgcgatggttgatgatattctgtttaatctgcatgcaagccttaaataactcttcgtactctgttcctgatactcaacttaaaaatatggttctacaagaattgcctacattgtatgtcgcaacggtgtttctatgtcttcttttaatttgccaagcatcaattgtgatagctcctttcaatcagcaatagattgattgacgatgaaatgtcttatgatatagatgatttatatgtgaatgctccattgctatatgaccagcttaatgttgatcaacgaaatgcatatgatcgtattgtgcaaagcgtcatgacggaatcacctgctttttactttgtttctggctatggcggcactgggaaaacgtttctgtggaattgtattgttacctaccttagatctcaaaaaaaattgttcttgctgttgcatcatcgggagttgcttcattacttttgctcggcggtagaactgctcattcccggtttaaaattccaatagaggttgatgaatcaactatttgccatataaagcgaggtacaatgctagctgatcttattaagtccacttcacttattatatgggatgaagctctgatgactcaccgtcgatgttttgaggccttagataggacattgcgtgatatctttgctgaggatgatccttctgctgcatcattaccctttggtggtatggttgttgtgcttggtggggactttcgtcagattttacctgttgtggaagggggtgttagatcaaaaacaattgatgctgcaatatcaaggtcccctctctggtcacatgtgtctattttagagctatcgatcaatatgcgtttgcgttctagctctctaagccctgaggtacaacatgaaatcgctgactttagtgattggattctttctatcggcgatggtacaacagctgcaagtgctcgtgatactgacactgaaccaacttgggttgatatcccacacgatctcttagtcatggataatgatgataaaattggagctattatatccgcagtctatactgattttgctgaacattatagtgatcctatatatctacaagatcgtgctattgtttcacctacaaatgatatatgtggcactattaattctcgtgtactagagcttgtccctgacgagatgaaagaatacctaagctttgattcccttgcaaaaacaaatgagaaatgtgatgatttagatgttttgtatccaatcgaatttttgaactcaattaaagttaacaattatcctgatcatcaattgtgcttaaaaaaaggtgtgcccataatgcttttgagaaatctagatcagagtgctggcctttgcaatggaacgagaatgattgttacaaatctaggtgaccgagtaatagaggcgcgtatcataactggttccaatattggtcagactatttatatcccaagaataactctatctgcaaacaataagaaatggccttttacattacagcgccgtcagtttcctgttcgtgtgtgctatgctatgactataaataaaagtcaaggacagagtctacgttcagttggcatttacttgaaaagcccagtattttcccatggtcagctatacgttgctctttctcgtgtcacttcccgtgcaggcttgaaagtacttatcgaagatgacaacgggaattgcacctctcgtactcgaaacatcgtttatcgcgaaatattcgctgctcttagatagttggtggttgctgtcgttttgtttattttattcctgcggtgtacatatatacttgttttgtttatatctaaaagtttgctatgctgttctatggatcctgtatattacctggttatgctgcgcttttgtttgctgtcctactatactctttgccataggtgatgcaccacatatttatctgcttattttatgctttttttgcccttttgcatgaccttgttttttgctttcctatagatggctttcgatttgctgtgtgacatatccccagcaagcagaggctggaagatccgtgcaaagatagcaagaatgtgggactacactggtacagctgacgatctgcctcctatacatgttgatctggtgcttattgatgagaaggtatatctcattagtccgaatgcagggcacctttatattccctgtccaatttgatttgcttacgatttaaatgcttatgtagggaaatgcaatgtatgctgaaattccaggcgttgaggctgataagttcagaccacttcttcaggaatcgaaagtctacacttttagcaagttccttattttgcctagcaaacctgcatacaagcccttccctaacaagtatatgatcaagcttactccatggacaaacgtggaacaggtcaatgaagttcctgctgatttcccatcccatgtgtttaatttggttcaattctcatatctaagcctgcgcgttgggatgcaagagtacttcactggtttgttctttcctttaccattactttccattatttatgctatttatagcatttatcaatttaccaaccactgttcttaattctttttagatgtgatcggtatgatcattggggtatcaaagctagcctatgtccgaatggcgtctaaaacgtcagacacacctaagagggtcattgctctaagggatcttgcgtacgtagcctccgtgatttacttgttgttctagtctttaccagcttgttgtttatgaccctgacctccaatgcatggccaattattttgataaccgttcattcttccgaataggaactgtgaggttaaacttgtcctatggggagagcatgctcccgactttgatgctgatgctgttcatagtgttggccaagataatgctgtcgttggtatctttgttgatactcttatgaaagcatataatagtaagcttttctccttctctgcatgtttagttctctctttattttctgatgccggtgttgtatcttcaatgtacacttgttttttttttgttgtctccacaatcatttctcctatgtattatgtagatgaagaaactcttagtggaggatcagcctgcaaatggtatttaaatgaggacataccagagataaaccagttctttgataggttagtaaaagcccctcacaacagagttaataattttttagagttctaccccctttctctaacatgtcgttttccatgccttgattagcctgggtgatagtgctccaaagatccagtggatatcaaccggagcagagtcctttggttcgtcacaacgcccagcacggttggagcataaatctgttgctgaccttaaaaagattgatccatgggaagctgcggtaatcactgtaaaaagcatattatatgctttcgcatatgtatttttcatttagttcatctacaaggttattgctaaacacttcctatgcagggtgctggcttctcatgtactgtgaccatagctaagttgagcccatctcagtcatggtggttttcatcctgttcccgttgtcatagagccgcaactgcatatggatctagctataaatgctccagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactaattcagcagagtttgtgctatttggacgtgttgcgcagcaagttgttggccgtcctgttatgaatcttatcaaatttcagggcagatcagacaatattcctaaagaaattgctgctgttgtttcacagaaatttacctttgctgtctctgtcactgagcggagccttatgcacaggaatatatcttttcaagttaatggaatcgagactttctttggaagacagggttctattccgcagcctagggaatagggtccatctgcaggcccttctactcctttggctcttgctgcttctggtatggataaggatgacgcctctcaatctcatgagtcaaccccggtcgattcatctacttcgactgctgatccagtcgatgaacttcctggtgacagcaagaagcggaaatccattgtccgtcatgtacgcccttccattcatatcccatacattaccttttgctttttttatggcccttctttttatatgtctgattgctattccagcctctagcagcacagaaaaaattgacctttgaaacagctccatccagcaaagaaaacaccagcccggttgaccctcctactaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgagaaa

SEQ ID NO: 71859 - DNA, 932 bp, Oryza sativa
atctgtgtgataatgttagtattatattagaatataaaattcatgctaaatggtagtaagaaataaatttacatgtacaagaatataaaatggatggtaactagtaagagttaaatgacattaacatatattgcaagtctttaattgcacctctactacttgttttatgcaacatgacttcatgaaagtttcaaaattttcccctgcattctataggacctttttggtgccgggagtgagacatcagctaatacactccaatggactatgtccgagctcgtgaggaacccaagagtgatgcaaaaggcacaaactgagctacgtgattgtcttcgaggaaagcaatcggtgtcagaagatgatttgatcggattgaaatacttgaagcttgtcatcaaggaaaccctaaggctgcatcctgtagtgccactgcttcttccgagagaatgtcaagagacatgtaacattatggggtacgacgtgcccaagggtacaaacgtgctcgtgaacgtctgggcaatatgcagagatcctaggcattgggaaaatgctgagacattcataccagagcgatttgaggatagcaccgtagactttaaaggcacagactttgagttcataccatttggagcaggacgaaggatgtgccctggtttggcatttgcgcaggttagcatggagcttgctctagcctcattgctatatcatttcgactgggaactccctagtggtgttgcgccaagcaatctagacatggaagaggagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgtt

SEQ ID NO: 71860 - DNA, 3789 bp, Oryza sativa
gacttaagttgtatgaagatctcacttttgccacttattgtgctagccccagtggcaaaaacaaaatgcacagggcaaaagtgagatacgatctttccttagtggcaaaaaaacaaccctggtttccatgcagatcttaagcttacgattactgatttaaaatgcaaattgaaatcaatgcaacaaatcaatcatatgaaaaccaaaaatatgtttaaagcgctacacatcatactatacagtggctgcagcagattgtagcaagaaatagaaggcctcagtggacccggaactgtacatagagccacagacaactgttgtgcagacacaactacccccggatcatgaccgttatatcagggctacacagagttatttaaaataatggcctaatgggtactccatatgcttgtctcacattgggagttcaagattagcttgcactagtggtcaaggaatttcaaacacactgtattaatagaaactagtagtagtttttaattttttttttcacatttagcaaatatctattatcatactaatgctgctatatccacttgatcaattcatactcttgttctgaaattgttaagtgacaggtaatattgccatccagaaatttacctagttctttaacacactacattgactttaaagcaacgtctacaacaaggatacccagcaaaaaatgcaaaccagtgtccaaatcaccaaacagatgtaagaaaggcaatcatactgaatatgatagtgataatcttagtcatctcaattgcaaaacaaaaaacacattatggcaatgaagtcaaagaaatgtatctcatgtactttgcttctagtaccaataaatctgagtcttagaaaaaaaaggaaaagatgtagtcatgctaaacataagaaaagcaacgagataaatagctatgtaaatgtcatgtaaattgttacaataacatgaagataaaagtaaattcaaatggtatcatatgatcaagatggaaatacagaccattttcttgttgaatctcccattgaatcatcattttttccaatgacccgtgaggtcatattggaagtggatcctccattatttctgataggaggaacaaaattaccacgtaatccacgacgagaattccaggttggccttacaccataattccggttatttgggttgttatcacattgtggggatacagaagcaccttgagtaccattatgcccatacttttgcacagaatccatctcctagaaaacagaagcatcagctagtgaaggttacattgacaaaatattcaacataaaccagaatggccatactaagctctcctaataacgataccacagcaaggcagatgccacatagtgcacaaaaatggtttcacccaaatgcaaactttgtgtgtttagcaccaaaaaataaattataattctcttgctaaaagagttttcttgaaaattttatgatttcagaagaaacaccataaggatctggaaaattgtcgtttttacaaataaaatattcgcacagaatatgctgcaatacatatcatggtttcaagctatgccataagtagaactttatttctaactttagctaactgttacctaatgatgctttcttaggtaacgtgtagaatgctcaggactgcagtgcatgcagcagacagagaaaagtaaaaaaaaaaaaagaacagttaaatgatatggatttgccatcaaccaatggtcattaagaaatgcacaggatttggcacagtggcaaaccagcaagcataaacgagcataacaaagaagctacccattttcaaaactatgcgatgctaaaataatagaaagagtcttggcacgaatagtaaatgcagaagttaaatacacctactatcatatgccactagtgcttacgatgtctttttgttggaggatcatagaataatagaggcactctaaatatttaccaaaattgtacaatatagaataaaagcactgagcgtaccaactttgtcctggcagtcacaaactcattggcaggggcatcggcttcatcattacttaatggagaatttgcatgttcgcagattgggcttctgaatcctgcatgctttcgctttgcattctgcaacagtccacggggtctgtcatcatcttcaagatccatataagcagtatacttgttatcagtatgatttgttctgactccattttcgacagcaacactctcattagatatgttactcactgatttgaacatattcccatcttgtacaacatttgccttcaggggcttatggctacgcagtgatgttagttttctttgcattactaattttgaagccctgatgctaagcttctcattttccatatcagttgagttttcctctacatgcggaccttcttcaatggtggactcttggcaatcagtggtcttctgtatttcagttcatgtcacaaaaagagaaaatgatgataaaatcagccagcaaacaatgacaatttgcaaacaattaacattggaagttgaaagctatgtgtttcttcatatggtgcttcaacaaaaaaaacattaaaaagagttaaatcacctttcagaaatgatgttgtaaataaagaattaagaaaaatggggcaatggttagatgtccctcaagaaggaagaaaattaagaatgagaagtacgaacaataaggtcttttgagcacgtaaagcctaacaacataaattgaattgtaccatttgttcagcagcatgtcctttggatttctgaagaagtgcttgaaaatactttgaacacttgatcttttcaatattaacttctcctgtctttgcaaaaacacaaccaacatccttttctgcaagcttaaacacagcactgaaatcgaaaacatctaaagtgaggactgacaccaagtatcacgatagtatgcatcagagcatcacaaataaacttgaacagtgcagaacaaagctaaagtaatttggtttaacagacaattatttgttctagcggttacattgctcaagtagcacctctacgtcctgggttcaactccccaagggagcgaatttcagacttaaataaagaaaaatataccgtgggggcctccctcactgtttccggtcaaaaatgaaatagacaactatttgttcaagattaaacccaagaagccactcagtttccatcagtgatggcaacttaatgctccaatgcatatggtatccgtaccaccaccaaaaagaaatcacatttccaaaaatttactagtccagtagtcctgaccctgataatatctgctactgctaccatctctactataaaattattttgactacaaatatcagaagttggattcatccttgcagaacttggttcgatgttgcggaattttcacaaatgacactccttaactttcatgcttacttgcttagccctgacagtgatttctgcaacgccacaatcgttatttaccagatcgcagcacattaataatgaagacatgtgtatgtcctgcaacacttatatctgaatctaacttgtagtggtatatgaatatgttagtcaattcaaacatgcttagcacatacatggaatgatctgaggaccttaaaattgaaccaaaacacaggctgatgtcaaccattgccgcagtggtaacctggtgatttcttcctcacttaaacaatgagcacaaacaaaaaggcaaaaatatttcagtacgcaatgtgcaacataagaagaaaaaatgttcttggccctatttatttagacaacaatttctaaacttgagtcaaggt

SEQ ID NO: 71861 - DNA, 3262 bp, Oryza sativa
cttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaattgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagtgtcagtgtgctttccataccgtagcagagacttcctatgaaacgctgccatacgactgcacatcaccccatcttttgcttgtatgttatttattgtaaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaagcttatgtttcatgtgctatgtgcctgtgcaggaatttgaaatttgtagcatttccatcctacccagctaatgtgataagtaggattttgtgccatcctttctgtcctaaagaaagggtgggcaaaatttgcagccaaaaatagcatacgcgttggatcgatctgcattttccacttctacagggcaagccagatgcaaatgacatgcaaatgaccatcgatgttctgtagaccacacgtgaatagtcaatgtattcaggaccacttaccagctctactgccactgctatgttaattagtgttgcaccttaagattattatcataggtactgcagcaccttacaaatatcagacatatgtatgttgttagcgctgcaatctacttatctattgccgtctgctttcattacttttcccccaccaacactttttaaccgttcttccctggctatcagcttattgggcggcacacgtgcgtacaggcggcacgccaagggtgcgccccaacctctagtagtgttaataggtgatttaccacacaactggtcaaactgtgcatttagagctagcaaatacttcttgtactcatttcctatttattgcttctccaaaattattttctagatcactacagaactgaatctcaacaagaaaaaacacaagttaccaaaacctaaatttgatgtatacatccaccatgatctgaatccatacttacatccaccatgcatgaccctacaaatgaacacaaattgaccatgcatgaccctgtgggatgaaaatataccctgcaaatttcccagtgaaagaaatgcgtctgtctaggaaaggtcaggaaaaaaacagaataaatattgctactggcatttgaattttaaatccatgcacacaataaaggaattttttttgaccgaacgaggcattcaacaggcacccaaatgaaccggtacgtcctatcgctaaacataaaccaaattaaccttatcctatcctatccaacagccacccaaagttctgtataatcccaacagcattcacatagtctcctctatcatcaatatcagtttgaagaaaacaggaaacatgtgtagactaatggcattttttttttcgctgggccggagactaatggcattttcatttggctgggcaacgaaaatcctaaatgatagagcagaactggacagtgaagcacgacttggtcatcaaacatcagtttcttatggccgcaaggtctcaactaatttgcaagctcaacaaacaaaagaatcaatatcctctcagtttatttttttgacatgtacttccacaattccatattacgctatctagcttgacaaaagattaggcctgcaatctaaatcagagaaacatattaagataataactttctttgccacactgcccacacattcgcataataatttattttctcacaggtttatgcacgtacacacataatagccatgacactgtaataatgaaggaacgggatcgagcgacgattaccttgttcgcgtcacggtggagagggctaaggtggcggcgcaacggagagcagatggcacgagggagtcgacggcggcgtcgcagtatagaagggggtgcgtgggtgagcagtcccggtggcggcgcgaggggccgggatcgacggcccgtgacaacgatctacattgtgtgggggcattggtggcgtaaatctggaggcgggaatcgacgacgatcctcgtgagggacgctggcggtgtcatctggaggcgggaatcgacgcgctggttggggcgtcggcgacatcgatctggaggcgggattcgacgatgatcggagtgagggtcgaggtggagagacgggaatcgacagcgacgcgagggggcgccggtggcgtcgatgtgaaggcgtgatggggcatcgatggcgtcaatctgaaggcgggagtcgacggcggctcgatggcagagcgtgggcggcgtcgcacgcgatggcggggcgtcgaaatcaacggcagcatgggataaaggaggaggtggtggcgacaattagggttcgccagggggagtgcggcggcgcttgtg

SEQ ID NO: 71862 - DNA, 4902 bp, Oryza sativa
cgatagtatgcatcagagcatcacaaataaacttgaacagtgcagaacaaagctaaagtaatttggtttaacagacaattatttgttctagcggttacattgctcaagtagcacctctacgtcctgggttcaactccccaagggagcgaatttcagacttaaataaagaaaaatataccgtgggggcctccctcactgtttccggtcaaaaatgaaatagacaactatttgttcaagattaaacccaagaagccactcagtttccatcagtgatggcaacttaatgctccaatgcatatggtatccgtaccaccaccaaaaagaaatcacatttccaaaaatttactagtccagtagtcctgaccctgataatatctgctactgctaccatctctactataaaattattttgactacaaatatcagaagttggattcatccttgcagaacttggttcgatgttgcggaattttcacaaatgacactccttaactttcatgcttacttgcttagccctgacagtgatttctgcaacgccacaatcgttatttaccagatcgcagcacattaataatgaagacatgtgtatgtcctgcaacacttatatctgaatctaacttgtagtggtatatgaatatgttagtcaattcaaacatgcttagcacatacatggaatgatctgaggaccttaaaattgaaccaaaacacaggctgatgtcaaccattgccgcagtggtaacctggtgatttcttcctcacttaaacaatgagcacaaacaaaaaggcaaaaatatttcagtacgcaatgtgcaacataagaagaaaaaatgttcttggccctatttatttagacaacaatttctaaacttgagtcaaggtctagtgggttgaatcctactatagggagcaacgaatcctaaacaggatatgcaatttgaattatgtgatccacatgtattcaacatatacataccactaatcatggtggaagatagaccatcacctttgagtaccctttgctttgaaaaattactttcccacaattacacatgactttcggcaccattatgcctgctctggtcaatattgttttgcttcatagagcatgcataaaaaagacactatatgctaagaggaagagcagcgtgtattattttatttccattccagcaaaatataatgtatatagcatactaatattacattagatggcttaatgtatttggaaacaaataaaagcaagctcccgagaaccacccaacacaaacagtggaggcactagtacttagcttgcttgtttgtgcacacggtaccagttcatcttagtcacggcaattctccaaaatccacagatttctagagctatataaataccacattaagtgaatactacagtatcagctaatggctctatatatttgcacaatctgaataatagcgaaagcaaatccatccaaatcgctcccactcttcgcccgaatcgaatcgaggagaccctcgtaaacacggcgagccgtctcaacgcatgatttgggcgaaaatgcgggagagcgcgcggggtggcgtggctgtgtttggggggggggggggggggtagggttttgtacctgtctgacctcccggcgcgggcgcggatggcggcggcgacgctggatgacgccgcggcgcggatgggcgcgacgaagctggcctcgtggcccgccgcgccgccgtcgccggggagggcctgcgagtcgaggaagccgaggaggcggagcgcgagcacctgcgcccccgcggggtccttgcccttcagcgcgacgtccgcgccgaactggagggagtggagccgccgcagcctatcgtccgcctccttcctccagttcgtcggctccccggagcccgcgccgccgccgccgccgtcgccggcgtgagactgctccgccatttcgcgtgtttttcttttttgttttctttttttttcctttcgccgcgcgtctctgctggtttccttcccgctcgtctgaggaaggaagggggttttagagctgggctttctaagtggtagtcatgggttattgggctttctatatgggccggcccattacaaatttacagttatacttatatccaacaaaagaacacttattttacaatttacaaatactcaatagaactttcaaaaggaaaaaaatacttttttttaaaaaaaataacgatacctttgatcttactgtaagtggtagttttgttggttttgggaccaatatatgcattcctaattctgtgcacttttaaatacttattaatatattaaaatttgcaaggtaacggaaagtgttgttttgcccgaaaaataaatctcattcatccatttcatattacaagatgtatttttttaaatcaaaatttttaaagtttgatcatgtttatataaaaatatagcaacatctccaacaccaattaagcccggttcttttcttcaataaaaattggataaacttttagatactcgtagcacgcttttcaagctgctaaacggtgcgtttcgtgcgaaagctttctatatgaaagttgttctaatatatcagattaattcatttttaagtttgtaataattaaaactcaattaatcacacgttattaccatctcgttttacgtgaaacacttaatctttatctttatctttatgttcaggagattcaaacaccaccttagtttcattaaacgtaaagttgaatatattttatactatattatttttgtgaataaattgcattcacgatgcatcaacttggtaacgagggtgcaatttggtgcaaaaatttgagaaatgagtatccttatgcaataacttagtatatgggtgtaattagtgtaagaactttataagtgagcgataagttgtaaagttggtgcaattttggtgatgcgataacttaattattatgagtattttttatacaaattcaattttaagtacttatttaaactttactatatagaaaatattataatccgatttagatttgagaaggtgaaaaaaaaaatccaaaccagtggtgcaaaatggatttgcaatgtaattctaatatccgtaagattgctatgtaatgccatattgacatttgagaaaactcacctagcactcgttaagcaaaacatcacatacttagctaagttgctgtaccaaaaatactacattatcaagttcttactagaatgtactcacttaccaagttgttccactcagacgtaattctcaaattaaattatatcataccccaccaagcaagttgttaaaccgtggttgcaatctactcgttatttttcattgttgctatatatacaacatggactttacggtgtttaagaagatacgtacaggctagttccacttctttttatggcaaaatctgttactcccttcgttttaaaatgtttgacaccattgatttttttagtacgtgtttgaccattcgtcttattcttatttattcttttcatatcatttgattcattgttaaatatactttcatgtacacatatagttttacatattttacaaatttttttaataagacgaacggtcaaacatgtgctaaaaagtcaacggtgtcaaacattttgaaacgggggagtatatttcagcacatcgggtcttgagatcaaattttacactatttttgtaccctctcgatacctaccatagaatgcctgcatatatacaataatatttaagtcacgttcgtttcaggaaaaaaaaaaggtcaccaataaacaccatgcactacatgatccctactctctagttttccaacacgacacgtatgtctcatggaaatggatcactcaggctataggcttgcatatgacatactcccccgtcccataaaaacccaacttattaccgaatgtgtaatattacgaatttgaacatatatatatatatatgtccaaatttattatactagaatgtgtcacatgtggtcctagattcgtttttttataagatggagggagtatgaaatgcctgagacggagggagtatgaaatgcctgtatagctttggtcggcgtcctggtgtgtgttcgtgaaatagtatcctgacctgaccgacgctctggccatttgatcgattaattggccttggctcacaggctcagggctaaaaaattccaacggcaggcaacggtgagtgagaagacagtagagtgagtgctttgccaatgaaaatgaggatcagtcgaattcagatgccggcccgtttcatttaatttttgttggagaaagttaaaagttgacacttgtaatgtacaataatgtactagccaaggtttgtttattgatggctggccacgtggcaccgtgctggaggcctggacctggagctacaactacccgcgggcgtcctcggcgtcgcgacggcgtcagggtgcgggcggtggcggaaacaacaacctactggtggtgccgccgcctgcggccaagcagagggcgctgtcgctgatgaggaccccgggcctcggcggggagagcgcgagccgcgaggggagagatcgagcagaagcaagctgtagcttttattgctactcacaaaattaaacgaagtttaatgaatcaatgaggaagaatagctactttagttagtctctaaccttttaaatgttttaaagaaatccttaacctttgtcataaaacctaaaatagtcctttgggtccaccaaaatcatcatatagatatgccatatcatcattcatgtaaaatctatgatgaattgttcaatttacccttacgtatatcatagaaaagtaaatataggggtgaattagatataaccataggaaaaaaaatacttcttttttcacccttttgatgtatatttttgctcttacatatatcatatatatatatttttaac

SEQ ID NO: 71863 - DNA, 720 bp, Oryza sativa
aggacctgtccagcaaagaggaaatcgatcaacttctttttttttttgcggggaacttcaaatatctataactacctgacaaattttcactcaagtttcatttgcaatttccttaggaatgcattacattacagagagtgcacttcgaaagaattgttgaataggcatttcacagctactattaagtatttcacaacatttcttcagctaaactgttaattttgttgatcaaatcatatcaggtgaatcttcaatgctggaacaaagccaacgaaaaattgatctttgcaagcagcaggacaagaagctgtgctctgcaactctgcatgagagaagcaactggaacaatggcagactaatactagcacctaacactgaaatggagctgtctaattcacttgatcctgtcagctgtcagtatgcaaagggagatcgtgcaaaatcagaaagacaggtttggcttctatgctcatcttaatgattggtaggagaaaggacagacacagagcaccaactaggtttcaaattattttaaaaaattgtaggcatgtagcacacacccgatttggttgcaataacaaaatgactaaatgagtagggtgtgatgagaacttttgatgtagttaggtggggtccaattccaaacaaacgtctagacgccaaaccaaacagaattggttttccactcaggcaaaactgtaatcagagagcgatagacgt

SEQ ID NO: 71864 - DNA, 685 bp, Oryza sativa
gaagagattagagatatcccttgctctggttcgcaaggcagctttctttttatccccctttatctccttgtatcactggcccttttttggtgtgtgctatcagggaatgatccactttagcagcgatgggttcaagcaacattcccgatgacttttggcaacctattggtaaactatttaaacgagaacgcaccatagtttaagcttgatcaacacgttctgacgtccactgtctcaatttcctggatctctaccgtgtgctatcgttttttaatagattaaaagtttacttcagccgacgcgaccttccgtagtttcctctagaaatatccgaatgatcattatgcacaatgtggagtaacaaaaattatatgatacttcctctgataatccgacaagatccgtttccgtttcactggattcctagacctccaccgcccctagggccgccgcctctgctggagtcctctaccatcgctgacggtatctgcctcccccctcaccgagaaccttgcaccagcgctcaagccaccgccgatcctagggccacagtccccgccgccgaggaagtcttctccccgaactaccaggctaccgccgccagtggccgctgcgtacgggacccacctccgtcggatctgccatctcgtagctgaggattggttgttgacgctaggctgtcgtt

SEQ ID NO: 71865 - DNA, 3445 bp, Oryza sativa
ctatagggcgaattcgagctcggtaccctgtcaccgttggatgggtgatgaagaaccctggccgttggatcaaaaccgcccgcggtccaccgtaggagttctaggtgggccttgtccttcatctgggcccaaaaacgggagcgcacctactcatctagctgtgctcttttcagtgagttcctaactcaccccttgtttttagcatgcataaattctttgcaaaaagaaaagaaaatcttatgaaagttgcaaaaaggtgacatatttttgttctgctatttctgtcaaaggaagtaacaagtccagtctcttcaggagtagcaggtaaatagagatatctgagacataatttgctctctgaatgacaagttttgcatggatttgtttctgttcttcattttttttctgtttctggtgttcttagtttttcttcgcaccacatacagattctccgattctcatggtgtgcactgcaccatcctacactaaccctagcaagaatgaaatatgtatatcttgagaatcctttgtaaaagtgtaaaaccttattgtccctcgagaatctctatatcatcctgctatattaaaatattgtcccttagtcaccttcattctttcttttaaaaaatgtcagaaaaatggagttctacgtggtgaaaagatccttcctttcttggaatggctctggctcttcagtaccaacatgcatggtaactgcacatattttgcacataagagtatctctaacagcctctccaaatcgaactcctaaaacacccatatagccaactctccatctgatttagctagtcaaattaactgtatactccaacagcctctctattctaccctctctattttgactatgacaccgggacccatatgtgagccactcccttattctttctccccttccttcccctcttcctcttttcttttctagcgttgacaagaagcaggcggcggcagcaagcggggaggggacggcggtgaaggcagcgtcggcgggaggcggcgctgcgtggggaccggcgggctgcgcggcgggaggcgggcgccgtgcggaggcagcgggcggcgctgcgcggaggacggcgggcgcggcgagcttgtgccgcgcggaggccagcagccacggcgagcgggggcggcgggttgcgccgcgcgggggccggcggccgcgacgagcggccgcggcaagcggaggacggcagtcgcggcgagcggaggccggcggctgccgtgctcgagtttctccccatgcctcgtcgggctcctgtgcttggctgccgtgtggggatgaggaagatgggctctgtggggcccaccattggccagccaaataaagtgaccaaatttggctagtggagggagggttttggccagccgatagcttagccatccagttgaagaggctgttggagcacgtttttttggctagaattgctaaaatttggtttgaagagtgggatggagaggctgttggagaagctctaagtaaccgatgaaatactgagaatcacaacactgggaacaacatgttaactttggatcagcaccagatatgcagaattttacaagccatggtacaaccataccgaaaacagattgtaacaattaaccatacacacagataagtatatctgtgagatgacaagggaagcacccaaacctgccggtaaacaaggcataaacacgcatgcagaggtaaacacacaatgctccacggaaggaaaccaataactcctgctgatgaatgacagataacttataattctatgcatcaaactacctagctgaaggtactgtctcacttgaatcaactgcctcgtctattgtatctgcttttgagttcttctcttctgtgatgcagtctgaactatcaggatgagacgaatgagatgagtcctggaaggagctggtcagatcaggcttgaacatctcatcattctccaagttggaaagcttctcagcagattctcccttgagcagctcaacgacttcagacattatcggcctctgttcctgtttgttctgactgcatgcaagcccaacaagcaccattcgcttcagttcagcctcgacgaagacatccttgagctttggatcagcaatttccttgaactttttgtcacgggcaagtggaagtgcccactccgtgatagttagcttcgtagtggggtttagcttctcaactggcctctttccactggcaagctctagcagcagtactccaaagctgaagacatcacagctttcagaggccttcccaagcatggcgtattccggtgcaagataaccgagtgtacccttcacctttgtagtgacatgggttgcaccatctggaatgagctttgcaaaaccaaaatcggcaacccgtgcttggaaattcttgtccaacagaacattgcttgacttgatatcccgatgaatgatatgtggtgtcgcttggtgatgaagatatctgcatggtagagagagatttcagatgtaagattacttctgcatgtactgaaagttgtcatactgttacagcataatgaatatttcataaggatgtaaaacatgcttacgcaatcccttctgcagaatcaatagcgatcttcattcttcgttcccaaccaagatggcattcagctgcatgctgtccatgaaggtgggagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcagattgatgctattttcaaccataccattttttggtaaagctgccaaaaaaatgtctatgtttagtttgttgtcaaatttggtaaatacataagaaatcctgccaaaattttagcaatattgtcatcttaaattttggcaacattgccatcttgctaaaattttggctacaatctgaataggcccgtatttttttttcaacccaaaatgaaacacaactcaccgggatgtagcagtttgggggttatatcaccatgcaacaaactaacaagtaccaatgtagaacagtttcatcatcttcataataaatgtgcaactgtctgatggaataagtcttacgctgttggtcttcttgtgctaattggtctttgtgttctttttgcttttcagtgcatctttcttttatgacagcatctcctttcacttt

SEQ ID NO: 71866 - DNA, 554 bp, Oryza sativa
ccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtagatccaacccgaccggagtatgtcttttgacgagatcggaaccatcgtcatcaacaatttgatctatcgagatcgtccaagcctctacaaaggtacgcaatgatgtcaaactagtacgcaacaagataattggtagattggttttgaaattaatctactaatttcatagatacatccggcatgtatctacaaaggtacgcaatattctatatgtgatttatcatagctattcttcagatcaatacaatattgtcagatcaataatttattatgtctacctagagcatattttttatacaacatctattgcacgagtgtttccgatgttaggccaactacggtttaatgctgggggct

SEQ ID NO: 71867 - DNA, 7999 bp, Oryza sativa
gatctatcccctgaatcgggatgattgcgccggtctgaccagtccagggctcggtctgaccgacatccagaggcgcggtcagaccggcttgagtcccggtctaaccgccggggtaatacccggtctgaccggccatttggccggtcggaccgatggcgaagtcgcggtctgaccggccatcaggcccggtcggacaggccatctgcgccgctccatcagttctactacttgtttgatctgtaggagcttggctagcactagtagaggctttatcttttaacataaaatcggccatgagagggccgaatttagttcttaaaaactcatcaaatcgaccttcaatagttgcgtctaacttatttttaaaaataaccatggatgaatctattgcagatgcatcttgttgttggatagattgtgttacctcttcattgcttaccaaatcaggagtgagcttaggacgtggcccaggcttgatgatcacgccttgacgagtcctagtgcacgcccttatcaacgcctcatgtgtgatctccttaatgtactcctccatggacttgcgatcttccccttcgaagtcatccaatgtgattggtatcacattggtcggctccacctccgccttggatgacgactgcttcgtcatggcaaagtcgaagttgagttgacattgaacggatctccccagtggagtcgccaaaaatcgtgttggcaacttttttgtgacaagttgacaagcacgatcgtagcaccttatgccttgcggtgatcctagagtcgccaaccaccttgatatagcaaagagctaaacctagatgggtttttacaaataaactggctagcggagccgattttagataactacccgtctcgtgggcaaaacggaaggttttcaggacaaacctacaaagagatgtcgcactctcgcagtggtggcgaacggtttacgacgcaaaccgacaaagatggacaaacctacaaagagatgtcgcactctcacagcggtggcggacggtttacggcgcaaaccgacaaagatggacaaactaagagaaaactaaaagcaatatgaaaaacgattcgattgattgattgtagattggttgttacaatagaaccggccatgtcccttatataggggttggtcttaccctttacaggccctcctccacatccaactcggggtagaaaccaaaggaaacctaaagcatgccttcccgagcaaggaaacctcgagacccgaggaaacacagtccgactcggacctgccggtcagaccggccacacactgccggtttgaccggccctcaaccggtggtcagaccggcccactcggaggaaaccggtagacttccaaatcttggcaatctttcctatattaatcctaggtgccaaatttgggtgtaaacgttatgtattgtgtcttacactttttttttgttatcgattgcaaatggacagaagttggatgtactatattcaccgttcgacactagagtatggggaagaggtcactgcattcctaaattttcctaaattttgcacataatgacaggaaaaataggttgagcaaatatatgttgtgtccatgtggactgtaagactaataaaatgttcgagaatagttcataggtgcattctcatttgatccttagaggattcatggagcactacagatgttggatgtcacatgctgatacatccatctcaaactaaaaacggaaaagtccattttacgccctcgaactcttatgcttgtccaaaatacaccctcgaactacaaaatcgaatataatacacccttgaactgttaatactgacacttaacccccctcccccgcccaagcctgtttttaccgtggtttatgacacgtcggctgctacgtcaaccctcgccacgtcggtgtggagatgcgagggcgacggtggtcggcaggtgctgcgagggcggcagttctaaggtcacgcctcgcctgattccgtacccatccattgtccgccggcctaaggttagagaaaacggggttgctcgcccatttggatgagctcgacacagagctcgtccccatgcccaaggtcgaagaaggttgccgtagcgacgatgcagcgcagaggcgatggcgaaggcagacgaggtgggcggggctaaggtcgcggagggtggagctcgctgccacctgcgtttcctatccacctcaagctcatcggcatccgggccatctccaaccaccaagaccgcccaactacctatgccagggttatggatactacatacccaatactaatcgactaagcttggcagggcccaccacataccatgtcttatacgcaaataaacctagtatatagaaggagttttggataaggaaggaaaaatagagttctacatggaaacgacaaggactactcggattgtatccatattggtctccctagttttacttggacaagggggcatctatgggtataaatacaagccccctaggaggagagaggactagccacaagacatataaatcaacatagatcaatacaagccaacacatgccaagataagccgcaggatatcgatattagagataagtctagacaaaccaaatatggtgtctgcggaggccaacaagagggatctagcgctatctctgatttcgctgagtgcggattcgaggaggaagactaccctgtcgtccactttaagttggatatccataccgccaagttgacgatagctagataagttatcccaattattgtattggtgcgattgtgatgaataagagcaacaccggcttcagccaacaggaatagggctattacctgtcagataagaggcccgaacctgtataaaaatccttttctccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtagatccaacccgaccggagtatgtcttttgacgagatcggaaccatcgtcatcaacaatttgatctatcgagatcgtccaagcctctacaaaggtacgcaatgatgtcaaactagtacgcaacaagataattggtagattggttttgaaattaatctactaatttcatagatacatccggcatgtatctacaaaggtacgcaatattctatatgtgatttatcatagctattcttcagatcaatacaatattgtcagatcaataatttattatgtctacctagagcatattttttatacaacatctattgcacgagtgtttccgatgttaggccaactacggtttaatgctgggggctcactctattttcttatgtctaaatcatgcttgtttacggtttacataatgtctgatatgtaatctactcattatatcctaataatactagaagatttatgcaattttttcagtacatagtcgatattctctgctatatatcttgtcttcttgacaatatttttcaggaacaattgaacacttgagtaggatatggtcgagtacaccatattatcgagaacgttctcaaaaaatgctgagttgtcgcacccaaccttccaacgtagaccgacgacttatctcatgtatagcaccggctccggctggactatttgagaaaaggttgttaacagataattcctcgcgaacgttgtcggcttgatcacccaacatgattgcgaacagagatcgggatatgctataagttgggtatgtgagtcatgttggccacataagatgcacatgtaataaccaactctagcacccctataggtgattaagagatgcctattcctagttatcaactagactgttgtagcgacatttcgccttctatcaatttaaatttacttgtggaccattgaactccatatattgttgtcaaagactctacgtctctatggtcttacaccgggatcgaccaagtgagtacagcaaatattgataaggggagtcgtggataacataagatgctttcgtgaatactgtttgtttccgtatgcctatctgcctataggtgatcgagatacgcctacacctggttctagaccagtagatcgtagtgatctctcatcatctaaaaattcatcttcaggtgatcgagatacgcctacacctggtcctcgaccagtagatcgtagcgatctctcaccacctaaaaattcatcttcaggtgatcgagatagacctacacctggtcctcgaccagtagatagtagcaatctctcaccacctaaaaattcatcttcaggtgatcgagatacgcctactccctgtccttgaccagtcggttacaggaatctctcgacatctaatgcgacaatcaacatcatcgtaatagcaacaatcaagaccgactggatcgtcgttttcactaggacgacattgtctaggactaatgacataaggacgacaacggacaaggttaacgacatcacgacatcacatgacgacgaagaaactcgagatccccagacttctagagggcccgaagacaaggtagtaggtccaggagtcgaacctctgactacgataattcctaattgtcttcattgtcatcaggaggcagttctcgcaggtcacgagaatgtcgtccatctattacgctggattcccttcaaatggtcgagatatgactacgactggtcttcgactagcaatgtagcaatcatcgaggatcatcgcaccacgacttctaatggtcaagatatgactacaattggtcttcaaccagcaacgtagcaatcctctgtcgcgcccggaaaaattccttttccagaacgctagtgtattaatccccgtcctaggaaaagccgaggtacaccaaacaaacatgatacaaaaggcacatctttattatatcaataatatttacattattacaaaggcacttcaggcctgacaaacaaaaataaacaacagcggactagcgggcctacggctccatcttcacaggcgctcaacaggggtataagccaggactccacctaggacttcttcttcaaagcttctcttactgaaggggggagagatagagcaagaatgagtataaccacagtactcagcaagtcacactgggagatgcatgaataatgcaagggggtacaaggggtaataatatagggttaggttttgcagtaaacagcatttaaaagtcacttagttgcccaaagctattttataaacacgatcctatagctacacaatattattaatcaaggccgtgaaccctggcaacccgaactgggtcccagctcatcccaagccaacctaggccaactattacacattttagttgttaagtaagttttaagaattaaaccactaacttgggtacattgctaggcttgcccataaccgagggcgtggctattcgaatagatttactctgatcagaggtgtacatctttacccacaagacacatctttactccgcattctatggccttggaacccgtcataaacatgtgacataacccttcacccatccgagctgtgaacaaaagtaccgacctatcccagcctacggccggtattctggacaggcaggccaggattgagcccctagcaataggatcaagaccgggtgcgccacacacataggggtgagaccacccgcgtactagtccagtgccatggcatctcgactaacgggcaccgtcccgtgtagccttcatttgcctagacatctcgattaccgagccacagctcatgtagccttcatttgcctcagagatatccaccgtcgcaacgatttcatccacctctatccgtgtccttttgttcaggactagactgagcaccgagttaagccttacccattagacatgtggttagtacggtagtgctttgcaatagaggcccgaagactggtccttatagtggccgagatgctactagcaaaaccatgcacctcgagcccagcctaaaaccattttgggagttttgaatagaggggggaggtgtatgttcaattccatcacaagccaatgtcgacccccgatattgtaaatcggaaatcttctgtgtttatcagtaccaatccctggatcagtagttggtacacacatacatagccgaatcacaacatatcacaaatgaattcaggctaagagagttaaatgcttacattagggccaggcaggccgacaactatcagagaacaacagcggaagacaaaataatacaagggcccggttgatgtcgcgaccgagaaaattgccttttcccgaacgctagtgtattaatccccgtcccaggaaaagccggggtacaccacacaaacatgatataaaaggcacatctttattatatcgataatatttacattattacaaaggcacttaatgcctggcaataaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagagagtacaaggggataataatataggggttaagttttgcagaaaacagcatttaaaagtcacttagttgcccaaagccattttataaagacgatcctagagctacacagcattattaatcaaggtcgtgaacccacacgagcctgccttagcccaaggcctacgatgattcagaccgaactagcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaacacgtgccacataccaccacggtatacggacggaagacgtgacatagttcccaacccatcctagccataaacaagattaccgacccaaccccacctacggccggaacccccgagacaggtaggcaggactgagcccccagcagtaggacaccggccctgtgccatgacatctcgactaccgggccgcagttcgtgtagccttcatttgtcctaaagatgtccatcgatccccgacttcgtccatctccatccgtgtacttttgtttataaccagactgagccacaaactaagccttacccactagacatgtggaagtacggtagtgctttgcaacagaggcccgagcttagtccttatagtggccggggtgctacttcccacaactggcatgcacccaaacccaaccgaaaaacaggttttaggggctttgaaagaggaagataggggtatgtccaattccaccataagccaaccattccatagtatccaagagatatgaatattcccaaagtctaaagttataaaaaccacctaatgttgtccttttaaccagcgaagcatctacctaaagtcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataagctgggattcaatatgttcaaggatgatgtgacttgccttgctcgcttttccaaacgtcggcttcaacttccacgaagagcggatcttccgaagctgcagcgtctacacaaccaacggaaaagaaaaggcttttactctaaataacttcatttaacaagcaggaccaaagcacaaaaa

SEQ ID NO: 71868 - DNA, 32331 bp, Oryza sativa
  unsure (1)..(32331): unsure at all n locations
atatccactttctctaaagggtcagccgacgaaaaaccttgtcctaatttttctacttcatcaaaatcatcaatagcctcccaaatatcgttcttatttgaccgatattgctctgcacgtttttgtaaccaatctaaattgctttctttattcatttataacatcacactactgagccgagctgcagaagccggctttatagacacgggtacaaaaccatccttagtgacaataacataatcataatcagaaagatctaagcctgttaaacactgaatattaccatactgccaatcaactgaggcatcggctaaagcaacgcaagccgaagtatctgcatgaacaacctctacatcatcacctacccactgtattaaagtttgatgcaaggtagaaggaacacaatggtttgcatgtatccaatcacgacccaacataacattataattaccttgcacctcggcgacgaagaaggcagtagggagagttttgctcccaatagttagctccatggaaataatgtccttagcttctgttggctctcccgtgaatccattaagtgtcaaattagcttttagaagctcactgtcctctctgcccaatttcttaaaaactgaatatggcattaagttcactgtagctccaccatcaaccaacattctagaaataggcctcccattaatatgccctttgatatacaatggtttcatatggcggctcgattcatcaggcttttcaaaaataacatctttaggagcaagacataattgtgcaatctcttcatcgacgaccctaaattcagaaggtagtgtaaaaaccatattaatatccattctttctggaagcggagagccatctctaattaccggggaaccacattctaacagatcatgctcttcatcactgttttcttgaactgaagctgcaacttgtttcgccctccattccctgcgaacacgtaccatgggttcaggattgatatcattgaaaatttcttctctcatcttctcagccttagactgtctcaactcttgtgcgcgtaatctttgcagcctccgcttccgagtgtgtccaatatctggagggcaccattggagctgtttacctttgccgggctgcatagacacattttctccacatgaaccaccaccacaatcagctgctggcactgcagcggaagaactgttcatttcggcaggcacggctgtgattgcggttctgttcatctgggctggtactgtagcagtcggagcactgttcacctgggcctgttctgtagcaaccgcagtactaatcactttgttactcacatgtgaattgccgctcgtcgactgatcattttttgctgccaaaactgcactcgaatttcctcctgaatcgccaccttctttcacacgatgcaccttattcaccaatccaccatttttctcatcataagaccgattcctttgattagatcggtcatccctaggccatgacagcctatcaaacaccggcctccttggtgcttcccaacctggatggaatggttcaaatggcactggatggaatggtccatatggcactgggtggaacggttgatagggcatcggatggaatggctcataagtcattggagcaggaggcacccatggaccacaccaaccccatggtggacaaggaggaaaaccaacaggaggaggaccccatggtaacggcatcggtggcccaaaaggaggatatggcggtgatgcatggaaatcctcccatcgacgatccggaccctcaaacccttgcattggaggtgatcttggtcttttaaaattatttggccggctagcaactcctttgccggctcttccctcatattttgccgaaaggtctttgaatgtgggcttcggcttttcaaccctttttgtagctttgttcctactctcattaaccttccaccgaccaatttctgggcttctaggtttaatcatccttggcaaactactctgaccagacccagaactaggagtcttcactgtatgcataccaccatcactaactatcacagctttatttttagtggattcggcctgagatggccgaacaagtaccttgctattctcaaaatcaatcacattgacaggaaagggattactgtctagttgcatttttgggctctcagcaaacctcaatcgtccttcattgatggccgattgaacctgtcgacgaaaaacattacaatcattagtagcatgcgagtgtgaattatgccatttacagtatgcacttcgtttaagctcctcgggtgatggaatgacatgaccattaggcaatttgatttgtttttcttgtaataggtaatcaaaaattctatcacacttagcaacatcaaaagtaaatttcatttcttcttgccaattcttttgggacaccggcttcaaagcggagcaaacaaatggtttagatttcgatgcccatgaccattcggctacacacatatccacattctcatcatccgatgacatgagatcatcgtctacaaaattgacagggcgactagatttatcattagacctctaaaaactcttggactctttagcacggctttcttgagccagagcttgttgtaatacctgactaacatctaaaatgattttaccctctaacttttctttaaagtgtggaagtaatccagaatgtgctagttcagcaaggtccttgtcagataatgctaggctaaaacatcggtttcttgtgtctctaaatcttctaatataatcaacaacaggctcattatatttttgcttgaccgatgtcaggtgtgctaacctcaattctacatctccagtataaaagaactcatgaaatttctgctccaactaagaccatgtatgaatagaattgggtgcaatagcggtaaaccatgcgaatgcagtactagacaatgataaaggaaatagcctcaattttaaagcatcactaggaccagcttcaccacactgtgcagtaaactgactaatgtgttctaaagttgtcctaccagcatccctggtaaatttaatgaaatcaggcactctaaaaccacgggggtatggcactgtgtcgtaaaaatcaggatatggttttcgataagtgcgtgctctactcttaggttccacatcaaatgtttctctaaaaacactgaccaattgctctctaagtgtttccggcaccacatgtggctcggccataggccgattaggggtcacatcaaattgtggttgctgctaaaaaatgttaggctgtggtgtaccatgcaaaaattgtgtcatttgggtcggcggtgtatatggtgcgtgttgtaaaaaactattattactattaggtaatgcaccatatgtaatgactgaaccctgtggtggaatacgaggtatattatacgccacagtaggatatggaggcacaaatgtactttctaaattcccatttactcggctatcataatttgaattagtgataatcggagccgagctagctgaactatttggctgtggcaatgtgaatggtgtgcccccctgtccaacatcatgctgcatgggaaatggcaatgctcctgcactaccagccgaacccccaccattagttcggctatatatttgtgtcatcggcgtattttgttgtgttgtaaacatcgccgatgcatctaatccttgctttgatttaccagtagtgctagaagttgaagcattagtattatgtgatacttgtcgttgtgtgtccttcccatttgatgcactaataacagatttaacacaagcattgaaacgagcatctaatgcgtgatccatatttttaataaatacttcatgagtattaaaaaccacagcactaactgattgatcaatcataagagcaatttgttcttgggtcaccggtggatcacttacagtgggttttaccttaggttcgacatagacggatggcagtgtagcctccttctggacgataccttgcctcgtcttctgaaagcacaataatgtcagccgctccagttcttgtttctttctttcgatcgattccccagcggagtcgcggagtcgccaaaatgtgttgccaccaagatttgccctaggaatgcaacacttgatctgtcctgaaaaagcaacactgaagtttcacctggtacgattgtgtgtgcgtgtaacggaatgtaggagatggcttccttgctgtggcacagatgcacaacaagcctatcgcacagcaagccaggagcaacacgtctcctgctgctgctaccagccgacgtgcacgcagcagcggctgctctgccgcggcggcgtcgccaccagcaggccggagggactgcgacgacggtagacaccggcggccgtattggggatcgaacaaaacaacacaaaggaaagcaaaacgagtaaaaggaaatatgacaggaattttgtatcgattgattgtgtattgtctgtttccaatcggcctagacccatatatagggtgcctggtctttggcttggtcccacactaattagattagagatcacatggtattaaccaaaacaatgaaaattaacatagaaatgaaaacgttgcatatgcacagcgcctccgacttccttgcctctgtacgtcacctctatgctgccaacttgatcatgtgatcttccatccagcatcacagcatattaattttgttctcaagctttatcttccatagaaaatgtactgctgctacgccaggagccaggaggcaaagtaaaactggaattaaaccatacatgcatgcatcacattcaggagaagcacttgcccatatattctctgataataacctgattaaccattgaacaaccgaattcaattaagtagaagaataaaaacattcggcaagacctcgtccaaataaaataaccgaataaaaatcatcggctgtcaatttttgatatcaacacacacacatatgtacgacgttgaagagaagaaaagaaatgcccatgaaaattatggtgagttctggactgacttggttatatggtaggtcttacatcacattattatttagttttggagtggttggacgaaatagtcgtggctgggatgttgggcttggcttgtttgggtcgatagacggatgtagaatggaaacacccggacgaacaattggaccttccctaaggtaattgcccaagcatatagcatttaataaatatgagaatgcatgaatctaaattagcattactaagcatttgtcataagtgactagggactcatacgtaattatgggtacaaaggaataaggtaaacaatagtcaaatgcatgtcacaatagcaagtaggatattcatcattgcatacatttttatttgtaaacaaagtaagttcgcaattgggatcaacatgcttaagggaggggtgatgacttatctgctcaggatagtccttattcttgataatacttgatccaccttcacctcctggaagttgcatgagttgcctcacgactaaccgatacacattctatgataggcgataaaaaccaatattcaaacaacaatcaaatatgctcaaacaaaatataaatgttggagtcatacctagggctgctcatactactctcgtttgcttatggattgtatggtgctaagagatctcaaaatggcggtagcggcttatataggcaagggggaaaattgaggtagcttaggctctaaattactcaacatgcaagcaccttatgggcaagagagcttaggggctaagacttcttaatccttctattgtcatgatggcttatttaggagctaaccaacacacatgatacatacattttgttaacatgcggtttagtctacttactgggctatggatggactatcactacagtggctccactctacataaaatgattggcactagagacgtgaaatggctcatagagtaatctaaatgtaatgattcaaatggacaggctggggattggcttattaatggagattggaaatcacataacattagcaagactaacgtatatggttgatttatttgttggcacagtttagttaacttccgctagcattattactagaattcttcatgacatatgatgggtagattttttctaattgtaattaacattcaacaaatatccatgctcagtatgttagattcgtgtggtccataatattgtagttaaggattatctcattgcataattttacaataaacaatcctaagtcacagttgaactacaattatatgaggtcaagatttagaattaatatttttctactatacatgcttatcatgtactcctctgtcccaaaaaaaaaaaaatctaattctagagatgtatctagacaacctgtatgtccagatacatccctatgattagactctttttgggacagaggaatgcaaaaggtaggctattgttcttctatataatttaaatggaatgtagagtagctgtgagtgtaaaaatatactagtattggatcatttactgagcatgagctatttactgttttgttaattaatgggtgctaaccaatccaactatatgctattgcacaaatcaactttatttggtggttcattcataatagctctgttattattcctcacaaacaatctaaggactgatctatatgtattcatatttttagtgacaaaaatataaggctaaaattcatttatataatttggaagtcatgtgtataattatatatggacatatattaataaatggcactagtatttcctaagcttcaattaattcgaaacaatacttctaattgatttacatggtttctacagtggcacaacatgttaaagacaattattctcctacctagtttactgtacaatgacaattttcatttattagcacatttttaggtttgccattatctaaccatttgacattagttattttataattataaaataaattttattaaataattaattatataccattggaaagctcctaaatttagatgaattcaggttcaagtttcactcaaatcagagctaaaatgagtgagatatagtcaaaacaatattcaaatttgaagtaattccaataattgtgaaacagtactgttcctaattgatttatttttattccgaaacattatccacaacctaccatggctgacatgtggggtctaaggtttatttatctgatttaccaaattatttctcttaagaataattttgtagaccaaatgacaggtgcttgactctagtcaaaatcggcctgaggtcgtcttcaacctctggactgggaagtagacgcatgagcgttggctggtgcgaggcggactcggccggggatggctcggctacgaccaagggaggtgcgaacgggttccgacggccctccacctgtggtggcggcgcaaggcggagcaggggcgagcgttgcggcatggcaacgccatggccgagctcaaggaggttcggggctttggcgatagtcggggactccggccaatttattgaatggaggagtgtacagagcgtcttggggttcgattttgctaataaggtgggtgagaggagctttgggatggcatgtccacggtgagctcgacgacggagcaatgtacgctcgggtctgcatggctatgggcgctattcgccaaaattgttggaggcgccagcttctatggcactaggaagaggctacaagagctagggattaccatgatggcgtggaggataagctcggcaccttgctcggtctcggttgattcctttccatagtagtggaagaccaggttttgatggcgccctgctggttgggtagatcctctgcgcgtgagccatgtttatgattttattatttcagatcggaaaggaattcttgaaaaaaattgactattacatatcacaattgtttgcaaggggatgaccagaatatatgaaaatgccgtttggaactctggagcatctgcacccataatctgcaccgttggatgcgcttcaggatgtgtgctgcttaatgtgcctggctctcagcaaatgaaggttgctacagagaaaagaggtggggaaggtacaccttgcactgcagcattaacattggggcagctactttttgctgctcaattcccaaccggcccctcacccctgctggccgcacacacaccagagcccctcattttaaccctatttgaaatggttttgggagttgagggacacatagtatctgtatttcggttcagggatgaatttcagactcaatgacaaattgagggacctgagtgaacttattctggtggaaaataaggtgggctaggtccctggggaagagggcgtcaggtgggtttgagggatggatgggaacatccagattcagcctaaaagatcttatagactttcattcaaaatagtttttgtttctaaaaatccatacacattaaatgtctataagaaatacatcaaaataatttctaaatatctcagaaaatttcataatggtcctcctgttgcaacacacaggcataatgctagttattagaaaaacaatttttgtctacagaacatattcttcttggaaatgtaacatctaaaaatttacaggacatccagttccacaaggtcaagatttgcatatgacattttacaggactgttcagttccataaggccacgatttggatgggcaaaaaccctgcctatccacatgtatgggcatgattttagttcaatttcctgcctatacacatgaatgtgccaatgagatgtcttaatttctcctccagagtgaatccatgttaatatatgataatattaagattacatccaaaatatagcatcctctaaattctgtttattctggattccaatcatctctatcacgtgtcccatatgaacttccatttttctatttccccttacttgttatagctccactcttttactaggctgcaaataagtgcattgctttcagtcataatatttatgactgaatcacttttattttttgttattataccatgacaaacattttaaacgatgtccgacaaatatgaacaaggagaggataagaacatatacagttgcaatatcaatttgacaataaaggttacacagtgactgttgtaagggaacacttaccggccaagatttcaaattgcaaaaaattccataataattgaaaatatcatctctgtcttgttgacaatagtttggatattttatttgcttttgagtagcaccagcagcaagttcaaaactttgtattagaataaaagaaagcatatacaagattggataacaaatgcattatataatgagatattacctgacaattgagtttcttgtaacctaatgttcatatgtgaagctgaagaccgaaatatgccctactgtgtcaaagtctataagaattattgttccttgagggagctatatttctaaaacctacaaaagataacatgatcgtcaaaatatttaaataatataaaggtgtatggactaaaaaagcatggattaagatttaagagcataggatgattgacatgtctattgtacaacacaagtaatcacactcttaacactaaatttaacttttctttttgtgtacccagaacatctcattacatctccaaacttttcaagtgagattgtttgagccaattttttacaaattcaaaatgcatcttgcaactgaaacaaaaccgtgcgcacacaaaatatgtgtggtacttaatatttgtagtcctgtattcacatacaaactgcaccaaataactactatcaatgctagaaagattcacttagaactggccatattactacaatgtttgtacgattgaacatggatgtcattcatttaccttaaaaagtaaaagagtctaaacatgtaccgaagactgaatgctggcatcactgacctaggattattaattatcagacatgtcaattaagcacttataacactgaatatcgaagttcggagatgcaattatccaaatgacaacatggcaaaggccaaggggacctccataagtgatgctaatctacttttccagctaatcttcttggcagtctaacagccaatcaactttccaatatgaatagttgccatgtcatgttagagattctttagttcacatattgtttagtctaaaagagcaaaataatgattgtatgtgttggctaacagaacagatcaagcacgaaaataaactgcttgtcgcaattagttcaccgacataagagcagttttgcagttgtcaccaaaagagtgaaacctataattgtagaattccactgcttcctgtaagtctttccaaattctcattctggagttccttcctcaccactgacacattgctccaatgaccagcatcagcatagaggtttgacaaggctattttggatgctccatggcttgggtcaagctttgacaattcttctgcagccttttctcctaaggctacatttccttgagtccttgcagctgcaaggatacaaccccaggctaccacatcagctttcattggcatcgtcttaataagcagttctgcttcttccaaatacccagctcgacaaagaagatcgaccatgcaaccatagtgcttaatttctggttggattccatattgttgcctcatggactcaaattggcgcttcccctcagctaccatcccagcatgacaacatgcatttaacacaccaaggtatgtgattgagttgggtttaatatgggtggtgctttgcaactgtgaaaacaattccagcgacatgttcacatagccatggatagctaaattacagatgatagaattccaaggagacactgaaattgacttatccttaacatggttaaatagctgaactgcttcagcaatgctaccacactttgcatacacgttaatcagtccagcgctcagtttatcagtaagctggattgatctgctgattatgtagtcatggatccatcttgcttgccccaaggtgccagaattggctactgcagacagagcacttgctaaagtgatctcattaggttcaacaccagcatctagcatcgaacagaatatctgcaaagccatgtttgaattcccactctggacatacccagatatcaatgtactccaagaaatggtgtccctctcaggcatgtcatcgaacagctgccttgcttcatgcactagattccttcttagtaggctagccataagggcattccaggaagctacgtgtgacttgtctgacaatttgaattgcatctgggcatggtcaataaaatcacaagacccgtaataatggatcagggtagcctgtacaaatgcatgagcgtcaaaaccattctttagaatgactgtgtggagttgttgcccttctgagacagcggaatgtcgagaacatgccttgaccaaaccaacaagtatcacctcattggcccttatgcccaccgtacccaccatcgcaacatatgtcctgagagcctgcagtaggaaatccgcacacatatatccatctatcattgtcaaccaagagacctcatccctctctgggatcacaccgaacacctcagcagccatgttaatcattcctgccttgacatagcaattaagcattgtattccaagtgacagtgtttctatctggcattagctcgaatatggaacgggcagaaggaacctgtgacactgctccatatgcatggaccaggttggtggccacgatgacaaatccatcaagcccacgccgcacggcaacgccatgggcagcaccaactggtgctggtgccccgtggtcacaggccatcgccgtgagcacttccgcaagtgtaacctcgttgggctgcacggcctcggtgagcatatcgcggaagacggccagggcgcgctcaggatgaccggagcgcgagagggcggaaatgacagtggtgaacgagaccgcgtccctctgaggcatctccgcgagcaggcactgcgcgcgttcgaggcggcccgcgcgggcgagcgcggagaggagaatgttgtgggcggtggcgtcgcggaggagcgggggtatttcatcgaacaggtggtaggcgaggctgggggcgacgcgggagtagaaggcgaggagggagttgcggacgaaaagattggaggtgagcaggcccgacttggcagcgagcgcgtggagctgctcgccgtggctgaggcgtgcggcggccgacttgagggacgagacgaggaagacggcgagaggtgcgccggcgcgggtggtcatgcgcgactagagatggcaacgcaacggggtgccgttcatccccgggcgggagtgggacgaggccgccgtcaccgagaaccgcgagagcgagcgccgccgcgcttgcgcgtcggaccgtggcgagaaggtgtggggattccggtaagaagagactagttacatttggttgactactgagctgctgcgttgagatggcacagtatgggctgaccaacaaatcgattgaattgcgggcccgttaacggtgaacggtaatggggactgcagtgcagtccctcggttaacgaaaaccgtcagtcctaggcgcaacgtgaagttaaggaattcagggttgagtttgtcacgaaaataaaccaaaccaaaagttagtattcataaattttggcatattttagtattactaaattttggcaatgttagatatgtttagtttgtagcattatatgtttagtttgcagcattatcaaaaattacagtattcgtgccaaaaaaaattactagtatttatgtgagaagaaacttttgaaatgtcaaattttggtagagtgatgatacaatattatgtttagtttgttatcgataacaccaaaaattattagcattaaaacttaaaagtggaagcaaggtgaagagctcttaattcatacttacagaacaaaaattattagggttaaaacttaaaagtggtagcaatgtgaagaagcctttaattcgaacttttacattggttggttgaggagcttataatacaatgtctatcttgacgctcctaaatgtatcgttgagtggtacttcttaaaatatagcaacttctaatatttaaaatttgtcataaaacataataactccaccattattctcttctcggtcaatcacaaactttcaccattcaattttttccacctacatctacttttcaattaatcacaacatccgtttcctcaattagttttatctactttctttatatccggctgttagcattaaagatctgatgtattagattttagacctgcaacgatatatttagcaaattaatttggtcttaatatactatgtattttcaaagcttaataaccacaatgatattccacacagaattttaataactggtgtcttattttactcttaagaaacaatggctatataaaatttacacatgccccaacgacagaccacatttaatatatacataaaatttgcaaccatattattccaagcttgtgggtggttccaggatcacctagaaatacgtagccaaagatacatgtgttaaaaagaaagaaaaactattcttaggaagagaaaaaatacatttgtttgcaagggtaacaattagcaaatcatatccttatgtcatgatgaactaactgtatattatctcactttaacaaaaataaaaaattatgtaagttagaccatctaaatgctaaatgctagataggccactgcccaaggagaaaaaagaactatctagagagagagagaggcaccagtaggttcttgataattttagctattccatcggaacagaggagccaactcatccactactgtgtatggggcaaatggaaaaaattaactatttgacactcttcaattaatttaccactcggatctatatgtcattaacacatagatgacaaatagttaaatgtccctggcgcttcacccatagctttttttttatactttctcatcgtaaaatccttttggattattgaagcaatttctacaaacgaacgaccttcaatttagatatatgatgatcacgaatgatgtatcatcatgcatgtagtaggccaagacgatcaattctaacttcagctgatgcataaacactactgtcattttcattcacccactaaagaatatacaagatggttaatttgttataggccgtcctcttaacatgcaatgtaatttggctttgcaaacgccacagatactggaagggtaaatgatgcacaaagcatccattttccaggagcaacgagccgcactctatgcatttcaacatcggacacgnnnnnnnnnnnnnnnnnnnnnatcctctgcaattcaaggggtgtgtgtcaatcgataaacagaactatgtatacaacagttctaacttaaagaaaaaaaattttggtaatactcgctgcttacctcatggaagtcatattcaggatcttctgctttggagaatccatacacgtgtatatttggcattacacaagaaggcacagccaaatggtggttccatgagattcctctgaacacatctggggaaacagtgaaatcataaaataattaattggtcctgtgattagcctaactgtcaaaattcccatccaaaaaacatcggctgcatattggccattagaatggacaggtaaggttagaactaaatttcaatgttcaccctttttttgcataaatatactattttttttaaaaataatagaatatacctgatttgccaggtggcatgacgacactgctgttgccgctcggcagcagacggtgtcaccatatggccaggtaagaccgaccgcctgatgtccctaaccgagcagcagccaatgcttggttgcatgcatagcagcagctagctagtcaattagctagatttgatttagttagctagctcgttagtcatcattgcgaatcgattaactagttcgtggatgttgtcgccaagccgggaggcaagaccggccaagtataacacgtgctgccttgccgcggggcgacagcacatggtgtaagagaagaagaaaataataagactggtaaatgtcccaaacgcccgtctcatttagttcccaccctctcctccactctcatcaatatactccctagtccctagtccctaccactcatagactttcttcccctatttagtttctatattggtaatgccattttgtagaagaaagattttctcccaaacaatttttctcccaaacattcgatgcgtattcacatttgatgtgtattctgtaaatctgcaatgtgtaatgccatataatcaatgttataagatgcaggttacaaattactacatttcagctgatcacaatccaaaaggcattgtgtgttcttactcttctatagtaaaaaagtgagaggagagaacccgacatgaaaccgtgcatatcctttgtaatatacatccccaaaattcaacagaattttagtggatgtttcacaacgggcgaatgagtgaattaagccaataccatactagaatgaaatttgttctctaatataatcataagaactcaagataacagttcaattaagtaacacaaataatgaaaacccacctaaaaattctgcagcatcattgggcaaattcattactacttgtgtgactggatgcacatgttggcttgagtatattgaactgataaaccttctagcgtccatgttaaaaacctggttcgacaaaacaatgaacaaatatcaacaagagccataaagacggagaaaaaaatccacactaaaccattagatacacttgaaacaagtcattaacaaacgaacataagcactaaaatggtgtattttctaatttctagtggtgcaaaaaggatttccaaccaaatgcttttctgagacagcggtaagctttgatgctaggttgctaacaatgaactttatgtaagctacaataaaatctgaaagccatcacaggaaatttattaataaatagaaagacatgagtgctatctcgcttatctcatagttggaactacctcgatttttctctcgagcttgttaagaacaatgtttctctcaaggtactccactgcagtggggtttaggtcattcgcatagacatatttgacctttcttgcagctgatattgctattggaccaacaccagagaacacatcacctgcataaaggatgtggtagcaattgatctttcactcactacggaaaaggttataatcaagtaaatattgtgaagcttaagagaagatgaaattaaaaatgtaatagttactgtgaactactccagaaccaggggtgcatacatcataaaacatactcgacccagatgctcgaccatattacattacaggagttgtaaaatacgattattcagtacatatacacaaatactgatttatgtgatcatcagaacacaccccgtaaatgatgattacattattttcttctacatggaccatttggttgtccacaaaagctgagcatgatgaagaacatgcatggacactgattatcatatttaatatatgttcataatgaagacagcaaatgcttttcatgtgaataggaagagaactgcaggaataaaatggcagtcaatcttttgctgtcatgtttatacaagctaccagaacaatacaataccaatgcagaaacactgcaagacacaatatttcaacactaaacagcgaacaaatacttgcccaacctatggtgcattgctatgtatactttctaaaaattgccgctgcccctgaggaggtatcagggtcaataccaaaagtaaatagtacacatgtttgcacaagtagtggcacatgactatgtgtttatcttttctgcaaacacagtgtaaattgctctaaatagaaaagatcgatatcttgaaagggaacaaagttacaaaacaatgtagactgtcatcctgattccacaggccacaaaaacctctgttataataaaaagcagggctagaacttacaaacaacatcagaatttttgaaaacatggtcaacaagcctctgtctttctgttgataatctagaattccaataactgcataagaaagttgttagccattcattattgagaatcggaaacaaaatcataaattgtgtaaaaaaacacgccaaacagttacatttggtggtctcaagaaaatgttaagatatctaaatatattcttgaaatcagacagaactagctaacaaaaggaatgtaactagagtatcatgtattcagatttagtgatcaagttcaatactccctccgtcccaaaaaattgaggcgtataatttttttgcagtgtcttcaatgtaaaactttgaccattaatttcatacatatatcatcaaaaactacacaaattaacatcatatgaaaaatatttttatgaatctaatgatgtcacatgcatgacactaaacattatattattagtacactttaactgttagtcaaagtttgcaaatgttgattttcctaaaattgtgggtgcattatatgttgggatggagggagcagcatagagcattgcattttcagagtctcggtttcactgctaaaacaacatggaacaaaatgctttgcaaggaatagtggtggccaaaaatactttctgaaacatcagccacgagtccctgacatccctgagaaccactcaatgtaaattagaatggggaaattgtgttcttcccctattttcaaacacaattgtgattttacccctctttttttactttatgattttgccatcacttttgtaaccgaagctcccgtttgcccctggtttggatgtttgttaggtgtgccaagaattagggagttaaagaaaagaaaaagggaatgaaaaatgatttacagaataaaaggattgttatacccccaaatacaacatcaattagccacacagcccttacatgtgtgttaccccattctccataccaaaccctggctctctcgtcatggcaacagcagcagcggcgggctaatttcatcggtgagcgggcacggagcagcaagcaggcatgagagcgccgtgcggcagcgcgagggggcaactaaacgcgcaggaggaggggcggctcagcgtgcaggtagagacctcttctccctgcctcatctgctggagcccctcgctgtttaggccataaggcggtgaccctctgcagatatcgccgccaggatgcgaccaccatgtggtctcctaaactgaagctgcatgtttctggaaatactacctaaaattatgggtattcattgtttctaaaatttatgagctgtctagaaaatttccaattgaaataatgtattgaattttttaattctatggctaattagtcgccctgtgggatacatgtttcagaaaacaatagagcagagattgtagcaacagaaatttgcacagaaaactagatgaatgagcttgtttggcagttggcagatctggttgtcgaaatagcagcttaaaaaacagtaaggttcatggccgttgtttcagaggaagaagagaaacagagtttttggttgaacatgtcccagttggctaatcacttgtcatctgatatgaagaatgatgttgctactcatgtgatttggagtctatacatgcaagagaaaatagaactgatgaatttgttgttgcaagtggaacaattgaagtcatgttgctcaatgacttttgcttgaatatttatgaagttgtcaaatgatggctgaaattatattgaaattctgttatgtttgtcaaataaaactcgatcagatttgaaatatgtgaaattcaagtcagcactggggcaaagttcttgtcaaaatgcttggtatcaaaataagggcaaaaacagaactagtgtacaaaagaagggaaaatatgcaagggcatacttgtctttttaccatatacttaacaccattaggatgacttaacagacctggggtagaccgaagcttcagttcaaaaagtgagggaaaaatcacgatgtctgaaaacaaagggtaaaaagacaattgcacttgaaaatagggacaagaatacaattgccccaaatggaatacatacaccagggaagcaaatttgacctccaggacgtctaacaacaccaagtagtgtttggtttggggactacgtgggatgggatgataccatccctgattttagagatggagcgatcccatttacttgtttggtttattggatggaatgatcccagttttttgtttggtagaagggatgggtagggatgggatgaatgacatttggagtgacgttagcaccatgttactcccagcgagaaaaggagcgaagctgcagaaggatgagcggcgaccggcggtgtgagcggaaggaggagcggcgaccagtggcgcaggcggaagaaggagcggcgctgacatcagagacaacgacgatatggacgtggtggccgcagaactcaccctcgcccgccatcgccgtcgccgccgccttccccgccatccccgccttcggattcgccgccgccaccgctggattcgccgccgttgcccgaggccgcctccggattcgccgccgccgccctccccatcactggatctgtcgccgtcgcccgagcccgcctccggattcgccgccgccaccgccagattcaccgctgtcgcccgagcccgcctccggattcactgccgccgccctccccaccactggatctgtcgccgtcacccgagcccgcctccggattcaccgctgccaccgagccatccccgccctccccgccttcaccaccgccaccgccggattcgccgccgtcgcctgagcccacctccggatacgccgccgccgccgccctccccaccaccggatccgccgtggccatcgcttgagcgcgccgttgttcgtcgagcgagcgagcacgatgggcagaggagcagagcacgacgtgagcgagcgagcggggcgaagcggcacctcacgccgtgcgctcatcccaggtgggatgagttcgtccgccagatttttccggatggcttggtcccggatctgagaggaatattcctctctaggaaccaacccattccactcacccctaaaccaaacacctctaaaagtgggttcgtcccgtcccatcccatcccatcaaccaaacactacccaagagaacaagcaaacttaagcatgcacttatcatgcagaattgataaatgagaccatttactattcctgctacacatagtttccaagtaaaatttagaataaattgacaaaactcaaacactaacaagctatggttccatctccaagtaattgagttttcgcttgaaccgaggttttaaaacccaatacaaaaatgcaggtctcctttgcaacgctggtagttggttggttattgctggttaccagaacttactggaaatatttgaatccaaataatgtttaccggccagtgaccggtagccggacctattactagtcagtaaccaggcagaataaatacatctataagaaatcaataacattctaattcaaaattaaactattcaggctcattcggtccaatatcgaatgccaccagtttccatacccttactttgacactatcatattgttggctaagacatgatattatttctaaattctattcagtattctagaaaatgctaagcaagtaagcagtagccactatgtagaggccaagtaatcggactaggctgccacctagatagaaatatggctgaaaggaggtgacatctattcctaggtaaacaacctagttgtggagattatggataccccatacctacacggcatgtatagtccgactgggtatggggtgccatgtgtagatagaatatctttagaaggactcaggttaaaatctaaacttgtatgtcaagaaaatatccgagatcctagtcggttacgattgtattttatctgtaactacatattccgttagggatatggactgtattttgtaatacggaccccttcccctatataaggaggggtccgggtgcctctaggggcacgaatttcacccagatcatacgatcaataatatactcggcggatcaatccccggacaggagtagggtattacttcttgaataagaaggcctgaacctgtataaaattccttgtctctaaacccaccacttttccagcttgatagccacccccttttagtattgccgaaatcatgtttcaacactagtggtggccgccatttagaacagtaaagctggtcatgcacttcaggtccagtttgtgctcacctccattctcatcgatcttgcaatgacaattcatttgccggcttgggccattaaggccattgataaaattagacgtggatttctttggagaggaagaaaggaagcaagtggtggtcaccgtttaattgcttggcccatagtttgtcagcctcaagagtttgggtgttttggaatcttcgatcttaagcttctcagttatgctctaaagggtgagatggctttggatgcaaaaaaggaaccattgaagccatggtcgacgtttcctatccgagtgagcggattacatccttgttctacatggcagtgagccagtgatctctggggttgggaatggtgctaatacgctgttttagagagatcgttggctgtttgggcagcacattgaggaagtggcgccgcgccattttgctttggtgccaaagcggaaggttaacaagcgtactgttcttcaggccttaaccaatcgttcgtggatctccgatattcagggagctttttccattgtggttagaggattttcttggcttatggaatgccctttgctcggtgatattacaaccagggtcaccgggcatacattcttggaggttctcaacttcaggtgtttacttggccaaatctacttatgatgctctctttgaaggggccatttattttggtcctttggagtgcatttggaagtcatgggccctggaaaatgccgtttcttcatgtggttagtggctcataatcgttgttgtacagctgatttgttaggtgggggatttcgtatgagcgatggcagaacaagttcgaagctacatccagttcggcagattgatggtggcttgtagggcaaaagctagtttgagtgtgttacgagtttgtgcgtgtctattgagttacttatctgttaggatcagtcttgttagattagagatatgattaggagagtatcgccatcgtacctcgacatccgcggcgccagaggctttggcctccattgtttcatccgtacaatctacggcaattgccggtgccaggaccgagcctctctctctttcaccgaaatgaagaatagaaccccgaatcgggaaatttctcaagtggtcgctgcaagactaatttaaggttctatgctatgctactcctaaaacaagataaatatgaggtttctcttataatttccaggctaactagctcgattaagaagcgattacaattgaaacaaaagtgagacaggaccacatcataggatgcactactgccagctcaaaagcagagtaaaatgacaactagaattcaacagtggtcccccgacaagaacggactctcagatcttcattccgattcgcgattaatcctgaccgttcttttctcataatcatccttccaatgcattttcttcagaatcttcagacttcagatattcagttaactcagagaccattcatccatttcaattcccagctcctgacagcccgggccgtgacaacttggtatcagagcatcttcctgccgcctgtgaacatgtcgggaacacaaggaacaatgggcagagcaacgctgcgctggcagccatcctcgaccagctgaaaaagatggagatcaccctgggagagcatacggccaccatcacccgccttgagagcaacaaggcaaccacagatcgcaaggcaaaaggcatctactcccatccaggtgggggacacaacgacggatcatcagatggcaagggtctgaacagctagatcatctttgaagcttggtctatttttggtaacatcggaatgattgtgttttcaacggaatagctccaagattatcaatcacctttatattagcaagtgaggaagcccgcctatggaatttggcagggactaagaggctctccttattaatggatcccggctaggcatggttctggttccacccttgcggtgggttgttgtgtggtggcgcgagttcgtctactacttgctgttctttggcgtgttcgacgccttttttcttctattaatgcaatgatagcttcttgcgtattcgagaaaaaaaattatttgctacacaaggttggcctatatgggcaatgcccaagtgtatcttttgggcttcaagttcattgtttggccccagttttgctctttgaagaattgaacaggactagacactactagctgtagtagtggatatatttgtttgcaatatttttttcctacaagattggagagcaatatattgccatccaaggtaacgagaatttgaactcaatcaagatcatagacacgattcatataagattgattatcctaaaggatgggaggatcattagtctcatgattaagttaagaaacatagaagattattataatcaaacaatacacatcattcagaaacaatgaaaaatcaaacagtaacaaaattcttagcttccaaatcattgcaccaattaataagcaaccatagatttttttttcgtcaaaaaaaagcaaccctagattgagaaaaagagatcatatagcacagtagctaatcttatggattacacgagggaccatttattcccatacacctattcataaaaagcaatagtcctattatgaacttttcaaaacattcaactaaaaattttcaaaattttctattacaaagccatcttaagaatgtgaatgttgaattgagatttgactatatctttattacatgtatagaataagaaacactagggaaatcttttggtgaagatttgttactggaaaagaggttaatgatagcaattaaactatggttcaagtgcaaacaatagaattctttatagacatagcacaaccacaaactacaaatatgtaggtaaggattttatcctgcaaataatgaaatcattttgttttgttattttgcaatcacaataaatcagaaatgttgtgtgacaaatatgagccaagagaggatagaacatacactgttgaaagatcaacttggaaccgaagaccactttcaataaccgtagttacaagggaatcaataccagctaagacttcaagctgcattgttctgtagtcattttgaatagcatcaatcttattgacaacagtttggatctttggcttgtttttgtccagtaccacctgcatgtcaaatgttagagcacaagaaaacatactcaagaatggaagctatcatgcaattagatattacctgagcaataagcttcttgtaaggtaaatggtcatccctcaagttcaagtgtgcaatatgccctactgtctcaaaccctgtaggaacgattattccttctgggagtatttcctctaaaatctacaaaaagtaagattcaatcaaaacagttaagcagcagaaagtgaacagacaacgagcatggtgcataagaatatttatttttttccatgtgaagcaatgttgatcaacatatctaatagaccccacaagtaacaatgtgatgacatgctaatacagtcctcatgctcctggaacatacagtttaatatctaaacatttcggtagatcaaaccattatacagcatttggattgaaaacaaaatctgtggagttgaaatttgtgctgcctaaaagttaattagtaatcccacaattcatatttgtgcctcgataatgcatttgtacgactgagttttcaattgcatttctatgttgtcacatctttgaagcaagaacagagtagaccaatcatctatgagaaaactgggaccagactctgatcttgagacaattcaatctaacctgtacagactgaacttttggtctgtatccggtatttgcaaaggcagtgttacctggacagtacagaagcatcagatactgacacaaatgagaagcttgaaaagaaagaattctacagactttgaagaacttgaaaacaatacagtaaattaaacaagcattattttaaatctacagaaattggataattttattctagaacaaaaggtaagccacaagggtaaataccattagaactaaaaaaaggtgtctcaaaggaactgagcatagcccagttggtaaggaggtaaaatggttcatcttacccaccttggtcagattgacctaggcacctaagtatcagccacttgtgacacatgtcaaacaagacaagtagtctggccaagtctaagtaacactgcctgtaagaaccaactcatattttgttttctcctggataaagtctttcacctctatttttttttacatgtgacatgcaacacttgcactaagatggtttacatttatcagctgtaacaatgtttcttactttggccggtttcagcaaattgaacagcagcaagatgttgttcttagcatatatataatttatggcttccagatcaacagacagaagcccagaaggttgaaaacacaaaatgaatggctatttactgcacatagtcaaaccaactttgatgattgatcctttcaatcaatcgccaactcatgatagtagttggctcacacttctgctaactgattctttgtgtttaaatccatgtgtatcctataatattagggattagggatacaactggagactagaacatctcaaggacaacactggcattagataacaaaggaagccgttggtataatgacctaatcaaaaaaatgcactggcacaaaaaacagcaaatacttggacaaaaataataacaagagatgaagagaactgaaagaaaatgatgcttagaccatcaactgtaaacaggtggcaaaatacctcattcattggccagtaattgtagaacaaggtcaattggcattgcacaagctcgtaggatgaagatccatccttgttagtttcatggtccaacacaacctgaaaagttggcttaactaaaactagtaaacagattccactgaaagagaaaatctacaaaagtaagatatacatcatttcttcatgtatcctcttggtatctattttgtaataacttcataaaccttgaagataattttgcaaaaaagaataaaaaataagctaccatttctgggtccaaataaggtaatattgtgtcaaaaccagtgaaatacgtaaattaaaattttaaacaggctgaaagtgtgattttcctcatctggtctcgaaaagaatagttagaaagaaaatactgtctagtctggtgagttcttgtgagtatcatcaaggtagaatgctgaaccaatttggccagcgcacacccaaacctcatttgatcacagttgaatccacagaatcattcaaatagaaacttttcctaacctatgtgatttttatttctacaactgcaactatgaaaggctatttggtgacaagaattcatcaccttgacagcctccgggaggtcatcaaccctcttgttggcatagttctcgtccaggagcagcaaccgggtgggacctcctctccacgtgatcctcccgaacccctcctccccgaccaaccccatccactcgtcgccgtgctcctcttttctctctccgatcacctccaccacatatactttgtctttagtatcccttgccgtagccgcagcctcgccgcctccttcatccttcttccccttccgtttcctcgcggggggccgcgacatcttggcaaggttggggaattgcacgaagcctcgggcgttgaactcgcgggccagcttctctcggcgagccaccgcagttggcagggaggagggagtggcgaggcttggatggggaacggggaagaggaggccgccgtcgtcgccgggttggcggacgacgttgcgcacgcgaggccagttgaggaggtggccacggaggcgacgctcgaggggcgcacaggcggcggccgggacgcggagggcggcgagatcgaagatgcgggcgaaggagagcaggccgtcagtttcgccgggcaggcggcggccgcggcggagcgaggggccatggagactaggtggaacttgaggcgctcgcgaggaggaggtggagctactggtggtggtggtggtggtggtggtgtaggaggaggaggagagaggtttgaggcggaggtgaaggaggagacggccggaggtggggcggcgaaggcgagggaggaggcagtgcgaggggagatcgaggagcggcggcgccatggaatggaatggtgaagtgtgcagtggacaaaacaggcctccgtctacagtgtaggaataagagggggcattatgcctataaatctaaagtcttcaaaccggccttgatctgctcttccgtggcgtggatgctgtagattttgcaaaaaagccctctcttttatacctattctgttatacgttcttgctgtacatttttcggctttaaaatatttcgtttaggcccttcgaatcctacgaaatccgatacgaaggagacaaaaatctaaagtcttcaaaccggccttgatctgctcttccctcagcgttttgcgctggcgtggatgctgccgcgtcgcgacacgtcagcgcgcgctggtgggctgctggattttgcgtcctctcgtgcggccgcgtcgtctctgtagattttgcaaaaaggccctctcttttatagttattatgttatacgttcttgctgtacattttttggctttaaaatatttcgtttaggcccttcgaatcctacgaaatccgatacgaaggagaaaaaaatgagaaaaaggaccgcccctgaatcgtggaatctcaggggcctttgtgaaaaatttccttctttcttgcgttctgcctccccttcccgaaacccccagtctccagccgcgtgaaagaaaaaaaaagaaaaaaccaccgccgccacgccgctctcatctctctcgctctctcctgcccgccgcctggatctgccagcgcggtggccgccgcccgctgtcctcggagcgccgtggccgccgctcgcactcctccctacgcgccctgccattcgctgctccaaggggatgttgtggatgcacggtgtcatcgctgcgccctcgctgctggcggtctcgttgctacgccgccgccgacgcccactcgaaagggaggccgtgggtgctggatgcggcagccacgatttcctttccggcggatccggtcactcagagtggagggcgagcgctagcgcagaggctcatcaatggtgtcgacgccggccgttcttccgcagtggtgagttccacagggaaagggccagctcacccaccctttctttcttcacactttccctctctctgtttaatccagatccaaactgatggggaagttcgatgtggcacatccagggctatcgggtatgctgagctcggtggtggcggcagtagcagctcggcggcgatggaggaggtcaaagcgttgatgtttgccgccggcgtggatgctgctgagtcctcgcacattggccacgacccacggctgcaatcctggtcagtttggggctttgtggttgcttgccaccctatccgtttgatctagatcgtgtggcctttgttcgtcatagtttgtgcggtgtcgtccagttgcgtttgtgaattttcgttgtgtttgacggtgggcaatgcattatcgatgcaattggtctatggctttggtgccgctggcgtgtaggccatatggttagggttggtttcatacctaccatggaatatgcctatgtaatgaggcacaactgtgcatgcttgctcagggttgtcagcttggggagtgcggttgtcagcttgggatggggcaagctgcttgctgtgattggctcaatttttctcggttgcatcggtgcctattggtgaacctggtctatatactcctcctggctgtattgtggggccttatccgatgtagtattagcgaggcctctcatggtgtatagtccagggtgtttccttcgttacgcgagatgtattaggctattccactttcaggtggggttgaatgccatggggtccatgtatgctgcttccctattggtgggtatggttggtcctattagatgtgatgcacaagtctatgccttcttctctattatatattcctttgcagatgccgggagccatcttcttttctccgcttccctttcaaagttgcaccatcgttttcatcgctctatcgttttcatcgctcttttgctgcttgcgtcctcacgtgtactacttgatacatctatttgttgttgcttttgatcattgaatatggcacggtaagatgtaggcgacattgtagtttggttgtcagcgctattcgatgtcgcttttcctgtttttaggccttctaatcattctttgatttctggcttgatttgtagagggccggatttgcacgggctgaagcggtgcttcaagggttcttgattgattttgccaaggaatgttcgggctgctggttcaatcaagcaggttaggttctttctactgtatatatatgctttaaacgatatggaaatatcccctgtatttgtggtgccttctgtttcaggtttatgtttgctaacaatctttttctgttgcgcagctctggtcacctttattggtgaccgtccctttctaccctttcttctatttctcggtcaaggcctttgtcttctgtgggtatctttcttgcgtggcatcttcttggttacattgcttctgctgcgttgtcaacacattgggtgctgtttcgtataaggtatttccatctctctcataccctatttcagtatttccttttctgtttattgattactattttgcactattttctgcttcttttcaatattgtgcatttatggtgctttgtttgtcgctatattaatagcttatttctgacacttatcacttggtacatgcgtgttgtcggtttcctatgttattgcagccatataacggtcactgcagtgccttttgtagccgttgcataggttcttgtgcacacacttctcgcatagtactctctttctctttcctgatattttgtcccttgctgcccataacgatgttgcttccctccacctcatctttagttcttatcaaagtcggctaggtttttgctttgttgtccctgaactcatcttttcttgctttagagctattattgtgaaacttcctctttccatctaatatatttgctattcacatctcgcttgtcctgctttctaaatgttgttcacaacgtttcatgcttctagctctacctccctttatccaaagtaagattaaaactgtcattcgatagtttgtaaaatgtgcatttgacgttttaatcctacatggctgcacaacttctgcacattatctctgattttttttcggagaagttagtaattatttttaaggtaagctagccatatgaagttttaaaggtataacctctattattaagcattggttctctctggtaaaaaaaaatacaactaatcaatctgcgcactgcgacctcaaaggaaaagttttgcttctcacctgtcctcgcttttatacagattaaattgaaatctaaataaacacccagtgatttgcaggatggaaaacatacacatgtatggagtttatgtgacggctaggagagtgggagagtggcacagttgcttgcaagacatcttttcccttttgaaacaaaaaaaaaaatattttatatagtgcaagatatttggtcagcgagcaaataaaaatggactagctctgcactttgattaggcctttgcttttatatataaactctttttagcattctttttgtactgctgcttcggagtgacatttctcattcagctctgcacattatctctgattttttttttcagaaaagttagtaattatttttaaggtaagctagccatatgaagttttaaaggtataacctctattattaagtattggttctctctggtaaaaaaaatacaactaatcaatctgtgcacagcgacctcaaagcaaaagttttgcttctcacctgtcctcgcttttatacagattaaactgaaatctaaataaacacccagtgatttgcaggatggaaaacatacacatgtatggagttcatatgatggctaggagagtaggagagtggcacagttgcttgcaagacatcttttcccttttgaaacaaaaaaatatatatattatatagtgcaggatatttggtcagcgagcagataaaaatggactagctttgcactttgattaggcctttgcttttatatataaactctttagcattctttttctgctgctgcttcggagtgacatttctcattgagctttcagcgctgcagttgtcaaactattaaagcgacttgatagttctgcatcatgggtagtgtgcctttagactattatgtttttttttttgccttttctgcaagcttagttcaatttttttatgaaattgtgcaagatgttaggtcagatccatgcttactattgcacaaaataattttaaggcacctcttatatctatatttaggagtatccgtcactgcagttttttgctttagtgccatactgattacttcacattaaacatgcctcgtgcatgattaatttttgtattgtgcaattagtattcagtgcttctaaaacattgcgtattgatattggagtttggcttttgatattttatttatggttgctgtataatgtgaggctattactacaacatgctcccacaatttcatcatatatggctattcattcatgatactactgcttgtctgtatatacatacgattatcttttgaatccattatgaattctggagacattcatttgctgtatatacatagggttttgtttagtttcatcttatagtgtataaagagtagaatcagctgtatagcaatttaatcatcagaccagagggaggttcaatgccctgtaaagaaacattttctcatgcatcaggcttaatgtatgtccccgcttagagtgttttctctgtttcagttttgcctcaaaagtaaaggcctagcaaattgttggaaccttagttttcaaagactttgctttccattgtgtaaagtagattttttttttacaaatttatttgagccaaactactaatatattacagttgttctctgttcaatgacagcagtagtattttaacatgagacaatgtgattaaaagaggttttgtctgtcccaaaattttggttttttgtgtttctcaaacgtctcatagcaaaagtagccaagcatgcatgcatattgtggcttgtgc

SEQ ID NO: 71869 - DNA, 31578 bp, Oryza sativa
tggtgacctttgatcactgacgatcgtccccaccctaatcgtcgtctctttgcctcttctcccacggctgcagtgggagtctatttgggggcatactattgcagagggacataaatacataactcttgactccgtggatgactacattagtgcccgagctgtgtcatttgcactctagacctttagttatacattaaaccaagattagggatctagatttgcatttttgaggttcatggaactacatgacacctcactccatgtttaaggaccaatagtgtattttatactttgagcaatgaagttttatgcaaaatcctttacaattagtatattgcatgaaattaactgccattggctgctcattaattgtcaagccacagccagaatttgaattttagaacttaattgtagattgattttcaatttttttttattttcaaccttggcttctgaacagctagattgaagtataaaagtctagccctaaaataacttttacttggttcatttgtcttggatgcatcttaacctttaccgtgaaaatctaatgtactaatttatttataattaaccagcaagatttttttttaccaaaatcaacaagcttttttggtacatagaaaatgatacacaaggtcaaaatcatgtttttcactcatctactaatggtatgttgacggaggaagggaaaataaaagataaaatttgagaatgaaggagagggagcagatttcatgagggcaaatgagagaactgatcaactttgaagggaaaataaaacgagtagacacaagcagttcataaaatccagaaaggacaataaaatggatcatagctcttgtatgcatgtatgtcatattgtccttggtagtgcataaaggtcttcagatataatttgtactatagtccacatcacaaagtacttaggttgattggtactgatttgccataaaacattacaagttgcactttctgttgaatggcatactattattggacggcatccatcacttgtacactgctaaacccttagtcatgttagataaacagtgcatgcttattattactgcaatgctgcgggtgacattgttgcatccaagatactaaatatcatcttctgaaccaacccatgatgaagaagataaagtttcttagcactgtatggaataccacactatctagctctatcttatttaacttgttttagaatttgggaaactaaggttccacttgatcaaacaaaccaactaggtattgccttgccacttaactgaatgagtacacacaaaaaaatataagtgattaaggctgttatttcgctattccttgttcccaaccggaatagtacgcacggaaaacggagcagtccattagcgcgtgattaattaagtattagctagttttttaacaaaatggattaatttgatttttttaagcaacttttgtgcaactccacttgataaaaaaaacgagaagatatttcgctgccaccaacttcaatgtgttcatacaaaaaatatataattacttatacaaataattgggtaaatagcattaaattgcaattattttgtcaatcatcacagtttgcaatgatatatgtcgttatatcagaaacttttgcagggcattaaaaaactgcaatactagtgcagaatttaataaataacttgcaactccatgaatagaagggttgccggacatatcaagcccatccatcataaccacatgctataccacattaaagtccaacctgagttggccctgtttgagaccaacttgctaaacgatctcatttccagttgagttgcagttttctaatagaactagctagatacccatcaattataatttatttcaaataaaaatgttataaattttaaacttcgaatttgttatataataccaagaagaaaatcatctgtaatttgaaacaaacatcaatgtgcaaataacattattaaaagctacatgcacaagcatccacttgtctgcagaagatccacaaactcaacaggtgtaagggtggcagagtcaccaccaccattagctccttttatgtagagaccatgtgctatccttgcggttttcagaaaaggaggtataccatcgcaatcttgggcaagtgaaccatcacaaactatagggtttggaaaataccaccaacaatcaaagaaatttggggaatatatctcttgactgttaaagggtgtgaaatgaccaattcaccctcacttttcatttagaagggagcaaactatggatcaattatatatccacactaaagcattgaggtggagcatggctgcatccacaattcattgttgatctcatctgcgacaagatagaaaattgcaagaacaggagaaggttgaactggatgttaacagtggtcatccatggaaaagctaagccatagtccaattttttttttggacttcatgatggtattgtgcaaatcttcacatttgtgatgataacttgcaacctgctactattattatgataccaaccaaatttactctttctgaaatgtcttgcggaagaagtaatgaattattgtcgtgatgccattaatttttgaaaaatagttgcagttctatgaaatttaatcaatataatattgttattaaatagaagcaaacactttaaatggttgaaaccaaacgactgttgggaaaaagaatgattaccttcttgaccgtccagcaaagcaatgaaccagaacattgccaccagagctgatagattcatcaatgaaactaaagcattcatcaaaatgctttgccaaatcaatgtctgggctgtcaagtactgtatattggtaaacaaataatgatttaggagtgcttgggaatttggacaagggcaacagaaaaaagagggtataatcacatcaataggtatttgaaacaccatgacacagtcaagaagtttaagtgctccatgcttatttcatttctcttgacattacagttttccagattgagtgataatctaacatgtctggtaaacttacaacacaacagatgaaaagtacataatttagaagtaaatgcagcacatttcttaaacttgcacacagagttcaaataggtatgtgaacttaagcgatgcgcattattactcctaaatatgcatacttcggttctaacttagttcttactggcaatagatgattgaatggctcattgcttcacttacatgacttcctccctccatccctcctcaccctctctactctctctgcatcctgccacaaccctaatttagttgttgcatccccaaacaacttcctcaaaacatagctggctagctggtaagattgaaccaccatgacaaagtgacctcaggcactgggatacgttagaattggggccctcaacactcaacaggcaaagtagaggatacgtgtgaagaagaaaaattaatccagaaacacacttatcagtcactgtggttcgccagagagaaaacaatcatggctttatattgtaggagaaaaaggaagtaaaatgagtgtggcagaagagatggaaaacaaggagtaaatagtgcttcaaaagtgtggggacagaaaaaagcatatgggagggctttctcacaggtgagctttgctgctggtgtagctggaggaggagaaaagggaagtgtggggatagaaactagcatgggagggctttctcacagatgagctttgctgcgggtgagactggagaaaaatggcacatcaaagccacatgagcgcctgctaggctgccattccatgatcaattgaatttaagctgacccacatatgcagctgtaggaatataaatatgcatctctcaagtacatagacctgtttgaaccaaacatacttttttttttcttgaaaacgcaggactgcacttcatttcattatgaagagaaactgtaatgtggttatggtgcaagcaacacattctaaatttatatggtgcaagcaacttaatctgataaaccaagctggcatgtggttaccttcaatcttcttgtagttaaattcagctgcaaaggctggatttaatgatctggcaacaatcaagatatgggttatgttcaagctctttaaagcatccttgttcattgctgccccaacagatcccaagtatagcccctacgaatatgtcaaagatattctatcaaatagatggaaaaagctttaccatagtaatgcattcttcaagcaaaaatacggtaaaagaagcaatatgttgctacttgattggcttttccttgcattcaattgaattggagagctcgtattagcacaatcgagtttcccaatttccaattaatcagtgtagtttctccattcgcgacacggacaatcaacggtgctaaagttaggataaacggtgaatcaatcatcctgtccttcatcgcgagaataaaaaaaaagaaaggcagtctgttttttttctttccatccagttccccagatttgcaccagttaacaagaaatccactcaaatagcgcccgaaagaactcaacctccttggattatccggtgtcagatcgatcagccgaaacctgacctccgacatcccgcggacgcatccatcaccgaatcggcagcacgagaacaaacggattgatcacatcaaggaggaagaagaacatgggcggggaaagaggaaggaacctggacgatggggcacgggatgttgtcggccttccggtagcgtgcggcgcagaagccctgcatcagtgccatgagcaccctggcctgctgctgctcgtagtcgtcgtcctgctcccgcccgtccctctccgagcgccccgcctccggcatcgacatcgtcgtccctccctcttcttcctcgatgattgttggggggtggggagatgtgcctgaccgaataggggaagtggcgaggagagaagcgaggacaccggctgatcactcgcggagcactgccaaggaatacatggtgggcagtggcccccgaaatattcaactatttgccactcacacgaaaagaatttttttcccaaaatccactctactttatttttatttctatttgtcatccggtctcactacaactcgcgcgtgtcattatttttccttttctcactggcgtagattttcaatttcatccagtccaatgtgaaggataagatgaaaagaccaaaatgcctttcggctcacttataagtctcttccctcctcattcgatccgatcgagttgagaagagcaaagcacatgcaaaaaagggagaaaaggccaccaagataaagcaagataaaggaagggagggagaaaagtagagagctattagggttggcattgtctaaagcttgtcgcctcaccctcgatacttgagcctgccgctgccctgctttttgctgccaccacaaccaaggcatattgttgttgttgttgttgatcttcggctttgtcacttgactgtggagtcgtgttccatgacgatgatgtagacaaaactagcggcatgcatatattgcctctgtctcgaaaaactcaacttaggtggagatttgacccatcctagtacacatgtccagatttattgtattagaatgggtcacatttccatctaggttgagtttttgggatggagggactatatgtttgtatgatgtaggggaggcggcgtcacgcccagaaatttagcctaaatttccggactattttgtgtattaaatccctatccaggacaagctagggtacacaaaatgacaaattaatacacatatccaaatgtaaataaagcgtaaatacttacagaagaggcacttattcctcacaccgaaaaaaagccgcagcggcggaaaaaaggcgatcctagcggggcttcagctccactccacaggcaaaactcaactggggtcaaagccttggtcctctaatttcatcttcagctcagaagcactacacaaaggggaaaatagcaaggctgagtacaaccaccgtactcagcaagccacaccaatgatgcagacgtgcaaagggatccaaggatggttcgtggctatttgcataaaggcagttgcaaaacatttatagttgaaaacggtaaaacagttgattaattaaggtaatattaaatctccactgatcaacgctataccacgttgaacaggcctaaccatcccacctgaactaaccagttcattaagccaatttattaagggtgagactaatcacggtgaatctagttgaccgcccataaccgtaggcataactattcgaatagttttactctaatcagatgtgtacaactgtacccacaagacacagccccacgacatgtttctgtgcgctgtcatgccaccatggcataccagaaagaggccatgacagggccattcgcataacctcctctaaccaagcgcaccacacctcaggtttcgcccccactcctcaacaggcagcgggcagccccctctcgtgcctaggtgaattcggaagcagcaaaggccgtcacaggtcccactctatcacgccactcttgcctggatgcgtcagctagaggaaagctacaatacaagtacagccgttgcctacgctggcttgtggtaactatgataggttcttacaggtcatcctgtgaaatggtccttaattgccatggcgcgacaagtaaaaccatgcacctgcagcaatagttattagaaccagaccggactggcggtctgaccaaaaaaaccggaaccagggcgtcggccagtccagtccagctaaaagattggcgagcaaacggaccggtgaaaaccaattgaaccagccgattttctgcagaaccggacaaaaaccgaagttggttcgaccggtcacgttgaggagcagaagctgcagcgttgggaaaatatgaaaaggttttctacagaaccggacaaaaattggagttggttcagccggtcacgtggagaaacagaagctgcatttttgggaaaatatgaaatggttttctgcagaaccggacaaaaaccagagttggttcgactggtcacgtggaggagcagaagctgcagcgttgggaaaatatgaaaaaggaaaatatgaaatggttttctgcagaaccggacaaaaaccgaagttggttcgaccggtcacgttgagttgaagaagctgcagcgttgggaaaatatgaaaaggttttctgcagaaccggacaaaaattagagttggttcagccggttacgtggaggagcagaagctgcattgttgggaaaatacgaaaaaggaaaatatgaaatggttttctgcagaaccggagttggttcatattttcccaacgggaaaatacgaaaaagctgctgttcatacatattttcccgttgggaaaatatgaaaaagctgctggattaagggatcaaacctacaccctcctcgttcccaaggagggtttcaaccaccaggctatgccacatgttgtgactagtgttataacacatatctatttgaaccgtattaaaccggcggtttgaccggttgaaccaataaaccagtgaaccgagtgccctaacggttcaatcacaggtccggtcttaataactatgcccacagcccaccattcagttgcactttagttggataattacgaccaatgaaacatggtcgggtgtctagagcacgcaactcgtcatgatactaaatgtctaattagcaagacatgcaattttatttgcaaataataaaacatttgtaaattaggctcaaaatgctcaaggggaatgcatgacttgccttgcttcttcaaaataatcttctgaactctttcctcgcgattgcgatcttccgaaacggcggaatcaacgcgctggaacgcaaaatgaggaaaaactctaacaaaaacctagtaaaaagtacataaaaagttaaaaaatgtgtagagcttaattttagatgaattttgcaagttgaatggcccaatttggagttcatatgaattagttatgaattttaaaagttttaagccatttaaatgaatttcttagaatttaaaccaaatttattgcgcaattaatattagttatggcgagagccgaggggaaggggtggcgccgacaagcggcccccacccgtcagtgactcaaggtggcgggcgcacggtggaccgggtccacgcgtggaataggcgcgggcgcaccacgtggcagccacgtggtggccagggcagcctagccgggaggaggtggcgcccacgtggcgccacgacggtaccgaccggggcagcactggcaagcaacgtggacggcccagattcatcgaggtgaatcgagcggccacgggtgagcaggagaggcgtcagccggccgaccgaccgggaggcggcgaccaccagcgtggcggcaggcgcgggaggcagtagagggaagcgaggagggaaagaggggggcagcggagctcaccgagcgcccgatggcagcgagcagcagcacagggaggtcccacagtggatatggcggcggcgcccgtgggacgacggtgtaaatgacgctcctgttggtggacggaggcgactgggtggcggccagggaagcgcgtgatgcggcgaggccagcgatgcgggcggcgcgtcgcagcggtggccgtggtgatggcaaacggcggctagaggcagtggaggcggcagtgtttcgggtttgctttagggtggtggtttcggcggcgggttgggggaaaagaggcaacagccgggcttgcccttgcggcggggcagccggtggtgctagcggcgtggcgcggcggtggctagggcgcaggtggttgtcgggcgggggcggcggatggcagtggcggctcggtttggcagtggaagcagcgtttcggtggtggtgggggaaaatagagcgaaggtcggggtgcgaagaagccggcgaagaagctggctagagagctccggcaagcggcggcgcacggactcgccgtgaagagagcgggagggggcgcgaggagcttggggaggaggggaaacatacgaggggagcgcggggagagattttatagcttcggatgcggagatcgtggccgatcggggcggaatcaaccggcaacggccggcaaagtgggggtgctgacgtggaggaggtgggctcgattccgtcgccgaaaattggggaaaatagggaaggaggtggaggacgtggggcagaccgcgtccacgccgtttggactcgggaatgggggcgagtggtggcggatttagcggcggaatggggcggcatggcggcggttgggaccggccggaggtaggggatgaccccgataggtgggccccacctgttgatggctcggggagaggagggaggagggagaaaaaatagacttgggagacaggggccaaggtagagaggtcggcccgaaaggaaggagggaaggaaggaggacgggatgagccacgagggaggaaaagcaggactttgggccggaagaggcccaaagtgaaaagtgaaggaggggatttttaattggttttccatttaatttaattgattaattgaactttgtgattttaaattacttcttgagctccgaaaattcacgagaaattccaaagagtacattagggcacagagaatattacaaaaatgtttccggccatgatttttaaaggaaattttaatttcctcaataattcacttgattaaattgctttaacttttaatataatttctggaatacattatttaatgatttttaatcccaatcgaaaattggggcgttacaggcggagtggtggtgcagcgtcgccgagaggacgcattagcgtcaattaagtggctgaggctcatgtcgttgtccgtctctctctctccctctccctcttgctgtttgctttgttaaatgtcagggagtggaagggagaacattttcaatggggccaaaccccaatgacatttaggtctttttgccacatcttccatatcaaatagtggtgaaaacaaaaaaagtaacatcatatggacaagaaaaatgaaaatagtggcacacgggagagttttagtggggaccagatggtaaatgaaaatgaaattttgaggaagtggtatatgggcatatgaaatttcgagggagtggcatttggatatatgacatttggaaggatggcaaatagtaaatgtcccgtgcctcctccagagtgctttcttttaaaaaacataagaacttgtgaggagacaataggggagactccattctaacccctccttttactcctctccttctcctcgttccttttttccacttcacttcttgatccaggttattagatttgagatctatgagggcaatttgttgtagaggggagagagatgcgaactcacgcacaggaggaggggaggaagggggcgccattggaggctggggagctagggttcggtttcctccaaccctccttcctccagggtttttacatatgggcaagggagtgggttgggctcgtgggcctagacccaagctgagttggctcacttacatggaaactgctcttttatttatttctattaacatctttattttaacaagcaacccaaactaaaaacctaaatatcttttaatatacaaggtattacaagtggtgacagccctcgagatctctatagttctccctgtccaggtatggagtagagcgtgatttggtaaaagcgagcaagccagtgcctaaattattacgataggattaaacttaagctttcttaagaccttgttcctcactagcaaatcctctctacccctttgcctatttatgccttgtgtccttggatgaacctggagaagagttaagcacacgcgttccctgtggaaattcaataccttggaatacttcagggtgaagtgctacagcggtatatccgtgtgcttgcagattttatctgtgactgtaagaaataccaacaagcatttctggcgccgttgccgaggaacggttgttgtttatctccgaaccttgttcattatcgtatctttttaattttctttcttctacctctacccggatacctttagagaagccttcctgtaaacacttctctaccatggagcacaaacctatctatcaattatcagctcctaggggtgaattttatgagccacctccttcaccgaagccaattcttacatctggctatgaaattcgtcctaaaattataaacatgattagggtgaaatccttctctggcttagatcaagagaatccctaccatcatctgcgagagtttgaggaattgtgttcatgcctcatgattcaagacatgacacaagaaatcatacggtagaaattgattcggttctctctttaagagggagcgaagcaatggtacacatacatcgttgggaatgtaaacggtaactagattatgttgtgagataggttatgcctcgccttcttccatgtaacccatattacatctcttcaggtacatatcctcagttttcggcagattgaaaaagaatcaatcaatagcttgggccagatttactttattagtacaatctacgcctaacttgtctatacccgattatgtgttgttacaacattttcatacaggcttagataaggagtctgcattccatcttaacatcactgctggagagtcgttttttcataacaccccatctgaaggcacggaaatcctagatcgaatcttggaaaatacttcctttgttgagaaatattctgaacccctccaaaaggcatctgtgtcaagtcgtgaggacccatctttagtcgaacctgagtctgacctttccatatctgtagattcaattaaagaatcctctcccaagccatcaacaccggagagcaaagaaattcgaactccaggatgtgctcctgacttcagggacgattttcatgaagattatggaaacaccctgaattatttcaacaaaaagaagccacatattcttactccacctcccgatccaatcgaagatgaatatcttggagtaaccgttggggagttaaccacaatcatgagcaacgaatggttgaaagagaaggagttctcttctaaagtaattcgggttaatacttctcctcataccattccttgccaaataggagggaatactgtaggcattttgtatagtccaacggtgatgtgaccatggctactatagatacaaccattgctcacatcatggatgaacaagatgatatcaagatcaagtcctccaagtgctggaatctgattcggccacctgctacaatgctgacttcaaacagccgccaaatttgcatacgaactccgttttgggcccgttaatacttgatggaaaggtctaggagtcctgtttccaacggatccagcctcattaccaaactcagtctcagttggccgcaatcaaagaaacaaggtgctacgtcacttgtcatgggcctatgggcatgtaacttcgttagggacctcggcccaagtggggcccatgtggggtgcgccccaactaggtggaacatgaccctagggttcctttggtcatccttccaccattataattagctacgtacccctttagagtttcttgggttttgtttagattaaagtttagctttgctactttgccgtgtaatcccgtgatcgattagatcgccggtttactcgttacggaaccccaacttatcatttgtgttcaattcctatctgcaattcagattgcttttatcttgttcttgcttgtttcttcgatttgcttgcaggaataaggttgatctgcaccggcaagatcaacaacccacagagaggtgtatcgatcgctaagacgcaacacaacaacatctcgtacggttgtagtcgggtcgtcaacgtttcttccaaatcatagttatcatcaactcaccgaaagattgggccaacaacagccttgagtgtctcgagtggagctcagggttcatcaggtggtatcagagctttcgttgctcggtgagtttttatctacccataaccagaaaatagccatacaatttttttttatcatttacctagccatattgtgccattgcattgttcttttcagtttttgctttgttgaattttgcgttgcatcgtcacgtcgtgttgctggtcttagcgtctagttcatttagagtttcgagttctggtcacgttttgttccactgttatcgccgccgccgtgttcttgttgtcttcgggacctacggaaacggaatcggctcgctgccacggtttcatttttctagctttagaagtttctgtcggtcggttttggagttgttgagttgtatctaggttttctgttgcgtggttgtatccgtgatgatgcgcctgtgatgtgcgggtgagaaagatggaaggagaagattatattagattggatatttggagaacggttgatttcttgttttagcgcacagtttccaaaccgtgtttccggtttccattgagtccaagtcccacacatgcccagtcgcacctctctgcccagacttattagtcggactccctcctccctctccaaatcacgttatctctcagttctgagtcgtgtcaaataatttggagaaattctgttttatgtcggttttgagatctgtttggaaaaacataaccgagataatttgtgaattccatttttgtataattttaaattttggtgtggacttttacaatcgagtccctgtaattttcatatttatgtttgagtccctgtaattttgcattgaggtccttaagccgttttgttaaaaaaaatttaaaaaaggagagaaaaggcagaaaggtgcataaaaaaaagaaaaaaaaagaaaagctgcaccaaaaatacagagaagaaagaaagaaaagagaaaaaaaagaaagaaagaaagaaagaaggaaaagaagaaaaaaatagttgtatctttgagctgaatttaatatatcagagtgtgcttgagttgtttctggtgttatcttgtggtattgtttgtgtctaggatcgcgtctctagcacgttctagcctaggaccagcacggtgcttgactttgaacaattattcaactttgcattctcttatttgagcatttgctattcctttgctacgtatttaagcctacccagagctccatagaatagattgcagccgtatagcaagtgtttggccaaggcatcgatacatccaacctctatcggggtgcttggttgagttggtgtatatcaccattccgcttgctttggtaagaacttgtaagagtttggttaaaagcttgagtatgtgtgatatcatgagctgccactacctagtagttgataggagcgtgcatattcttgtgtagtgtttcttgtttgctactaaccatggcaggattgagcaagggaataagagatcatcaagttcttcactttcgacgagatatgacgacttctccacgcaatgcatataaggtacatgataatgatcttgcaagggtagaatctaaattgccagtttttgatggtaagtatgattccgccgcttatgttaattgggagctaacagtagacaaacaatttgataagtatgatttctctaatgctcaaatgattaaggctgctagtaataagtgtaccggttctgcttctttttggtggtatactgttggcaataagcttgaaacttgggatgaatgcaaaacaatgatgaggaaaaattttgtgttttcatacttgcttgcagtgttgagagcaatattttaaagaacccaagggagaaacaggttatgcttgtgcctccgattactgatattttgtagggagttcagaacattcaccatgaggagaagagcaatatgctcgagatgtcatctccatcactcacgaaggaagaagagaagactgatgcacctatattatctaaagagggcataaaaggtaaattaaatggtgctgatattactcaaggtgagtgtgcttctgatgagtcacatttgtccactatccatgctaatatagagcaaatttgggtggaaactacttctgatttgcatttgtcacaagttgatttacttgctgttccttgtgataaagaagagttgtgtgataatgcttcacttatatccctaccacaactagtgaatgaacatgctatttctagtgtttcattgtgtgctgattttaagcatgttgttcacattgctaatgatgttgaggaatgtaaattgataacttctttaaatacttttggctatgtttagtttgatgatttttgtgagcttaataatttggaggagaaattatttgctaagtctgatttgccatacccaactaatgctatttttcatatctttggcgaatataatgatagaggaatatatttggtgcatagagttttcatttgttcggattcagagaaacatgttattgctaatcacacaccttcgagtttctctagttttgattggatgaaacaagttattttgaatggactatgtgacgagcaccatatggaaaagccgaggacggttttccatgaagaagggaaggatgatgtgaccatggctactacagatacaaccattgctcacatcatggatgaacaagatgatacaagatcaagtcctccaagtgttggaatccgattcggccacctactacactgctgacttcaaacggccgccaaatttgcatacgagcttcgttttgggcccatgagtacttgatggaaaggtctcggagtcctctttccaacggatctagccgcatcatcaaactttgtctcagttggccacaatcaaagaaacaaggtgctgcgtcacctgtcatgggcctatgggcatgtaacttcgtctggggccccggcccaagtggggccctgttgatgtaagaacacgaggcctgggagatctgcttaactccagtacaggtccaaaaacttgcctttaggttcgtgaacgtgccaattgatttgatcctgcaatcaacaagaaataaagacaagaaaccgtggttaaatccataaacgatagtcgatcggctagttgccgatgacatatcatttatctttgagccaatggcatatgtagatcgatcggcaatcatgaataagtaagaaagaactaaatctactcgatcggctgtagatattaacaatatataatccttatgtcgataggtacttaaatcaagtgattgggatagatcggtcgccatgccgagacagtataaatcatttagatcgaaatatatactaacaacaagactatatatgttcatagcatagccgatcagatagatctagtatgtatcggctaatactccgataccactctatattaagatatcaaagtatgtagaatataccaaacaaaagcctaatatacttaaatgcagcaagatcttaacataaagggcatatttaacatgtcaatcgagcatataagataaaagtggttaaatcaggtaagatcggctgaaaccccgatgctaccctaatcggcaaccaaaggcaggctaaagattaagatcaaactcaactgatgcacctataagtatgaaaagaaggacaatatctagacaataaagccgttggatgtttcatagagtggtagatatcctatataatctaagtcaacgtcagtatttaacttgatcggctgtcttctggcaatagacgttagccgattgaaggttagatagcgatattgccagagattatataagatatatgataactcgacaaattacataaacaagattagagtatcataaagatggaagcactaatcccgaggacgcaaaccgccataacaagttttacctctagttgaagatcgaaaccgatgcagctcaacccgaaagcaagaactcgtcgaaacaaaacgaaagtaaaagggtggcgatgcgccgagattgtattgaacgtgtgtgttagtttaattacatgaggctcagggtctatttatacgcgagattacaagatatgtccatgtcggcacgactcttatctctaacaaactctaagataccataagtctttgcggcagacttttgctcaaacatatctataaggaaattacatgaaatatcctaattaatagatacaattgccttctcagaactctatccatgcatggcaatcctcatgaagcacattaactcaacccgacaacgtatgccgtgtcatattgtcggattcggctcaatcggctaaccttgtctaactcggactctgccgatcctggtcacagctgattcggactttaaccgatcctttctctgtttccgaaacgatttccatcttggattctactccactcctatcttcatctccgatactcagattaccaaatttggttgttaacaggcccatgtgaggtgcgccccaaccaggtggatcatgaccctagggtccctttggtcgtcctcccaccattataattagctaggtagccctttagagtttcttgggttttgtttatattaaagtttagctttgctactttgccgtgtaatcccgtgatctgctagatcgccggtttactcgttacgaaaccccaacttatcatttgtgttcaattcctatctgcaattcagattgcttttatcttgttcttgcttgtttcttcgatttgcttgcaggaataaggttgatctgcaccggcaagatcaacaacccacggagaggtgtatcgatcgctaagacgcaacacaacaacgtctcgcacggttgtagtcgggtcatcaacatttctcccaaatcgtagttatcatcaactcaccgacagatcgggccaacaacagcctcgagtgtctcgagtggagctcagggttcatcaaacggccggtgctaatctgatctctaaatctctcgctttctcctatttgggcaatggagtgataatactgacctacaaattcttcaaacatcatgttgggcagttgattgaaggatttgcgattataaaagatgttcttgttcatcacaataacaaagaggttgtcatggatttccacgcttttgaaatccaagacattgacgtcctaatcgggcatccaattaagaaacttctcatcgacaccatgtaattaggaagcctcgaattctcattaggaggggatgagttttctgtttcattctcatggtcaagatatgccttgaccgatgcccttcctgaagatgaatttgcggaggaagtgacggttgttcttccatttgagccccctgaatctcttcttgaatatgatgtccccgatttcattcaagaggaagaatcgggcgaaacctttgaattgtcgtccttagaaccaccaccaccacggcctatgatcgaaataaaacatcttcctcagggccttcgctatgcttttctacatggcaacaaggaagctcctgtcatcataagtgacaagctttctgaggatgaaaccattcgtcttgtaactgtgttagagaaacatcactctatcatgagctgctctcttcaagatctcaagggcattagtcccgctctctgcacccattgcatacctattgagcttgagagctcactgtcaagggaaccccaaagatggctaaacaatgcgatgagagaagttatcaagaaagaggtcttgaaactcttgtgtgcctggattatttatcccatacaatgtagtgagtgggttagtccagtccagattattgaaccagattactataagttagattataataagccgacatagaataagttgttagctgtttgtttctctagattattagctgtttgttagctgttagccgaccttagtcatgtaaacacggtgcttagattattgaatatcatcaagtttgctttccaaaaccagatgagttttaacaaaatgatagagactcagctggcgcagctagctgctctagttcctgctaaggaagcgggacggattctagggcaacccaaaccgtccctagaaaatgttaaggcgatcaccacgaggggaggaaaatccactcgggatgtcacgcccggaaaaataccttttcccaaacgctagtgtattaatccccgtcctagaaaagccggggtacaccacacaaacatgatacaaaagacgcatctttattatatcgataatatttacattattacaaaggcacttcaggcctgacaatcaaaaataaacagcagcggactagcgggcctacggctccatcttcacaggcgctgaactggggtataagccaggactccacctaggacttcttctccaaagcttctcttactgaagagggaaagattgagcaagaatgagtacaaccacagtactcagaaagtcacaccgggagatgcataattaatgcgaggggatacaaggggataataataggggttaggttttgcagtaaacatcatttaaaagtcacttagttgtccaaagctattttgtaaacacgatcctagagctacacaatattattaatcaaggtcgtgaacccacacgaacctgcttaacccaaggcctacgatgattcagaccgaactagcaacctgacctggatcccaactcgtcccaagccaacccaggccaaccattccatatttttgttgttacgcaagttttaagaagtaaaccactaactttggtacattgctaggcttgcccatacccgagggtgcggctattcgaatagattatactctgatcagaggtgtacatctttacccacaagacacgcctttactctgcattccattgcaagtggtatccatcataaaaaacgtgacataactgttgacggtcgttatcgatcagttttgaccgtcaatattactaaaatagaggggaactagtgatgcttgcaatgcatatatatgttagaataataaatttccactagtattatgtatactaaccttttgcagagaatgacaataaagtggaggagaatcgacatcaacacagacgacaaatcaatcggacgatgtcgagaaccagacttatgtatgaatgggccaagaactcagaattgatacaaagaattgggccaaaattcacaagtcagcgaatagaagcaacagaggaggccgctagccgaaattgggctggattgggccggccccaggttcggccgaaccagggagttcagccgaaccctcctcagcgccatccgatccagggcttcgcctggacggtatggattagcccccaatgacggttagagggtatttccgaccattccaaccgtcacaaccgtcattgtgaggctatataaggagttgccattctcacttcactcacagatctcaagcaatagctttctcatttctgtcaagtttagtttagtagtatctagctggtggaataggaatagagtagaaatcaagagtccggaagtcttcggaagagttcaggtatggctctagtagccaaataaatatatagaacaacggaagcttgtctacccaatccagaagcataccgactaggggtttaccccattaagttcaagtcctagaagaagcagacgatacccgcatcactcaaggactaaatctaaaacctgcaagcaaaaggttaattcaagagcaagagtcagtacattaatagaaataatatactggcaagcaccaagacaagcctaacaccctacttgcaaggcatataatcaagaaaggcataatatggttctttttagcataaagcaagttttgtttgcataaaacatttctaagtcagatttgctttcaaataaatttcagcaagctagtacttagcatatgggcattaaagtaggcattaatcatgtataaatattcacctcattgccatccatggcagcaaggagatcattctcaaatctcaatataatttgaaggtaaatttcagcatttagaagaataaacacaagactatactcaatacatatccacatgccgctcgtaaccacgagcacggctaatcgattagtttttagactctgcagagtttgtacagatttacccacatgatgtgaatcgctctagtttatccggtacccgtcggtaccaccatactctacacacattgagtgcgtctagaggtcacaacgaggcttttacattaagtcttgtccaatccttgcatgagcacgatgagtgttgttccacactaagtctagaatcttaatgtcattatattggggggggggggggtctttaccaatataacgccataggcaagccggtacagtcgcttcctatgtggcactcaacgttgtacatgaggcggaacattgcagtcgtcccctcacgcggaacaatacagttgttccctaccaaaccataaataaaagtgaggcggaacgttacagttgtcccctcataaacatcatgcacataaaaagcggatcggtacagtcgtcccctttgcaattcacataaacacaaatagccctaaagttcactcgtaggcactatcgctactacaacggcctcccgaatgcaaggttagacaagcacttaacttaataggccaaggtcaccccataataacacatgtggatgtacagtaaacataatgaacaaacattgagtgaagtccttaggtcggtttgggcgcactctccccctatcggtacacaactaatcaccatatgtgtaccacttgaggcccaaacctaaactccatgttttccatcattttatttatcaaaatcacaagtattaaagttctgttcagattatttcaaaatcaattttcatatttgtaatgaatccataatgataaggaagatcattctaagcatggctaagcattatagtaacctaatgactccaaaactcatatataaagtggtatagtcatattgttcctaaggttaggaatctgggatatggatatatgtggggttagggtgataatgcaagtaataggagtttgtctaacaagtttaacaaaattttaatttattagtgtacaatcaacatgcaagatttgcaaacattttcaataacctccaaaacataggtttaaagtgatcaaagagagggaggtgggacttgccttgcaactgaaaaatgtcagcacctaaatcacttcttcaccgtttaagcattcatctatataaagtacacgttatgcaattaaacaccgaaatatgcgaaaaaaaatccaaaatgctctaaaatgcatgatttgtgcacagaggataggcactggtttaagatgaattttaggtgaaagaatttctattttatctctttttatttgggagttatgaattttagaagtttgctcagtataagatagtatcacctagggagtgttataaaatatttttataaagtgatgtttattaagtttgacttcacagaggtgtagaggagtgttttctaagactaacacatttggtttcataatttttggagttaatatgaattctttatgtattttacaagttataacgtgttctaggcatatagtctctatgaatatatggctttagaagttttatgtccaaaacatgttctatttactagagatgcataaaaatgaataatttagctaaccaatttaatcttagttcaaaattttagagtttatattactctactacatattttataagctagggagtgttctatgttagtgacttaacatattaacctagagcatagtgtgccaagttctagtggttagggacggaacttatgttttctctggtccaacaagttggtttattcatagctagagtgcattttaaatacctctacacatatattttgcttaaccattactatgttgaattccactatgttcactccatttggactaaagatgaattttctacaaattttagaaattaaggtatgctctatgttgcttattccttacacaaatgtttaggggtttttattatactgtaagtatgtctttttattttactagtgaacgtgcttgcacgttccctcacgtataaatacgagtttattatgttttcccactatgcatattaaacagaccacatatctctctgtttacagtttgtcatataaacggaaaacaaccaatgataccaaatatacaatttgtcatagtttgataaatgtttggcataatatgaagtgtacaattgccacatatacatacatacatacatacatattatatatatatgtatatatatatatatatacacacacacagagagagagagagagagtcctttatgtaagttatagcttccttggtcacctggttatgatgtgcatatatgcctgggaagaaaaccctgaaaaacacctaatagaatgggagaaagcaaaaagaattacttgcagaaactattggcaatccctatcactataataaaacagcattatatactttctataatgatgcatttagcataattagttactactcttttctaggtagcacacaaattaaactgaggggcaattttggtgcaccaaacctgtcagatgagtcatttttcataatctataccacaagatttcaacattatcttgctacattcgtttttaattttggtgctaaatctacgtctatgctaaagaaacataaaaaaaactgacttaaaggaaaccaacctacactaaggagccatgcaatgttgtgtaataaaaaaatataatatgaatatttgttgtatatttttttctcgaaagatagtgctctatagctctacctgcgctaaaagactccatttttttttctgaacctttatgttcatcaacaatgttttagctaacctttacaaggcaagttattatagcttcggcatagtttcagcagcatcgtcttggataggaaattgtgttgcatgttatggaataattcaggataaaaataggatgggatctacatattttataaatagattctcactatttatcatgggattagatggaatcatacaaatttttaattcagatgacagagttctcggttgtcaacgtaagcaaaatattattcttccctcacaataatatctccagaagcttctgaagcctgaaaaagatatattggtttacataaacaaccactgagaaatggaaatgctttgcagagctcgtaccaagaaaaataaaattaatagttgccattagtaacttaagaaacaagagctttatttgataaaaggcagatacattcagcaccagcaatctataaaagccaagatctgtagcagcatttagtaatgctgaaaattttacatatacacaaattgtggttccatgttgtttctataaaaagtattcagatcagcttaaacatatatgcctattgagctgcagttaacaacagaattcaaaattattttaagtagcaaggtaattgatatggaggattataggacactacgaggaaattaacaaagtacgtcgcaggaagaagttttgtacattgagcatatttgtatctcaagaagcttgctaataagaaaaattcaagggaactgaatggtgttcctaacctggaaactcaatcatgcgtcaaaatgataggaaaacaatgcaggtccaaactgaatgaaactttatatataaattgatctatttaggcaggggcaatactacttccaacactcttactactctagtgtatctagaaaggtggtggtttatacagagataacactttaatgatagctcaattgaccccaatgtcacgacgttgatggatgatcgacggcagggctactgatgggcaaagaggacatatcgatgtggggagggggggagggggtaggaggaggggatctgtaccttttggagatggcgtccgagggtgcgtagggggtggcggactggatggcgcgaccagcaatgggggcagcagactggacgacggtggaggagggctccgcaacaaacagacactgaggttcactccttgcaaactacagacttgaccccaaacacctgatagtaaccaatcaagtggaacagctgcaccatccacttttgaaactcaaattaggtacctcttgcaatatgcatgagctcaaggaccaaatccccaacatcgctgcaactcctttttatgtcaggattagcagaagctcattttcagcatatttatgcctttttttttttgaagagaataggcttcattgctatacaaacaaaacaattgatttcgaatagttggatgtcaaaatttgaggcctgattttagtctaacatgtatgacaagtgcaataacaacataaacaaataatcttttagaaagatgtcgtctgatgtaaacaaaggatgtcgtcagtttatttcagtttcaatgcaaaatgatcgtgaaaaacaacatgtattatttctatttccttcacagaacaaaaatataaaaattactaagcttcatttccacatctatccaaaataaaagaaaaaaaatagttatattagataacacaaactgtatctgtagagcatcagtcatacataaacaacattgatataagtaattaagtagccacgcttccaatcaaaagtagaccacttgacaaacctttcaccaatttttggcctagaaattgacaaagggatgccgacacgcaccatgtggggcttaggacgctataatcaggagttcgtcttgatcaaaggcaaaactcacaaagtgtattcacagcatttgatgctacatcatatcaatttggggatcaaatctactggaaagccacatggagcaccgcccaaacggaattgcgtcatggtggttagttgctcgcaggacttgtagttgtaccttagctagttggttgtggttgtgcatgggcgcagtcgcagctgtggttcatcctcgttgccacccaatcgaccgccagagccacatccacgtcttccgtcatgccatatctacccatgtaataccccacatggattagaactgattttataatacttagagtactgatagatccatatgtgaaaagaagctcataacaaaggcaagagggagcagcagtacattaagatcccattttatatgtcgattaaatcaaattgaataatcaaagtcatcatattttcctaaagttatcatatttcccttagatttcctttagaagactcaccaagatggtttgttggctcatcaagcaaaaggatggttggattcataaacaaagctcttgccaaagcaatcctcacacgcaccagaaaaatccagagttttctttgcctgcatttgtttattaaagcccaaaccaatcaatatgtcacagatatagcaataggaagcgtttgaagagctggtcacctgagcagacgaaaacaaaggaaagggcctgttcactttgatgccaaaacaaaattttggcatagttaccaaaatttgccaaaatttaccaaaattttggtagaatttcttatatagttactaaaatttggcagcaaaataaatgtagctacttttttttttgtaaactttaccaaaaattggtaaggttgaaaatggcattaaagtgaacagccctaaaaacaaacaaactccgaactcacggtggtggtgatccaacgggcggacacagagaccccaccccccaaattttggggaaaacccccggaaaaagggggtttggggccccggaaattttgggggttccgaaggaggaggtcggtgatggtgaagatgtcagcggcgggcgacgctgtcggtcagcaagggctgtgcctcaatcgagccagcgtcggtgaagatggcttcgacggcacgacgactgatagagaggggcggaggagatcgatgcgacggcgctcgcttcaacgacagctgcgcgtggcgacggggacccggcgactgttggcgctgcgagattggtggcggccgggcggagatcgatggggcggtggcgcggcgactgatggggaggggaggggcaacgataccctcgctctcagcgccgatgaggcggcgatgaatctggcgttgcggcggcgcgatggagcgggaggggatggaggagcggcggagcgtcgatgtgcgacggttcgggaaggaatgaggaggcggcggcgtggggattgcagaggttagatcgtgttcccgttctttttttttcccgttctttttttttcgtatgagtagtttcctttttttcgtgcgcgagatatggtgctgtttctttgggccagatgaccaggtgggtcccacgcgaaggattgcagaattatggatgaactcgtactttttatattaatatacataacattgaagtgcatagctctatgatgctatagaacttgtgtttactcaaaaaggatctgagatgaattttatataaacttctaaagttcagctaatctaaaactagtcattttaaaggtaatagttttagaggcatttgatgtaaagtgtgtatatgttttatttcactttgtttttagagaacatgttggtggatctttagaaactaagtttgctctaaaatgagttgaaatgtattttgtatgcattttataaatttgtatatgctttatgtatgatttatcttagatgaattttagaggctaaatttgtactgtgagtgcaagtttttatttcataactttaaagttcataatctagtgagttcaaagaaatttgaatcatctcaaaataagctttatttgattttatatggattttacaagttctaggtttctctcttgtatagtctcagattttatctccagggggtccactgtcagtgatttgcgaatatgcagaaagacccttacagtttttaagaatcaatccgcagtcctaggcccatatatatgtcattgagtggaaagattgtacaataaaccttatagttgtttaaattctcaaaatgaggtcctcgtcttctacagaggcagagcagccatggctgagctcgatctcaggttcaccggaggcgattggtggctcgtttggggttgaggtaaaaatataaaatgaagagaactctctcacgattccattcctctacttttctcgattagtggacatcggagtagcgccggcggcgggtccgagcgaaagatggtttcgggtggtggtgcatgtgactttaggggctggatctagatgaataaagtgcatgaatgcgacactaaagcctcaagaatgctcgccatgagtctagcgaaggttgccgtggtcttggcggcagcggtggcttgcagaacggcttggcgacggcaagaacctcccgggtgaacggcgacggctcaatcggcaccaagaactatcgtgcaaatgtgtccatgaggttagtgaggccagagagatggtgtgtgcgcgagtaatcgagcaatggctcaccggaggaggcggaaacgacaatggcgacggcaaccggaggtgaagaagacggtggccgatctccacactcgtagcaccattcttcgtggttcttgaggggaaatggagaggagtacgaggcgaagacgatggcgcgatggcatggcccggcttggtccagatcggtggcgacggcgacgatgccaccacagcgacgtttggagcgcgctctggagctcttgagggcacgtcggcgttcccgtcgatccgctgcacgagagaggatgaaatcaaaaggagaaattttccgtatggtgaggtgagtatggaacgtggaagagatagggttggcgaagactcgtaggcgaggacgagcgtcgtcttcatcacagccggcggtgagatcgaaggcgaggaaagcagctagagcttgttctctcggtttggtcggcactggagtgaggagtgaggatgggcgatgtggctgggaagagaaggaggctcggctcggcgttgccacgtctcggccacgcgtcgcgcacgcccagagccgatcactctctctcgttcattgtgggtctttagattggtggaaaagttatgcacagagttggagctagcttgtgacaccgtcaagtgggcccaggtcggagcaaattaggtgaggatgagaagtttgggtccagaagcaggtgggcacagccgacacaggtctcaggcaaattccaggaatttttcttgattttatttcttctcccttctttgttaatttatagattaatttttattgcatatgagttcacatggattttattggaggcagatgaatgtacctagtttccattttatttggttgtactaaaaaattatggatagattgttcaaaaaattaggagaagatagactcattggaaaccagtttgaatttttaagaggcttagaagagaagataaattctgcaaaaattatatttattcatgataattaacctaatatttgaataaattatttccctatacactttcatgcagtttaatgcacatttattgagggtaggtttttagccgattaaggattataattaacctactgtttgactggtttgaccgatttattttaggtatcaaatttagttattaaattataccaaaattacagtgagttgcatgtattaagtagagcctacatgaatttttccataattttatcttgcacgaattattttagataattagcaaggtcttttctttatatggacatttccaaatcttagatgcatctaaatagttgtaagaaatttatttagactactcttaatctatagtgatactatttaacctcattttcatgtctttataattattgctcaagtgtggttgtaggtttgattagtgaaactttatcttttatttatgctcatgagtcctagtatgcaatgccaaccaaaaatctaaatgcacaagaaagactcaagtcaaaacatgttttatgcaagtatccatgctttcacttgagttgcatctagtcctaggttgaagatgaaaaagttttaatttattctaaaattttattcacgcaagagttagatcaacttcacctagatttaaaatggaaatttttggttcacaaaattgaagaactttcctttcaactagttttgatggaaatttcttaatcctagaattcgggtatgttaaccggccgggagaggggactgtaccccatttcaacacattttcattccctctccaaagtttgctctcaagctcattcaagctttgatagtttccctcaaattcaaatcacttagttgcatttatacaagttgctttggtgaaactaactggcgggtgaaactcttgtcattcctaacccccgtcgagttagtccgttcttgcttcattgtacagaatgaggaggcgactgtctcgtctattcaagggatccggctcttcatcaagtcatcatgacgagtctagtactcgttcatcagctgatgtttcgatggaggatgccgaagttccgcgacgactcctgaacgacaccgacctcgaccttgtcagtgatcgggagagacaagtctactatatgctgagcgaccgggagtatgctgacacgcaccggagctgctgaaaaagataggtatggatgttgaatttcgttctatttggaaagcggttggttggcagagatttgctgtggtagatgagcctggttctcgtttgcttactttgcaatttctgtgcactttgaaagaaatagaatatggtatttcgttttgtttttccataaggagttcacacttacatggaaaggcttaagtacacttcttggttttcacgattcatgtaaaatcgatctccagaaaggaatttctaggttcgagacaaataggttttgggaagatatttctggtgctccaatttgcaagaaatctagaacaaatgatatccataatcctacaattagactcatgcacaaattgattgctatgactttgtttcttagaggtgatatgagacccattaggggagatgaattgattatcatcatggttagaaagatcaaaattgttcctgtgaaatgtatgataagacaatggttagaaagtataaagttctctgctcctgttgagtgcacttctctgattactcggatagcaaaagggctaggtgtcattagcgaccaaattatttttatctcagctgctcgtccgcgtattgatgaggcttatctagtgcaagggcatattctgaaacatggaatagatggatctttggtatactttttccccggttgtacaaatgaaatcccattgccaaatgcggggtatcatttgtacaactgccatgaactaaccattcccctgtagaccatagaaaaacctcgtgcaggtggaacatacagggagacgcgcaacatgacaatgatgaaacgagaaagttcatcatccttgacacccgtgcagatgtatgaggcaggttgggcaccaaccggggatgcacccggatggacccaagctccacgccatagcattggagtctcaacctgggcaagtgccagtgaggaccggtggcatgcgcctcatgacatccaatggggggacaatcaacctcccagatcaagtggtgtgcctccatctccaagtgaatggcgctcgagttcctcttgttgggacttaggtgaaatcactaggagaatggacacccttgatatgcagacaggggagatccagtacaacttcacggaacacatagctcaaacgtaagaatggcaacaatctgctgatgctcagttcgccaacatcaacaatatgatgcagcaacaacacgatgaccttcaggcgtactttcgttttcaggggttcaatccgcatcaaggaccctgagcgaaagccaagcttggggg

SEQ ID NO: 71870 - DNA, 71438 bp, Oryza sativa
ctagctagtatttttgcttcttcttgtgaattgtattctgagaacaataggtcatttgcaatttgcttcctcatgtttgggatatattctggtctgatcatatctttcaagtgcatccttgggttccaccattccatacacttcatagcgtagattccgcaatcatgccttgatgagacaaaaacaaaaataaatcatttaagaaaaacaaaatcatgggaaaaaaagggaggagttttggacaaaaaagaaaatgatatgtaatttggggatgtttgttggggttgataggtagttacccattgttttggcgagtaatttgtgggtattggatatcaaatttactaaagtctttctccacatctgagaattcttcccacattgcaatgaatcctggtatctgtgtataaacaagaggagcatgaaaaaaaaaccagaaaaaaaatcagtggatgcgtctataaataaattgtatggaaaaaaaagaacaaaatttgtatagctcaccagtagcccttgaattttcttatgatatttgctgttttcatcataaatggagtccaggaagacaaagtgatgccccttgatgtccacagtaaacacaaaccaatgattgtcatacaggcatgggaaaataagctacataacataaaaaccaagggggcatcactttatgttaatcacacacacaaaaaaaccgatcaattttatgtttgaaaagaaaaatgtacaaaccaagtcatagtagtgcagaggtttcttgttcctagcaagtgtaaacgcttgtcttgcgcaattttcatagtcttcctcttttccagcaccttcccaattcttcaagaaataaacctgtggaaaaaaaggtagagaattttgaagtgatacaactggagatgagaaaaaaaatgtatgtgatacaaagtatgaaaaaatcacatacactacttctgtggaagaagtaaaaattcatgtattcattttctttgttattctggtcgttggcaatcttcttggcatacgcgttgaggacatatgtatccaccactccccttggtgataaatatttagacaatgatgaccatgtgacttttacattgtccattagaactgcaaatttactgtaccagaaataaagaagataaatgcttttagtaatgcttagtactcttaaggcagaaagagtacaaaacaaaaaagttcagattacttaatttcagaaaattggaatagtcagcacaagctctttgttatgcatattatgaaaaaatgcaaaaataatttgtaatgtcatagatttttcaccttctttgcatgccttgttgtgttaaacaaaaagtgataaactttcatttggttgttaatgcaaaattcagctgctcctaccacttcaggattatcatacaaaatataaaatctaaagcaaaagtgggaaattagtgcgacatgtatcacttcagctgtgcatgttcgactctgtgttatgaacaacgtttgtaaaaactacagaaaaacaccccacctcccattcctttttaaataaaaaatgcttgaaatgatcacaaaatctaaaaaaagcaaatgtaaaaaagcaaccattataatgttgttttgtgacacttactttttatattgttgcgtctcaccaatgctgagtatgttgttgtagtgattgagttcagctgccgagatggtttggtgccgtgtgtagttgtcatatggtgagctcttgtatttacttggatgtacaattcttttagggcgataaagattgtgtctggtaccagaacagttgccagaagcatttagtgagtcgatgattcttgtcattgaatattgtctttcttctgtttgagcatgttgatttggttccctcatttatgttattcttggagaattcatacctatattaggtgatgattgtgaactctgcattaaaaaataaaacaagtgaaaaatgggaaaaaagagaatttattgtaataatgtttaagagtataagacatagttttatgtcatgctgattgaaaaaaattaagcaaaaaattgagaggaaagtacttacaatttgtattaccttttttgtagcaggtgtccttgcagaagtaatgtttatgtgcagtggtgtttgagggctactttgctcattgtttatttgtggttgctgcaaggatgaaaaataaaagtaaaagaaaaaggacacctgaactgagaagaaaggatgtgaactcgaaaggaagtggtgaactcaaagaggtagtggctctgaactgagaagatgatgctctgatcaaaattgcaattttggactgaccttccgaaaaccaacaaacctgttaggttgtgctgttatatttaaagtttaggatcccaagatagtattatatttttcaaactgccagctttttgctactagtttattcctccaatatctacttctatactactacctccatctcataaatataaaaagaattattccttttttgcataagattaaggatagcaacaaaaatactataataccaatgttaaaatatcagaagttcagaaattgttcagtaaggagcatacccaaaaaagggttgatgtttgaaaaaaaaagacaagtaaaaaaaatcagaggttattaccgcacgttgttcaaccatatcgatgttatctgatggttcctcttcatataagaattctgcgaagtcatcttggtactcgttttcatcacagtgctgtccctcaagcctcctattccccatgtttgcagtgaagtttgctaacaaaaatcatccacataaaaataaaaaaaagtaacaagaaaaaacatctaacatgattgtgcaaatataaatttggttagttaatctttttattcttcctagacattttgattcgccccccttgattgttactacttatgtctataaaataaattaatgatagtacaaaaaaatcattttatgtgtacagagaaaaaaggtcaaagttttacctgataaatgttgaactccaactttattgtttatgcatgttttgggtgtgttcatgtacctctccccctgcgtcacctgaatgctgctatgttcaatgtccatgatgtttgtgcctgatgttgtttgggacaagaagtgcccaaggctggcacttttgtttgtttttgatttatcatcaaaatgatgtaagcattcaaatttgggttgatgtgtgtgagttacatgagaagaaatgaaaaagttacaaatcgggatagatcaaaaaaataaggtacattttttgtacattaaagtgcaacatagatataaaaaaatgttagtttatcagtcaatcaatgctgcaaaaattgacaggattaaaatcaaaacaataaaacaaatcagtacacagtactggtagaaaaaaatgtgacaaaccaaaattttatgacatgtggagtttagattttgttcttgatgtgtataagataagatgacactgtaaattaaaagatgacccaaaaaataaaagtgatttagaaaacacctgtatgctctagtttcatctgttttctaaaatttgaggtgttttctaaaacaatgtctatctgcttctaaaaaaatcatccacacatatataatatgtacaaacaaaattatggaccagtgtacaatgcaaaacaaacattatataaaaaaatagaggtgtataatacacaaaaataagagaaaatgaaaaaaaagcggtttgttgctcacaaaacaaacactaaaaaaaactaaaaaatactagtgctttaaaatgcatgatatatgtttgatacatttgtgctcttgtttggaatgttgtctgattcatcttgtgtaggatgttggctcttatgatcttctgaagagtttgaataattcacaagaatgaacttcgtcttatcctaaaaatattaaaaaagcataataaaaaaagatataaattgattaaaatcattgaaacaaaaatggaacaaaaaaatattttttttaaaaaagtacattatgtagtcgaaaaaaatcatttcctattaccgttgtgtgacctgttatgtcttcaacatcatatggaccctctatatcaataacaaactatgtagagttgctttcaagatccttggtgggctgcacctttttttgcaaaaaaagaaagacatgtagtgaaaagccagggggaaaaaaatataatggtttgaaattttgactcttgcctaattttgaattttacctcctcctttttggctggtatagtacagataggttccacgaaaagaccatccttgtttgattcttccttgtctggttgagtactgataggttgtgttgcttttaagggctgaaaaaaatgaacttatattatgcaaacattttttgtaattttttaatccatgaataatgtattgtgtataatgatatgacataaaaaagtaatagtgtttttacctgtttccttactgctttgcgaatcttttggtcagaagaattttttttcgatgggctaattgatacaaccgacaaaggggatgctgaatgtaatatcttagctctagtcctggatgccacagagttgtttgattgctgactacaaacaaagtccttactggatgcttttttatctggaaaaggattgttttagagtgaaattatgctaaacaagacattgcttaagcgtgctaaacaaaagataaaaacataccagaaaagaaactgggaaaaaaaattgacaccaagaaacaaacccaaaaaattatgtttgtttcttggtctcaagtaccgtattcgcctataacatgaatatttatgggagcatgacacttttgttacacaaaaaaaatgaacaaaacaagatattgctatagtacaaattgaacaaaaaaaacctgcatactgcgtttctttgcaagcgttgtccttgttgctgtttgactttgagttttcttgttcagtttgttttgatggtggtgtggtttgtagttgggaacatataacattctctgaaaaaaagtttgtttcagaaaaaaagtattactgtcaaaacagatattaaagaaacatctaccagtaagactgcataaaaaaatggagtagatggtgtgcagtgagattatattttcagattcaaaaaatttcagcttgcaaagctacagaccgtggcatagctgaatcctggagcatattatagcttaaaaaattggtgataaaaaataaaactaatcagtgtgatccatgggtagcctactggaacaaaaaaaacaagatttatgtgaaaaaaattgaatgaacaacggatagttgttcgctttgaaaaaatttaattgagcaatagactaatagggctctgtatgaacatcctaatatatcttctatatttgtgaaatacagaacatatatttgggcctggtaacttatggttctggtaacattgagtactgacacagaactaggctatgcttagtcatgttccagattttaaagaaagtatacatgccaagtaaaaaaaaatgctatagttcagaatgaacattttttttggactggatagattgatattagtggtagggaaattttgcttagcattggcacaaattatttgatctgttgtgtttgtgtgctatttgtctaaaaagaaaaatttacaaactaacagaataataacatatacctgtagggggtgctcctttgctagtgctggtgttgttgatgttagactttgtttcatgctctacagttgattttgtttgtggtgtctttggtagttgggaacagacatcagtgttgtttgggtggttttgttctaggggtggggcattaccattatgtgctacattgctgccaccctgctttcttccctccttgatcttctcttctctactcttctcttctcttgttatggtgctatctttttgtgtgaataggcttgcttttgacatgtagacgcaatccaaaaccttggcagctagttgtgcattttttccgtatgttgtgtcagaaagttctcttgtgaaccacttgcaaactgtggaaatgtcatcaatgagctacatttaaaaaaaaaacacaataggagtgactatattggagcatacatatacaaaactaggaaaacaatttttttaaaaaaacagagcatttggaggagcaaaaaaattacccttgggttaaatgatttgctatggtattgctggagagcatcgctgcatgacatgttgctattgttgccctgttactcaatgcagcgggcccctgaacatattgcgtcataacttaatttcttcattgctttgatatgtgaaaaaaaatagagtatgatctaagaaaaatgaaacaaattgacacaaaataaaatttttctgttgtttttacttactggtcgctttccaaaatctcctgttttgcattcatccatttttgaatactcttttatcattccgcctttccaaacagagattcttggtggtggaccaattggaatatttctaaatccaaaatctttgaaatcaagataattaatctaaggaaacaacacaaaagaaaaaaaataagtcaatgtttagaaatattatgggtttaaaaaatgacttaagtaataaagaagagaagcatacagcaagtaagtgtccgcagccgccaagggttttttgtgacatcctgatttttgtttcagggtttataaattatttaataaattaataatagaatttatattaagtgttctttaatttacaagtgaagtaaaatgtgggaaataaaattttctaaatctaaagcatggatggatttaatttttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggatagataaaatttcattaaatactttgcttaattctataattcctagatttttctgggatttatttgagctaaggaagtatttttaataaatggaattgcatttaagaaataatttaaattgaaaaatgtttttaaaagtcttcttttggctttgggccgaaagtcggcccaaaacctctctctttccttttctccctccccggccagttggcccaagtcggcccagtccgcgccgccgctctcctctctctctcagccgctgacaggtgggtcccgtctgtcaggcttgtcttcctcctccggccgccgccgcccgaaaccctagcgcaagccgccgccgtctccttccaaattcggccgcgtctttccttctccggctgaatcgtttgagggcaaatgatccttgagatctcctcttccttttctcttttggaatcatcgcctaattcggtttggaaactcgatggattcgagatcgaatcggattcctctctccctcccgaaccctaacctttccttctcgtcgccggcagccgtgggcctccgtcgccgctcgctagcccctttaaaaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagccgccgtcgtcggtcgctgttgccaccatcgggatcgccaagttgtcgccgtcctcgtccgccccttcgccgccgccgaagaccgccggagcaccgtcgccgtcgtcgacccgatctccgccgctgcttcttcctcgtcgccggcgccgtccgttgctcttccgccgtggttttggtcaccggtgagttcgccgcgtcgccctctacccgttggtgtcctccgtttgcgtcgtcgcgccgtcgttcgccggcgagcgtgcgccgcccgagccgttcgctccgccgagccgccgccgctgtcggtgacgtcgtcgctgacgtcatcgtcgccctctcccgtgagccgccgtggacccattcgatctcggccgtccgttttggatagggttgatctcggccgttcgtttccgtgaaccgctgccgtgcacccggtccaccgcaaaccctagccgctgacgcaataaatccccttttccttttcaaaaataattcattattgcgtcataattcaattaaaatccatataaaggttttaatccgatttaatctttaaaaattcataactaattcatttgaactcagtttaatgtggttcaagttgcaaaaattataaaataaagatctacatattaaatttgtccataaattgaattaaatttatttaattctttttaaatgggctttaaatagatttaatcttataaaattcataataaattcatatgaaatcagaatgaggccgttcaagtctcataattcatctaaaattatgatttacatgtttgtttactttttatgtattgtttatttggtttttattagtctttttcttcgttttgcgtgttagcttgtcgtttccgtcgttccaaaggttcgcgagtgcgtcggaagtgttcaagaagattaattgaagaccgattattgcaaggcaagtcacacagatcctaaacacaatcctttgaacatgttgatcctatatttaaattctctatttatttcaactgtgcatttattttcgaatgtcattgggtggaattaacctattctttgttatggcccttttgttcttgattactttattccttgatacctagggttattataatttgactagttgagctttatatatcagttcaactagatattagatgtgattgcttagccatgctcagaaacattagcacactattgggataacttatgattcattattatttaatgatggtttaatgatagttcacgatggtcaatcgtgattggttaattaattacttgccaactaaaacctgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattacggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctgataataatttgcttagctcctggtttggagattagatctgtacagccgggtatggttgttcaggatggttgggcctgtgcagcatgggtgtgctgttcagtgttgattaaaatttctgattaattactccactgttttacttctcttaaatgttttgctgaatgctgcttttgcaaatgagcctatattaggccatcctttggtattcttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcaattttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacatttttgatgtttgttcctttgattttctctccttttggaacttggctatgtatgtcataagccattcataaacaaactttgaccagttccactttgagctggacttgacatcaatcagaggttcaaggtattttgggttggggtgagtgcctgagttggggcaaagaaaggttgatagtgcaaccaccatgaaacaacgtaggacatcatcttctgatagtttgttcacacccttgtcactaagcaacttagtgccaaagaaggaaattaagggttttgtgctcccataatgctgatgaaaaaaatgttttcctgcatcattgtcatgcttgatctctaaacctccatttgggataccaagtatgaagttggtggtgtttggattgattggtatggatctcccattgacaactatatctgagcagctgacgtcagtgtgactagctatccatttgacaaaagatagtggtatagcacacctttgaaagtttagaagagaaccaaaagcagaattctcaataattgacctttgctcgttgctgagcccttcaatcaaattggaaaagtatgtgatgtttagtctgcttcttggttttggggactctgcacttccagatttatcttggtcatattcaagttttgtgcaacataaactaattagcatactgggttgtggaaaaaaatgtttaggaaaaaaagacagaaagcgataccttttgtttttgtctccttactggtttgtctgacctacctcttttccttttgatcgatcctgaaaactaacagaggcaaaacaagtataaagttattgatagctgtctgtggtagtagaaaatgatattttggaaaaaaaaggaagaaacatatataccagatctttttttgagatgtatttgtcagaatcgctggtttcttcctcttctgaaatagagttggcataatcggaatctgccaccttgttgtccgacttgctatttgatgaacattcatcatctgatgatgtactgtcacttgccatgctgttaaaaaagaactagagaagtaagtacattaaaaggaaaaaagagggatcttgtcaaatgtcttgatattttcatgtgtaaccaatcaaaaccaaaaaaaaaaaactctcaatgtcctgataggctgctaagccacatgttaaactgtgccaaaaaaaaagaaccagtgccaaattgaaacaaaatgtataattgtgaacccgtttgatacccctcgcacgaaatcttaaaaaaaaagcaaacaagatgcgagtggtatcttggtgctaactcattttaatcagcactgaagaatttttagcaaaaaccaacttgcatgaacttaacatcggcaaaaaaaataataataaatgttttttgaagctctataactgcaaattaatgtgttgaaccaaaatttgattacagttacatatacttgataaaatgtcaactacaacatcttggtattgcaaaaatttgtgttaactattcgcatgattatagttgcacaaaatcataattaaagttgcacgaattactaaccaaaaagttgcacaacattaaaaaatggcaactgtaggaacaggaaggtgcaatttttgcatataaaaaaagtaacaaaactggatggatatgacattattcaaccgcccacatgtcctagcttaccggcaaatcaaaatcttagcagaagaaaatgtattcttcttgccctgcagcaagctcctccccccccccccggtagaatccaacgctccctgaaaacaaaaatcgtagtgagctactacatctgagcatacaatcagtctgaagttgtgcttgtttataaccaaaattaggaaaaaaatcatatagtagtcagctaaaaaagaattagttgcacaatttaataattgaaaattgcatatatttataacataacttgcgcgaaatgtatagtattagtttattttgctatttggactatgctgctgggatgtagatggttcaagcgggaaaaaacagtacatgagaaaaaagaggcacacttgctgtcgtgtgttgatgagaaaaaaaaagatacaacataaaaagtagtatgggttgcaaaaagcaaaaacacatgaaaagttggacaaaattactaagaaaacaagttgtctaccaaaaaaagtccccagttgtatgcatgttttcccaaacacaaacgctatttatcaaagtaaacggaaaatttggctcaaaaaacattagttgcacaaacttattacacgacttgcacggaaaatcaaaatggctactacaatagtcagggagtgcaactagcatagatacataattttcagaaaaagaaacaatgaaaattttaaggccatgtgctgatcgaaagcataggttttagttaaggccatatttaaagcagcaaataagtgaatcattgatacaacataattgtacatagtgtatgaagagatatgctttatactgtcaatttatacagtactatagcaagttatactgtccatttattctctatattttagtttcagattaatcctactgttaacgaccaaatttggtaatatcagcatcggaaaaggagattagatcaaggtggagtcgaaggcggagattgatctgaaacagagcaagaatcggctgaagtccggatcggctacgattaggatcggctgggtctgagtcagactaggtgagccgatgtagccgattctgacagtataatttggtgtatgacattgggttgaattgaggtacttcaagatgattgccgcacatggatagagtcctgagaaggcaattgtatctattaattaggatgttttatgtaacttccttagatatatgtttgggcaaaagtctgccgcaaagtcggctagcccaagcactgttaaagaaaagatccagaagttggggttgactgacgtcaatgaaggaaacgtcgtgcccatcgatccagagaaattcacacctgaacagaagaaggattttgaagcaatgttgtagcatgcccgggatcagttcttgaactcattcatgcagacccgcaagggaacattggttcagaagtataaagtaaaggtagttgctgatgatcttgggaccagttcttccaaaggtgaagacgggaaacaagctccagatggctcggctcaactgagtgacaaaggtgctaccgacggttctctaggaagtcaaggtgacaactctcaagggatccatggagttcaaggcgatggagtgcatagagttcaaggtgatgctgctcaggggttgcaaaggggaaatcttaatcagaatagtgatgttgcacaagattttttcaataatttccaagaccgggtcgactatgctgtgcaccatgctttgatcaatcagtctggggtgttagtcaataccttatcaaacatgatgaagtcaatagccgatggatcaatagctgagcatcaggctgtaggcccagtttatttgcaaggaggtgtctttccaaattatcggctttgatcactgatgcccagccatctattcagccagtttcccccgtcgcaccatcatgtcagccgacagcgccggcatcgacccccttacctactccgtcagcattggcaccaggccagctggtgaaccctcagttgttaatgagagagcagccacagcatagtgggcaggttgtgaatcggccgacgcaagatcaggttgctgccatgtttctgccgcctcaacctgctgttgatccaatacagcagcagccgattcaatagacactcccgattcagcaggttgtacaacagattcaggtggccattgagggaggcaggattaagtttgatgattccaaaaagccgatgagggtcgatgataaccaatttcccgttaacatggtacacaaagctggccgaacagctgatccggggcgcatgaggggttatcaagtaagttcggctagaattataaacaaatgtcaaaggaaatatgacaagcaacaggaaaggcatcatgaagaagataatggtggctttgatcctcattggggctgtgagttcttcaggttctattggaatgaaggtatgaggttaccatctatcgaggattgtcctggatgcagtgatgttgcagggggttcaagccgattgtacgatggaggcagttggccaaaacagacaagagtgcctgttcatcagagattgggcccagtaaaccaacgtggtgattcggaatatgacgaaaataagaagactcaatggtgtcctcctgttatttttacgaagaatcagaaaagaagggttcaaagattgaggagtagggaacgcttccaagaggtcgagcaagaaattaatcatcggctgaagaaaccaaaaccgaggcaggagtggagtgttaagaatcaggctcctgtagccgatgatgttgcagctgatgaggcaaagaggttggcaaaaggaaagagtgttgtgacggcaccagttaacatggtttttaccttgccagccgaattcaggatcggtcaagccgatgtcgacgaggtggaagaggaatcggctaagttggttctatcaccagaacaggcagtgttcgagaaacctgaggggacagagaatcggcatcttaaaccattgtatataaatggctatgtcaatgggaagccgatgtctaaaatgatggttgatggtggggccgcggtgaatttaatgccttttgctacgttcagaaagttgggtagaaatgccgaggatctcatcaagacaaatatggtgctcaaggactttggtggcaatccatcggaaaccaaaggtgttctaaatgtgaagctgacagttggcagtaagactattcctaccacgttttttgtcatcgatgggaagggttcttacagcttgttgcttggaagggattggattcacgccaattggtgtattccttcaactatgcatcaatgcttgattaagtggcaaggcgacaaaatatagatcgtaccaacagacatgtcagttaatgttaccagtgccgatttagctctttgggagatggatggccttgattgtttatctggaaaagtttggaatggagattttctaaaagtgtccgattctgatatacagccagttgaagatggagaacccaagctattattttgagggcgtcgtggagggttcaagtgtctacactaaggatacggtagatgatctcgatgacaagcaaggccaaggttttatgtcgaccaatgatttggaagaaatagatataggtccaggcgatcggccaaggccaacatttattagtaagaatttgtctccagaatttagaaccaagctgatagagctcttaaaagagtttagagattgcttcgcttgggagtattatgagatgcctggactcagccgatcaattgtagaacatcggctacctatcaagccaggggttaggcggcactagcagcctccgaggagatgcaaagccgatatgcttgaacctgtcaaagctgagattaagcgtttatatgatgctggttttattcttccttgccgatatgctaagtgagtttctagcatagttcctgtcatcaagaagaatggcaaggtgagggtatgcattgattttagagatctgaataaagctacaccgaaagatgaatatccaatgccagtagccgatcagctggttgatgctgcgtcagggaacaaaattttgagttttatggatggaaacgcagggtataatcaaatttttattgctgaagaagatatccataagacagcttttagatgtcctggtgcaatcggcttatttgaatgggttgttatgactttcggcttgaagaatgctggagctacatatcaacgggctatgaattatatttatcatgatctaatcggctggctggttgaggtctatattgatgatgtggttgttaaatctaaggaaataaaagaccacatagccgatttaagaaaagttttcgagaggaccaggaaatatggcttgaagatgaatccgacgaagtgtgcttttggtgtatcggctggccagttcttgggatttcttgtccatgagaggggaattgagataactcagagaagtataaatacgatcaaaaagattaagcccctagaaaacaagaccgaattgcaggagatgatcggcaagattaattttgttcgaaggtttatttctaatttgtccgagaaattagaaccttttacaccattgttgagattgaaggccgatcagcagtttacttggagggcagagcagcaaaaggctttggataatattaaaggatacctgagttcccctcctattttgattcctccacagaaagggataccttttagattgtatctgtcggccggtgagaagtcaataggctcaatcctaattcaggagttggatggaaaagaacgagttgtattttatctcagttctcgactcttggatctagagactagatattctcctgtggagaagttatgcttatgtctatatttttcatgcacgaggttaaggcattatttactgtccaatgaatgtactattatatgcaaggccgacgttgttagatacatgttatcggctccaatattgaaaggaagggttggaaagtggatattttccttaactgagtttgatcttcggtatgagtctccgaaggctattaagggacaagctgtagccgattttattgtggaacatcgtgatgattcaatcggctcggttgaaatggtgccatggactttattctttgatggatcggtgtgtactcatggttatggtatcggcctagttataatttcccctaggagggcatgttttgagtttgcttatactattacaccttatgcgactaataatcaagctgagtatgaagcagagcttaaagggttgcaattgctcaaggaagttgaagccgatgctattgaaaacattggggattctttgctggtaatcagtcaattggcaggggagtatgaatgcaagaatgatacgttaatagtttataatgagatgtgccaagaactgatgaaggaatttcggctggttactttaaagcatgtatctcgagaacaaaatatggaagctaatgatttggcccaaggggcatcggggtataagccgatgatcaaagatgttcaggttgaaattgcagcaataacagccgatgattggaggtatgatgtgcgtcaatatttacataatccatctcaatcggcttctaggaaattaagatataaggcgttgaagtacattctattggatgatgagctttattatcagatgattgatggagtgttacttaagtgcttgagtgccgatcaggctaaagttgcaatcggcgaagttcatgaaggaatttgtggcactcaccaatcggcccataagatgaagtggctacttcggcgtgcagggtatttttggccgacaatgctggaggattgcttcagatattataaggggtgtcaagattgtcagaagtttggggcaattcaacgagcgccggcgtcggctatgaatcctattattaaaccgtggccatttagaggttggggaattgatatgatcggtatgataaacccacgatcaagtaaagggcataagtttatattggtggcgactgattatttcaccaagtgggtggaggccattcctttgaagaaagttgattctggggatgcaattcgatttgttcaagaacatataatctaccgatttggtattcctcaaactattacaacaaatcaaggttcaatcttcgtgtccgatgagtttgttcagtttgccgatagcgtgggtatcaaattgttgaattcttcacgatattatgcacaagctaatgggcaggctgaggcatctaacaagagcttgatcaaattaattaagcggaagatttctgattatcctcggcaatggcatacctggttggcggaagcattgtggtcttatcgtatggcttgtcatggatcaattcaagttcctccttataagtttgtttatggacatgaagctgttttgccatgggaagttagaatcggctctagaaggatagagttgcaagacagtttgacagccgatgagtattataaccttatggccgatgaaagggaggacttggttcaatcgcgtttacgagcccttgctaaggttaccaaagataaggaacgagttgctaggcattataacaagaaagtagtgcctaaggatttttcggaaggtgaacttgtatggaggttgattttgccgattggaactcgggataacaagttcggcaagtggtcaccaaattgggaaggaccgtttcaaatctataaggttgtgtctaaagggacatatatgttgcaagggcttgatggtgaggtttatggacgagcgctcaatggcaaatacttaaagaagtattacccaagtgtttgggttgacgcatgatcggctagtgttgctgatgcatgacagccgatgtgttttacatcgtcttgagatggccgatattgttatatcacccttagtcatttttctaattgtaatcggttatggtttgccgatatatataatggccgatattgttatatcgcccttagttgtttttctaattttatcaatgttgttgacattataaaattggggggcacatatatacaaaaaatgaaaaataatgaaaaattagaagttatgttaatcggcacaaaggattgttcaaacagcagggttttaaggtatcttagccgattacaagaatttctaagtcctattacacaaaagttattgagacaagtactgctggatagccgaaatagctctttgcctaatttgttcgacttcttcaatggcttgggcatcctgagcatcagtcctaggaatgatcttcagggacttggttaggtcagcaacattattgatagctgatttgagccttgctttttgctcttcgacagattttgggagatcggctagctttttgtgctccatatccaattcagcattgcattcttcaagctgtgccaagagatcgatcttgcgggcttcaagccggtcgatattggatttgatcggaccttcggatagctgatcgagtttgatttttcttcatgcacaagctgccgattgacttggattgtggcttcaatctctttacgctcacggcgttcggctaatcttagcttggctttttctagtttaaattgatgttgctcaagataagcggctggagttaggacatcggccagttcttcaggaattagagcttgaacttcgtgcaatcgtatcctaatcgatccatagtcgaccactaagctatccagagaagaggcctctagccgacgcgagatatcttcaagtgttctctttgcatcgtcagataagggagctacagctttgcttgaagtatcttattctgcctcatcaagataatctttgatatcaaaagaaaagagatcggctagaacctgcaggtataagttcagaaagtttgagagctaagtcaatatagtcgatctaaattcttgcatcaaaggaaaacttactgggatagcaggagcagccggttgttcttcttccacaatatgatgactccccacggccgatggagttcggtcactcgatgatttttgtacaggagaagaaggagtaggaggaggctataaaaagacaagtgttagacaaaatcggctgaaatcaactagtaaaattgggagtgtcttactggtggagctggtttgagaattggtgctgccgatttcttctttatagcagttttcttcttctgcaactacaaaacctatgagtagtcggctgaaaaataatgattacaaaagggtttgcaaggaaatatgttttactctgaagaagtgagtgggggcagaaggagttgaaggtatctgcttaggcgaagccgatggtgttttttcagtatcacttacttcggctgcagcctgatcaacgtcatcctcaatatcttcttcatccagagcttgttcaatggatggatccaaagcaggcaggtcgtcggttggcttggttttcttagacttggcctttttctttggagctagagtcaaggtgctcacagctgatgatctagtttttcttttcttggttacatcggttggtttcctgatggcgccttggaggagggttgagaccttgggggcgtgatagccgatgacagggggagacaatccgcctccattaggaatcagacctggggcatattcaatgttcctaccactattgctctgatatttaggggaggattctgttgtctaaaaaaaaggaacaaaagattagtcaagtaatgaatcggctaaccgttatgaaatttagtgatggcaaagtttacctggggtatgacgtcagggaatagatctgtcatgtacattgtggccaattgacgaaatagatgcaacttccattcaccctaccatctgtcaaagttcctgctcctgaatccagctaactcaatattgtcgatactgcctaagggaggtccttggaggttaagctgtcgatccatcattagagttgaagaaatttctcctcagcattggatcttgtcagcaaagaataagccgattgggagttggcctaatccaagttgtctagctgaactcatagggtgatagaattcataggagacttggatatttcttccttggtgaataccgacaggtaggatgcatgggctgattgcagctgtaaagacttccttggacgtttgatatctttcatgattgatgtcttcaaatctgaagtctaatgggagttcaaggtctgctgagtcttcataaagaaaccaaactcgggcatctttctggaagccttcataaaagctgcagaaccaatctttgagcagctcagccgatagttttgccccagcattggctagtgtggatgcatattcaacatatgacatgcatctgcgatgggtgcgttcttctccatcgtcttctacaattggcttcaaccttgggaattcagcttctgttacagatggccgattgacaactttcatgactaccaggtttagccaggtctgcagtagccaccatggtccacctgctccaactattgagccgacggctatcttagccgatgcatgcattgttcaacatttggtatagatagccgagaaggattttgcccaagggaaattgtttctttgattctaaggcttcggctacaaattgccaattggttgtgggaccacagctggatccacagaagagaaacttttctagccacattagcaagaaagctacgtgctcccgaggagtgacaggccctttgcccatgtatgccactacataatcagaccaccctcctatgcttttggtcttgaagtcaaattggttcttggtgttcatactcatagggttagccgatgaagttatatccaatccagtaatcatgatgatgtcgatcaaagttggagtcattggcccttggttaaataagaaggcattaatggtgttggaccagaaataggtggcggcagccatcagaggttcatccttagcagaattggctatggtgagagcaagcgcttggccgatcccaatctcatcccaatgggttttcttactagccgatatgcgttggtaccaggtggtccagctcttatcaggggtaggcttttcgagagatggccaagacttgaaggtattcttccagtgacccaagttagggttggctagtctaaaggggattctgttggtttcaccaatgatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaagaaaagggatctagccgatgagaacttacctcagcgtactcggccgatgccgcagtagacaggctagcggaagacgacatcgccacaggcggagatcttatcaaaagcgaaatcgcctggggatcgcttttccgtcagaggaatcaccggagagagaaaggacaaagtttcgcttaggcggtgaaaacggaagtcatagcgtgagattttttgagggcaacggttggtatttaaagtgatagaataacggtcgaaaaatggcagagtgcgaaacttgcacggagtcggtacacgacaaatccgaaacattatcaaatatcccggacttggggggcaagtgttaacgaccaaatttggtaatatcagcatcgaaaaaggagattagatcaaggtggagtcgaaggcggagattgatccgagaacagagcaagaatcggctgaagtccaaaccggctacgattaggatcggctgggtctgagtcggactaggtgagccgatgtagccgattctgacagtataatttggtgtatgacattgggttgaattgaggtgcttcaagatgattgccgcatatggatagagtcctgagaaggcaattgtatctattaattaggatgttttatgtaacttccttagagatatgtttggacaaaagtctgccgcaaagacttatggtatcttagagtttgttagagatagtggtcgtgtccggtatggacagatcttgtaattcttgggtataaatagaccccaagccctatgtaatttttaacacacatgttcaatacaatttcgacgcatcgccacctttttgctttagttttgttttgacgagttcttgctttcgggttgagctgcatcggtttcgatcttcaacaagaggtaaaacttgttatgacgacttgtgttctcgagattagtgcttccatctttatgacactctaatcttgtccatataattcgtcaagttatcatatatcttacataatctttggcaatatcgtcatctaacctacaatcggctaacatctgttaatagaaggcagccgattaggttaaatagcgacgttgtcctagattatataggatatctaccactttatgaaacacccagcggcttgattgtctagatattgttcttcttttcatacttaatgctgcatcagttgagtttgatctattaagtcgtgcttagaatatcaatctctagcctgtcctctggttgctgattagggtagcatcggagtttcagccgatcttatttgatttaaccatattcgatctttgtgcttcaatgacatgttaaatccgccctttatgtcaagatcttattgcatttaagtatattaagcttttgtttggtatattatatttgttttgatatctttatataaagtagtatcggagtattagccgatacatgctagatctatctgatcggctatgctataaacatatataatcctgttattaatatgtatttcgatctaagtgatttatactgtctcggcattgtgaccgatctatcccaatcacttaatttaagtatatattaatataagaactatatattgttaatatctacagccaatcgaatagatttagctccttactatctatttataaccaccgtcgattcatatatgacatcggcccaaagataaatgatatgtcatcggcacctagccgatcggctatcatttatagatttaaccacgaattctttgtctctatttcttgttgattacagcatcaaatcaactggcacgctcatacattcgaaggcgagctttggacctgcactggtgttaagcagatctcccaggcctcgtgttttctatcaacacctactaattccgttaatctcactctcattttgtgtttcccactgtcatttgctgagttgctaatgtaacacaccgatgctttgcgaatttgcgattactctcctctctcaatgctctgctggtaatctcaaaaagattaaacataattggtaggagcagagcctggagttcattttcagggaggcttatctcagattgatcactgatgaaatggaagcaaaagtgtcttagtatgtcacagttgagcaggactaccgttaaaaaaaataatacatagcacacaaaaacaaaagatagctttttttgtatacaagcacaaaaaaatccaagaaaattgtggtctccctgtatagagtgaccactgaaatggactgattaactcaaaccctctgtgcacaaaatggatctgacaatgctgagggacaaaaggtaagagcatttgtagggatttaatgaaaatattggttagttgttgagctcgaattgctaccaaatccctaaacccctttctaaaatgctacggcacagaggtcatcactggcctacaggataaaacgactaaatctagagcaaaaccatgtgtgtgcctaacaaatgaagttagggagaaaaataattagggagaaaaaaccaggcagaggcacagcccacctcccgctgattatatcatacacgatgtgcagtaaaaaccctaaaaaaaattccccaactacaccggacaaaacatcaaagcacacacatcatgtgggtttcagatccagggatgctttgctcaacattggtccccccccccatcccgccctgctactcacgccctgcaccaactacggcgcacacgggttgatctgttgggtcggatcgtgggttttgttggcgacaaaaaaaggcccacggtctccatgtcttttttaatttgaacaagtatatatattggctatatgaaatattttgatttcacatgatgacttaattgttcaaaaatctgagtagtaaaaatatgtgtaaaattatcaagacgctgcaattgcatacaaatctatcgatttcttcatttgcaattatcaaagatattggaaattgttgacctaacttgttctgaattgtgctcccaggtaatcatgaaacatgaaactattgtctaacaaaaaaaatcataataacttcaaatttcaggagacgtgcaggagtctaaagttgccagatggctggagaatggcatggtaaataatccttaacatatgtttgacctccttaacatatgtttcatgaagaaaaaaattctgtaaatgatttaagctaatatctatttgacctcctctagccatagcttggtgttaatgttactactcagatatatagtcttgtttaggttcacaactagtttcaggaaactgggtgttcaggtattaaatgacaaaaaatataatctgttgtgctgaattaaattttcctctagtctcaggagaggcactcgcgtgtgggtttggcaaaaaggaaagctgaaaggagttgatattactcaaggtatttgagaaaaaaactaaacacaattgtacttacatttgactgatgtgaggcatttaatcttgcccctgcatattaactagagtaacagaagtaatatgaattggcacacaaatatattgacctctgaatcttgtacctctgctacgtgaggttttaacaaagtacacagatctgaatctgagaactgtaccttgcagctacaaagcaaactgctacaaaattgctgctagagttcagacaaaattaactattgacaactatctctgtctccaatgacagaactgcttataactatttctaaaaaaaaatgacaaaacctatttctctatacattatgtttcaggttgggagcaaaaactgaagtaagcatgttattcctctaattccagctcgggtggtctgtctgatgagtactccataatgagaatgacccaatggtaagcatgtaaatccagttattcttcacagatggggaaatgatttacattaaaagaaaataattagtgagaaaatgaagttaggagaaaataattagtggcaaggtttagaaccaggcagaggtgcagcccacctcttgcccactatatcatacgcgatgtgcagtaaaaccctaaaaaaaatttccccaactacaacgaacaaaacttcaaagcacacacatcatgtggtttcagatccatgatgctttactcgacattgggcaaaatcaactcaaaaacatatacccagtaaactccaaagcatcaaggaatgaaaaaaactccgcgggattcccccctccctcccccctcccttgaaatggtagccaaccagccctaaacaactcacaaaatccacatgatagaaatctggagctgaggggaacatgccgtcgcggcgtgagatttgaacaaaaaagagcgatgaaaaacctgcagtgcctcaactcaagcgcgctcgccttcgacggcacactcgcggtgccttctccggcaccgtccacggccgctcgcggtgcacaggccacctccccccccccctcgcctccccttccacctcctgccttggaagaatctccggcaccttctgctcacaggactccgcctccctgctcgagaaaacacaaacgctatctactcgaggagcagaagcgctttttagaggagtcacgggtgcgggcggatttttccagagctatttgtgggttgtgggctatgggctgtgggctgcggactctgggcttattagcaagggaaagatgatggcgcgcacaaaatcaagacacataatcgatggtcgatgcgatcgactgatcgattaaaattttgcaggcgactgcaaaatagcaaaagcgttgctaatttgtttaggagtaaattgcgttgacggaaaaaataacttggcaggtgggtgcgattaggtgtaaaaacttgaaaatcgagcgtagcggtacaataacttggctaggtgggtgcgctcatggtgcaaaagttgccacaccattgttccacctcagcgaaagtgccacattagcattgaccatctcattttacagaaaagtccatagtaacttttatattacaatcacttcttcagatgtatctgtttgcccattgtttggtagaaagattggaaagataggccctgccgccggccgccgcagcgtcgacggagcagcccgaggtcaccgagcaggcgacctcgacatcctacaggctcggcaacaccggcggcgccatgaccagtgccgcgtctgctgctggctccttccttccacattcgctgggcgcagatcgagtctccgacagcatcaagtccatgttcccctcctcatccacagccagcggcgccgcctcggccggacacgacgagtataggggatccccgccggacctcctgtcgcgacgacaagcaaccagcaggcgcagtcacgcaggagctatgcctcaatctggtgagcaattttgggactgacgaagtgacatttctctgtgttggctgcctctacaggggtttggatgttctgcaatatatttttttagataatggaatagaatatcccaacctttgctcaacgagctacaaccaattattacaaagtagcacacaaaataaaaagtttctcgcacaaaaaagaagacacttaccaacacaagataagaagtacacaattattaaattctgtttgtgaatctacatccaaaattggtaaacagttgcataaccattgcctcaagattacgacatgcaacttttaaacgctcgccctcttcatcacacttttgtagcagtgcccaagacctgagccagtgtgttgcctcgaaaattacctgcatatatgaaacagatggtgatttgtcaaaaatcatatcattcctactcaaccatagagcccaacatatagaagaagctcctatgagaataagtttcctatttttcttatccacccctagaagccaatcatcaaaaatatgagatatgctattaggagggtaaagaccaaaagagaactgtacagctctccaaataaactttgcaaaatggcattccataaaaagatgctgaatagtttcattcttcatacagaaacaacatctcaaacttccattccagttcctccttgccaaattatctttagttaacactacccctttaagcaagtaccacataaagatcttaatcttgatagtcatgttaagcttccaaagaatcttatttctctcaatataaccattgtttattaaagccagatacattgatcggacagaaaattggccattctgatgatagttccatctaacacaatcactctgttgattcaactgaatatgtacaatagaagcacacaattcatgccactttgctagattctgaccaactaaagccctcctaaaagaaacatttagcgaaacagatctcataacattagcaattgaagaacttttccttcgaacaataacatagagagatggatacctatctttaaacgccaagttacctagccatttatcttcccagaatctgacttgttccccattattcagaatccaggaacccatgtttaagaaagtattcttaactttcataagacctgaccaaaaatgagaatcacctagtttcctatcaacttgggtaatagactgattataaagatactttcttttcaataagtcttgccaaaccccttgctcatttattaatttaaacaaccatttactcaaaaggcatttattttgtatttctaaattatggacacccaaaccaccctgatctttgggttgtcaaaaaatatcccatcttgtaagtctgtactttttcttatgatcatccccttgccaaaagactcttgatctataataatcaattttttgaagaaccccttttggaatctcaaaaaaagatatcataaacatagctaaactagaaagaacagaattaatcaaaaccagtctacccccaacagatatatgttttcccttccaactactaagtttcttctcaattctttgttcaataactttccaatctttgtaactaacctttctaaaatgcattggaataccaagatatctgacaggaaaagtacctaacttacaaccaaagatagtagaatattgttcataaaagtcctttgcctggccaaaacaaaataattcacttttatgaaaatttattttcaagccagacaacttttcaaacacagataaaatcaattttagattcttggcttgttgtaaatcgtgctccaaaaagatgatagtatcatcagcatattgcaaaatagataaaccatcatccaccaaatgtggaattaccccattaatggtaccaacatctttagccctcttaattagtagagctagcatatcagccactatgttaaagagaataggagacaaaggatacccttgcctgaggcctttgtaagtttgaaaattattcccaatttgatcatttactttaataccaacatgaccaccctgaaaaaaagaagctatccattgacaccatttaggagaaaagcccttcattctcaacgtttgttgaacaaaagaccatttaaccttatcataggctttctaaaaatcaatcttaaatattaccccacttttatttttatgatgcatttcataaatagtttcatgaagaataacaaccccttccataatatttatcctaggaataaaagcagtttgagtaggactaattactttttgagcaacgccaattattctatttgtagcaaccttggtaaaaattttaaaactaacattaagtaagcatataggcctatactgttgaattttcatggcctccacacacttaggcaaaagaataatagtaccaaagttaagagagaataaaggcaaagtaccattatgaaaatctttaaaaagatctaacaagtcggctttaataccattccaaaacacttggtaaaactcagctggaaatccatcagcacccggagccttgttgtgttccatttggaaaattgcctctttaatctcattttcggtaaattcttgagttaaagcctcattctctaattgagatacttgagggatatcatcaattttactctcatcaagctgaagatcataatcatctggaggaccaaataaacctttataataagtggtaatatgcgattttaaattcgcatcaccccttattaattgatcaccatcctgtaattgaaaaattcctgtttttctatgcttaccatttgcaaccaaatgaaagtacttagtattagaatcaccctccaagatatctttagtcttagccctttgataccacttaatttcctcttctctcagaagcgtagataatctatttctataatacactctaatatcaatttcctcctgagtcaaaagaatggtttccgcttttttatctagcaaatccaacttatctaataactcttttttctcttttttgtagatgccgcttgtatgtttagcccatcccttcaaatgttgtcttaaacgatgaattttagcctaccaatgctccatgggagtattaccttcatcaacactagaccaaatctcttttaccatatcaacaaaaccatcccgtaatagccaacctaattcaaacttaaaactatgttgagcattacccggagacgaagaatttgtttttaaaagtaaaggagtatgatcagaaatatatgtaactagaagtatatatgcaagtgatgtatagttcctgtaggttcttttgtaagtactctgggagtgaattcattatgtacggaattatgatgaaagtgatctaaagttcctctgtgcttttattaagtactctgtaagtgatttccaaatgcaatcaaaagctgcctcacataatttgtttccaaattggtacgaaaaaaatcagaattgtatgcttctgtctgaatgagacatttggtacactttatgcccaacagcccaagcgataatctgtcataattttgccagcttgtattgaccaccacttgcaatgtagggaatttctatatgcatatatgatgtgggacattttcttgtccataaataaatccaggtagaaattttcatactgaaattcaggaagaaatcaacatgcccataacaaaataaaaggtgcaaaataaacacggttcaagaacagggaaatcagactaatgtagcttatgaaacatgtctatctggttggtatgaaactaaataaaactctctgactgaaacatatgctaatgttttccacataaaattgattactagctgttttcattttttctttgtctccttccttttcttcggttctgcttcattatttggcatcgatttcttattaggtggtgcatttctcttccttggctctgccatcctcttcctaattgttgccctgccctctttggttgcggtcgacattggtggctccactccagcccttctgtttgtggcaataaaatttgattccagcaatggaccaggggcaactctagaagagctgttgtttgtgttctgcacaaagtacttggaattgtggaaaaatgtttcacaaagttacaaaatggagaattgagaaagcattgcctaacctctctaatcaaggaagacaatatggtattgtctaactggttgtagtttggctgactagttagaatactagtctgactattcagaataccaggcatgacctgcaaaggcacaacatcttcttgaacaggctgtagagaaggagcactggcctgctgctttccactttttatatcttccttcctcttcttgcggtcccttcttattgtgattaactccttggcagtagctacagtgtatttgcacaccatgtttcgatatttttgttcctccttcaagctcttgaggctgctttcttctacatctactaggctttcgactttcttttcataaactggtgggttgaccttcactccattcatcttcgcccaagtagttttgtctctaacaggcattatattaaatccatatgcttccataaatttctctgttgagtaacaaaaagacaccacatcttcaggcttgatcctctcactcctcaagcaagaaattgcatggtttcatggtatccctgttagttgccatctcctacattcacaatgttttgctatgatgtcaacaatatattggtgttctttctcagtaacatggaacacccctttaccagcaggcaagacatagcatgtatttgctatttctgcatttttctcaacctttttctttatttttgggcatatatttcccgaccacttctttgcgcactcctcctgcttattatgtatcctattcatgatctggctcctaatcttctcaagcatggacaagattggaagctctctagcttcaagaatatacttgttgaacacctcagaattgttgttcagcaaaatatcacacttgggaaaaccactaaagaatgctctgcaccactgatttggtggtatttcctccaagtatccataagcatcagtactaagatacttcatcttttccatgttggattcccattccggtattgaactggaccttgcaattgcccacaattggttctttagagtctcccctttatgcaaaacatggaagttttggtatagatgcctaacacaaaatctttgttttgaatctggaaatttatccctcacagctggcaccaatccctacaatttaattaaaaataaggtgaattctagtccatcatcaagtttaaaaataaaataaaatatgatgaaatagagatgtaaggaatacattttgcctatctgtcataatagtatacggtgtcgtgttgtcaataaggagatcttctttcaaagtattcaagaaccaaccccaactagctctactctccacttcaacaattgccatggctataggatagatgcaactctccacttcaacaattgccatggctataggatagatgcagtcattggggtcaatgcctactgcagtcaataaatgtcccccaaacttggttttgatgtggcatccatcaagaaaaatgataggtctacaaccacttaagaagcctcttttgcaagcatcaaatgatacattgcatgtatggaagcacatattctgtagattcaagaaaaatttgctacctgaattagatgtcctaagctcttgtccataatcccataacatatcatactgagctatttcatcaccgtgtatagcctccatagctaaccttctcgctcgtcctagtttgtatcttgatggtgttacatttaggtctttttgaactactttagcaaaactcttgagtgtcatcttatcattatctctaaagctttcaatgtacctatttgcaagatatctagcagttacataattcagctcccactctttttgacatttgtgaccatccacatattgttttatcataaaacattttgtcctgctgtcctcagaggcatttaacatccatgggcattcttcagcacatttggcctctattcgtttcttggtgtttcttgcaaatttgattgcaactctatttttcacactatattgttttattgcccgcctaacttcaatagcatcattaaacaacatcccaaccttaaagataggtgactccatgtccacatcagccacaaagttcttaaatttcaacttgatgccccatcatcttcatcagatgactctggtagcaacaaaccttcatcatctggatcacatccaggaagctcaactactagcttgctagcctcagcattttcggtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtatgtacaaaagcaatgatctgaaccttggtactaatgcaaccatgctgttagtgcttgcatcagaatttattctccttagcccatcactaaatgttttcccaggcaataaccaataaaccttaaccttcctctcagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatacaaaataattggtgatgtgttatacccgcataaggaaaataatacactaagattatttgcagattattgaactaattatattatgctcataagggtacaaaatacatatagcaagaatttatcattgccaatgttactcttatatcgtatacagctacaggaaacaccaataattacagtacaaccaatctcgtggctagtaccattatatcacttcattgcattgtaataatgttgggatacgcgtaggctacgatagcataaaacaaaattttctatcgcgtaaaccaggaaccatgcaagtattagatcatagatcgttaccactcgacgcgctgcacagcggaagaagacgctgagaagtcgaaggaactctcgcgaagtagcgcacgtcgatgtagaggaagtagtcgatcgcaccggctcgaccttctcctcctcgtgcgttctcctcaccgtactcccacgccgatcagcaccgcaaaccagcggcgcctctaccggtatccacacgtacagggacggaacaccacgcgcagatgtgcaagcacccgcgcgcggctagggttttgctcgggaggaagtgatggctaggatttctcacgtgatgcaatgcctccgccggtcacacccctcacgaatatataggatccatcactcgggcctccaaggcccgtaggattcctatttggatccctatccgaattaagctcatattggatctccatccaatcctcttattccggcccattaagtgtgcgaccctgtaggttcatatatactcggctgtaacccgaaaactccttttcggtccacgcgtcaacagcggccccttgcagaacgtattgacccaccgggcatacataaagatcatatcggctgaacctctagtgtatacttgtaagaacccctttgccccacgatatcgattaagctcaaggctagatatgtgccatcctctaatagctcaatcattcactcgaacctgttgatagattatataacttgtgattgactcctcaatcacctttggcatggccatgcacttccataatctacaacatcgaggggctcagagatatctctccataggaggggcaaatcccatcttgattattcatatcccactacatatttcatagcataaccgaaaactacttttataactacccaattacagagtagcgtttagcagtccctaaataagttactacacatgttaggaaccatgataatctcaggtctaaggatttaacaccaacactaaatgagatcactgatgacacaacacatatggctcttgcagtgtctcatgttgggtctatccaacaacatgttcactaagatgtgtccacattattaatttggtatctctatatcatgatccatgagacatgatcatcaattaatacatgtgctgatcatctaaacatatttgttccacatatgatatttgatcagggatcctttagaaatagcaacaaacaacataaagagtctcatgaaagaatcacatattcattaaccaataaggagttatctatttcaaggaacaatgtcggacaaatatgtaaacatagtatgtgatacaatcatctctatgattgcctttagggtatatcactaacaaataacaaataacaggatattcaagtgaaagaccaaaataatgcagccatcgtacaaatcaatgagaccttaactttgcaatcatccatcaattgaacaaaaaatagaaatctacaaccatcagcaagtgatttaccataacaaggagcagaagctcaaagaactcgccgagtcagagccatcccaaagattgcggcaatcacgtcgacagcagtagtttgtggacttgaattggtttggttatggtttagggcttgaattagtgtggcacacagagccctcgtcgccgccgcgacgtagttgcacggtttccctcgtcgttgtcgccgccgccgccgttgcgtcgccaccagcacaaccacctctcaatcaggatcacttaagaaagatgaagggagatatttgtacgtcaagaaatcatattatggggttttctataaaatgagataggtctttcgtgtcaatgctaatgtggcactttcgctgaggtggaacaatggcgtggcaacttttgcaccatgagcgcacccacctatccaagttattgtaccgctacgctcggttttcaagtttttgcacctaatcgcacccacctgccaagttattgtaccatcaacgcaatttactctttgtctagactagtaaaaaagttgttacggaacttagaaaatcacattggcacttggcaaaaaaaataattagggaatttagagcttaattttaaattaaattatattttttatcattttatatttgacgtaaaatatttcaatattgcatcattactgcgtaataactctatcctttaaaaaatagaacggctcgaaaacggtaccccgttcagacggatactttaagtaatggcgtcatattcatgtcaaaactgacgtcactctatacttatgtggtatcatgtatgatatttattggtaccgaacatgatacccgactaccaggtgtgacacactatatctaccacatcaatgatgatgtcaatgttatggggatgctatacaatggaatcctgtttgaacgggattataccggttaggtatcaggacatgatacttctgaggtatcatgtgtcctgatatctaaccggtatcaggtgatacctattagatatcaggcgatttctactacatatcaaatgatacttgtgaggtatcaaacgattcctataaggtactatgtgatacttacaagatatcatgtgatacttataggtattggctgattcccgctgataccatcggatactcatcaatagtagagcgatacctaccagatatcaggtgatttctactaggtaggcatcatcgtcagtggccgtgtcctccgcgtttgagcatgtccttcaccgtcactccacatgctggagctcggtggtggcggccctacatcccatgaccgagatcatcaccggtgcagccacatcctccgccatccacattccacgccagagctcgtcaccagcagccgcgtcctcctccaccacgctccatgccaggctcgtcgccggtggccgcgtcctccgctgtccatgccccacgccggagctcgtcgctgaggctgcatcctccgccgtacacaccccacatcatcgagtgttcgcatcagcacggtcataggcggtagcgacgagcaagccacaaccgcgaccatgaagccatcatcatatcgtcttgtcaccgactcgccatgcgcatactcattctcttgccgtctcgccccgctgggcatcgtcgacgctcttcatcgtcttgccggagcagagcagcagcaacaacaggagtcatgcatcatcaacagctctcaccgaagcaaagcaacaacaggaggcacagcatcagcagtggcgcacgcggaggagaagacatggctcaaggagatggtgcgggaggaggcgataccatcccactcgctcgagacggtatcccgtggtataacatacaagtatgtcacatcatcacccacaagcaattactattgtatagtatattaaatctcatacaaacataacacatatctagaatacctcgtggtatctaaatttttcactaaacattatgatatctaccaaatttcacagtaaaaaatgtagtatttttgggtaatttcttaatgatgataaaattgcttatgctataagttttgtagcaacaaaattataaccatatgaaagtaaaatgtcaattcaatgatattattttcagcaaacaaaattcaattcatattatgatagttgttggttaaatattttaaaaagttgagacttaaaatgtgtgtgtgctttatatgattgggtgtagggagtagctatttgtattctgcctttgttgcaacgctagttgcctgttaaatgaggctggctcggtcggatgtgctactataataataataaattaactagaataataatgttcatagattgcacatataaatggtataataatttcggattttcccaaaaaaatttatttgaaacacaaacaatctatcccaatataacgataacatatcggttttgaatttgaagtactaactccagccgttcactaaaattgttcatacaatacaatatgtattcgcctcttctatttagttgccgattgacatttccccgaatctgaaattttggaatgccatattagccccttgtgatcgaaataacaaccttttctacctagtctcgtatataaatccttgctcccccattgcatgtctcgagacgtttttgctgcatgcattagttcgatttttcttttgcgtcaatttgggcaaagaagatgatgttaaccaataaaatttggggaagtcgttgatatatgactctaccggtaagagttcaattcttggcgaagtcgttgttatatgactctaccaataataatttaaattttgatacgtacatataaaggacgtaactacacagctaccactaagtttgtctaaaccagctaccactctatctatagagacaccatccacatgtacttcaaatacaattttctcttaaactactcatccgatctacgatccgactacaccgttgtgtttgtaacaattaaatctttacaacaagatcttacatgattatattttgatgaaaaatcataaattacttttataatatgtctaaattacttttagattttactaagttacttcttagatatataaaagtaaattcagtaaagcctaaaagtaatttacatatattatataagtaacttagaacaaaacgaaggtaactttgccatgtcatttaaagtaaatctgttggagagataaaaacatgactctatctagaaattgaattaatcagcacaaattatggaattaactaaaaacaataataaaagtaatcacctcagagcattatgaatatataggaagtattttaatcaaaagtaacctatatatatgataattatatatatgataatttgttcaatgaaaaaaggaattaattaaagttactttctttttgttataagttagttctataatatatgtaaattacgtttaggctttactgaatttacttttatatttctaagaagtaacttagtgaaatctaaatgtaatttagacaaatcataaaattaatttgtgatttttcatcaaaatataatcatgtgagatcttgttgtaaagattttaattattacgaacataatggtgtaatcggatgagtaatttaagagaaaattttatttgaagcttagatgataggaatattttctcaacttacttcatggattagtgctatagtaaagtaagattcttcaagttagcacatatctaaataggggtcactcgttatgactaaatcgagagtgctctcgatttagattttgcgacataaaaatattactccgtacgtgaatttgccatttagtaactaataacaacaattgggctgggccatcttgggccagagggaaaggccgagaggtagaccaaagcccatcaatcatagaggaggccacaaaaacatagccatgagatcgaatggtgtcacgcatggtgtacgtaaccctaagcgccggcgcggtcgcggacaatgtcgcggccgatccttcgccggcctgcgcagccctctcctctcccatctccggcgccccgtccgccgccacgacgccaccgacgtcccagcatttcttcgtccccgccacctgatcataggcccacgatcaggcaactcctcggatgccacaaacggcgccgccggcgagatcgcggcgaagaagcacctgtacctggcgatcgatgaccggaagaacgcgtacaacaggacatctctacgacggcggcgacgccgtcgacccatggtgttggcggagctcagagccgaacacgcagatgtcatggagtcccgtgcgagaaaagcacgccgtacgtgcaccccgggggacgcgcctagcttcttcctctccgcgatgaaccagtttcggtcgggcggcgtcgacgtcgaggtcaccttcttctacagcaaggacagcgacgtctgctggacgcgccgcggcgactggctgctgccgttcagaggccacggccactacgacggcgagctcggctcgtgggtcggcctccacactactccgacaccaacaggctacgcaccgacgggcgcctctgcgcctgccacgtcgtgtccgcctccgccgaagcgagcggcgagccggcgccagaggtgaaggtcgggaaggataaggtgttcgtccaggtccctgcaggctgggtgcacgaagaggccgagctcgtgtacatgggtaagcgagtactgcctcgttgcgtggctgcgccccgagggcgacgacgaggaaaagtgcctgtgcgacggggacaagtgcgtgctccacctgaccagggttaaacatatcggtttagccgatttgatcggtgctcacaaaaatgctgaaatttaaaacaaaatttagttgaatttgaaataatattaccaaaattcaaacaaaaaaaatatggccaaaataatatcgtaacggagggatccgaaatgaccgaaatttctaaaattttgttctggaatttgcaatcctacgcctgaccacgttgcaggtggcgtacgacggcgacggcgagctcaccgccactgatcgccggctcgctggctgctacaaattctccaagtatgagatgaactcccatacgagcgttctggatataacggacagctacgagcctacgacagttcactaaagaatttagtagctcatggtgaatctgagggttcaaaattccgaaacgaaatttcggtctattggatccctgatatgatattataatggacaaaaaaatattttttttaatttggcgatatttattcaaatttaactaatttttttataaaaaatcaaacaatttctgatcaaaatttttgaaatttcacgatatcggcacccacaatacatatgccgaaaaccagagattgaaccctaatggccatacgtgtatgccttatttgaagagtcattttagtgtcaattaatttgtagcagtgatccagtcaaaaggaacaaaaatttgcatagaaaaacaccattatggatccttattcctcagatcaaaattgctctcaggggcccaccattttagcaccctgctgcctgctggacctaggccacccaggctaatgttgcttgagttgcttgcttcctcgttagcttccctggagtttgtgtttttcctcagtagctctcttcgtcttcgcacgcagccacgcaccgtgtgtattcgttcctctttttttttttagccggcagctggctggttgtaaactagtactccctctgtttcaaaatgtttgacaccgttgactttttagcacatatttgaccattcgtcttgttaaaaaaaatggtacatgaaagtatatatttaacaatgaatcaaatgatatgaaaagaataaataattacttaaattttttgaataagacgaatcgtcaaacacgtactaaaaagttaacggtgtcaaacattttgaaacagagggagtatttgcttccttctaatatgtcgacacgcaagctttttgcacgttaaaaaaatcaaagttactctagaacaattaatttatatttcatcatttgttactaatatttattgacaaaacaatgagtgccagcctcctaccatttaggtgattcctaaacgcattctacagctctttccggctcctctccactgaattgccccctattgtccttctaggttcccacatgcctctctttcatcgaatggcatagccaggaatatagaggccctagcaatagatgggtgcatatgtctctcctttgtttagtggcaaagcctacgcatagagcccccgactagagagggacacctagagagggagtactccttccgtcccaaatataacaaattttggtcggatgtgacatattctagtattacaaatctagacatgacgcatatccagattcgtagtactaggaattgttacctccaatcaaaatcccttatattttagaacggggaaagtataacggaaggtgatacctgctcatatatgttagtgcctcaaagacaccttatcattatgacaaaggacgtgctcctacaagcacaaccaaaacccataaaagctagccgccaaaagcgaattcctattggttatcaatacttttcactgcaattgtaatgcataaccatttgggtggccaaattctttaaacgaatgaaggaaattttataaattttaggctcctaaaataactttgagcgtaccgtggccatggcactaaagttaaaagtaagttgtagatgtgaaataaaatcttaattataaagatttgatttgaaggataaaagtaaaccataaatagacaaagaatcccccggagatcaaaatacatagaagaactgatctccaaaaataagaaaattgagattatgccaacgtaaaaaataggctttgccaaaatgccatcctgcaaataggattggataaaatgttgtgaacagggtgatttcaccaccattccaccatttcatacaaattaataaaatgattttgctttttttttacatgagaactgacaaaagtgcccctctctccctatctattgtttactctcattgtggccgagaaataagctagactattgacgccacgtagcagcgccaatgctgagtcgccgccaccactcagcaactagctcgtgcagaatgtagacgagcacatcatcctgcagtaggttgagcttgtcaatccgtcactcctcggcttcttccatatgaggcttaaaatcatcagatgacaagtctgataaggagctagggttagggtttgcgactacaaattaagtagtgtcagcattaaggttgttggggttaccggtacggtggtggtgaagctgaaggagaatgtgatcaacggtcacgtccgatgagcttgttggtacaaggcagaggtacgcggttcctagcttcactacgtacaaggtcttgcggtctcagttgatgtcattgcgtcacaaacctagaaaatgatctgcttggaggtcccataaaaaaattgaccatgatgaaggggcaataggaatgggacggcccacgtttatgtggcatcctcacaagatttccacatgttttgaccttgatgacaatgatataagcccatggcgagctcatgcctccctcccgaagctcatactcaagctctgccggggagcttagacctagttgaaaaaccattttaattggaaagaaatggctttctagcgtagatgtctagccgtttaggttgttaatactaacattttatccaactctatttatggaatgatatttacgtgaaactcaatttttctaggcaaaatttgccacagggcatccaaaaaaccctgtaattagctggtggacaccacaaaaacacgaaattgctgtcgggcaaaaaaaactggtaattagctctcggacacttatggccttattttattattttcggggaaaacggagagagaaactgaggtgagagtacgattctgcccctgtgctacttcgctgaagctggtcgtcacaatccatcgccgccctcaccgaagctggtcggcagtccctccgtggcggcggaggtggcagcaccgaggccgtgagcgcgaggatggtgtggcggtgagcggcgccgcgggtgggaaggccttggtggcggcgcaccggaaggcctgcggagctcgtcggcgaggtgcggcatctccctctctttctccagctcctcctgcgcccctctgggcctcccgcctcacctcctcctcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgcctcctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagttttttttcgtgcctgacagcaaattcgtgtttttccggtgtccactagctaattacaagttttttttggatgccccgtagcaaattttgccattttttatgtggcgtaattctaaataggattatcttaaaaaaactgctgcaagtttttttaaggaaaaaccttttcaatctaactatagtattatagtataattgtaatataattccactataattgtaatatgacttatatataagtgttataataatatatacaactttatatctaacttatataaagataacaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatggagatggccgcccccgtctcccccgcgccgcgcaccgtcgaggacatcttcaaggacttctccggccgccgcgccggcctcgtccgcgccctcaccgtcggtaagtaataacgacgaacacctcgcccgcctctctctctatctctcttcggttgtctcctcttctggatctaacgagctcgccgcccgtgcggggggtttttgtttgtgccgcgcagatgtggatgagttctacggattctgcgacccaggtaagaccgaaccggatcggatctgatgagggtagagagagttcgggtggtggttttgtgtgtggggtttgatttggggttttggggatgtgagcagagaaggagaatttgtgcctgtacgggcacccgaacgggcggtgggaggtggcgctgccggcggaggaggtgccgccggagctgccggagccggcgctcgggatcaacttcgccagggacgggatgcaccgccgcgactggctctcgctcgtcgccgtccactccgactcgtggctgctctccgtcgccttcttcttcggcgcgcgcctcaacggcaacgagaggtaccagccacacgcttttcctccattagatctcgtgaaaattgaccatctatgaagaagaaaagatcacttacttggagcgtataattcgatgggtgcaagtgcaatcgaactctgttcttgccttgtgggttgtgggtgcagtgtaatgccgttcttgtgcttgccccgtgggggtttatggatttgcatattttatttcagctcaactggtccatgtgtgcgcttgtgctgtgttgcacatgtttattgtgctttatttcaccattcttttttctctttgctgtgaatgggggccatgtttctcactgtgtttgctttattttctctctttcttttcttcgtttgctgaattgattttattttttgccataaaattgcaaaacagtgctgtgtgtacttggtgatgattattactcctaccagtagtaattgcctttgaaataagttcccgggctgtctgaaaatttgatctttcacttggaacatgttttgacagatttcttttcagttttcacatccttgtcagaagttggggggctgacggtgataggctctgtgtacttcacagtacattgaaactttgaaaggtctcagtgtctgcacaaatttttgtttcgtgttacaattcgagtgttgtgctatatggatgacctttcatcataatgctttttagtcatttgggttttggataccttaattcatgtttttcaagagtacctattttatggaccatggcagtaaaagtgttcgcaaattaggatacaactaataaacaatcaaatgggcaagtaccattcttattcaacttaacatgccataaattgaattctttctttctattgagcttcagttgtgtttgctctgttccttcgttcttccttaagaaactttgggattacaatttgctttgtgtccttaattttcaagttctgcaaatactcgttgaatatttttctcgctacattttaattcctaaaatgcaatgtgtcatatggagtcttttgatggataaccaaagggtagatgaagttttatgtgcctaaattattagtactgttaggttgaatcattaattggcctctggtccttttttaatgttttatgcaggaagttttgtgttttttgctttggtctacttgagtacttgactgccatgcaaaccataagtcgtaattctgtgatattgcaatttttttcttagcaaaagttatcttgtttattctgtttttcagtttgattttttttttggttcagttaatcttgctagtttcctggttgaactttgcatttctattccagccatttttctcttctcttttctccctgagatgaggctttgacgctttgtgagcttaagtttctatcattttggcatagtaattctgcctgctttcattgtactctagtatctattttcctgcacactttccacttctatttgaatttatttttcttctgtttcatcttactatctgttactgtatcagggcagtagagtgctaaactgtgaagtgctgccatctgttctttcatgtgcttcgtttgtgttgcacaaggagctaaatcagtcacaaaatttgtattatcattatgtaatgggaagcattatctgttccttatctgtttgtttatgttgctttcatgtttgtttatagtgtttcgttgcttatctgttgtctttcgaaggattcatattgtacgctggattattttttaactcccaaggaaatattgggtcatgcctcacaagtgttttctttctttatgtacaaattctattttatttgttgcattacttcatggatatcttgtttccatatttttgtctatcctgcccagggctaacctgttgaaacataaaacttgtgccatgtgtattggtgtcttggattcatattctgatttgaacatccctttgcatcaaccattatctctgttaagaacccaaagtatcatatcatggttaacaaaatccttttcctggatccaatgtgttgctctcttgattgtcaggaagcgcttattcagcttgatcaatgaccatccaaccgtgcttgaagcactgtctgataggaagcatggaagggataataaatctggtgccgacaatggcagcaaatccaggcactcaggaaaggtgccgtaccagtgctcttagtttttattttcatcatgaaccatttctgaactgtgcccatttgagtttttacgaactgaaagctggctttgttatgcagcgagcaaatgacgtgcagacaaaaacctcgaggccagcagttgttgacgatgggtacgatgaagaagaacacagtgaaaccctatgtggaacctgcggtggccgctacaacgccaacgagttttggattgggtgcgacatttgcgagcggtggttccacggcaaatgcgttaggataacaccagcgaaagcggaacacataaagcactacaagtgccctgattgcagcagctccaagaagagtaggcaataaaaaccatggagctgctgctgtggctctctactgctgactaagctgatcaatcaaatgatacttgccatccctcttccagtcccaagttggcggcagatgtgaagaatttgctctagaacattgcgcactgttgtggtagatgctggaaaacaaaaaagaagaaactttacaggatagtttgtttcataaactggtcggttactgttgtggttgttcatttgagatatggatactgttacattgtagcctttagaggaaatttgttcatgccttgtttctaatttggtatgtccttcccttgctgcatgacattgatttctctctacaagtttctgtctgtcactgtgcatatatactgtggtttgtctcggtgtgtactgtggaacagtcctgtctgctgggatatttggtccttggttcgtctactctgtggtgcatcagggagggattcagggtttctagtttttggagggaatctgcaggcagggatatgctcgttttcagagcagaagcaattatcaagatcacgggaatgctattcccaatctgatactccctcctgataatctcataataagttcacttttagcttttccatttgttataagttcatttttagagcaatattatatcggagtttatgaacgttgggaatataattgtattgaaatataattgtatcgagagtagttaaattgaagaatagttacattagcatttgataaagtaggggtatagtctttttagttttgtattatatattagtattagtatgtgtgggatggatgaaaaatgaatgggagtgcctagcaatcattcgaatgattttttcattcatctcactcggatttttcaacatatggatgtgcgccacgttgcagagggaaacaggctagcttaatagtaagttcgtaacaacagacccaatatgacagttataagtccaaagatgtttaataaaaaaaaataaaaatgtcatcaacatatgcatcagcaagcgtcaagcgaatacatataatctttcccaaaaaaatgtttttggtttcctaaactgaaaatatgaagcaaagtaactgaacgtataatctttcccaaaaatttgttttggttttctaaactgaaaatatgaagcaaaataacttattaaaagcctaaattttatcctcaaaaattaaaagtggaccattatgttaaactaccaacatgatttccgttttcctccgtcagcgcactacctcctagcactccccctaagggcatctacaatcactaactgagggtactctaggtgtactcacatctacaatgcaggccatgtctggtagcccaatgagtgtcccaacccaaaatagcccatttctctcatcctcctctctttcctattctacccctctcttccctctctctctctccctccgcacgaccgcatgcgcattcctctctccctccacccgttgttccactcacagcctgcttccctctctcccgccgctgctcccgccgccgcctgccacctccgctcgtctccctctccctttctctctctctctctctctcactaccaccaccgtctcccgccgccgcccccgaatcgagctcatgggacggaggcggcagtcatcatcgtcatcgtctggtagctggagcagcagatccggggcggaggcgaccgacggcgagcggcgcacggggcggaggtggcagtcgtcatcgtccggtggccggaggcggcagatctggccgctctctccctctctctctctcccgtggaaggtggcggcggcgaccccggaggcggcagatccggcgccgccgtggccggatctggccccccggcggatggagtggcgccggccgcgccgcatcgagacggtggtggtgccggtggtggccgcatcgacgatggcaccgtcattcttcaccggactcgccgacgcccgccccctcctcacccttcctttttctctctgacagcgagcagccgcatcgagcagacggtggtggcatcagcggtggctgcatcgatgatggcgccgtcggctttttcaccgcgctcgcccacctcgctcctcgccctccctttttctttccggcggcaagcggcacctttcgctcgcccttgacgcgcgggccggtgacataggggagaagggtggaagaggaaatcaaagctctggggtgcgtcgcctcaagaacctacctacgcaatgggtttcttcgccccgtccccctggaaaaagcgagcgagcgacgcgtcccccagctagggcgcgcgtttcatcccaggggacgacgcagacgaaaagcctaatggacagcgctagggagacggaccgaagcactacattggtgattgcctaaagccgcgccgatctcccacgtgcgggaaaagcgctcccccctaaagccatgccgttcgcccacacgtgggaaggagaggaggaagtacaaggtgggagcgacgatattgggagtgggcaagggcgccgttttctctgacatatcaacataactccaaaaatcatgtaggggagtaggggatctgttggagtgctttttttttcactaaaatacctgaaaattggttttggagatgaaataggaggaccattagtgatgctgtaagaactttaaaaaaattacgatggtcaaggaaaatatagtttatcttaaatatagtttatcttatggcaataaaatatttaaattaagttgagttgtctctacgtatagcttaaaatgatactccctccattcttaaatatttgacgtcgttgacttttttaaacatgtttgaccgttcatcttattcaaaaaaacttatgtgaatattattcaaaaacttgagtagtagtagtataatatttaacaatgaatcaaatgataggaaaagaattagtaattacttaattcttttgataagacgaacggtcaaacatgtttaaaaaagtcaactgcgtcaaatatctagagacggaatgtgtacataggaatagtatttttgcatatcccaccaaaataaaatgaccaaatgacccaatttgtcgggggtacctttagcgcatgttgctagattgtgcaaatttatcccctttttttcaaataatgaaataatggattaattcgtacgctccctgaatttataaacagtgtttaaaaaactttctatacattaatttctaagaatattgttttaaatctattttctatcttcataacgtttaattcatttatatcctcaaataattataataaatcattcgactattcggtcattcagcataaaagaatagagccgtggacatgcgaacccacatgctgacatgcatgaacaataatctttcatcaatttgtgttatttgcgaaatcaattaaattttatccataagatgactagtggcagctgtagatacgtggtatggtctactctcttgcagattgcgaatagtttatcattaggtattaagcttaataaagggctgtttagattatagccaaaataaagtttaccaaattttgtcattaccaaaagtttgataatattactaagttttggcaggatttcttacgtgtttaccaaagtttggtaaaaaaaataaatagttgcatatttttggtaactttattacaaattgatatagttaatctgaacaacctctaagtcaatgcttgcttcacgtgttttacctgcaagttcacacacacacacaaaatgcatatttgtatctcaagttcagtaggcatgcaagtcaaaactgaatccctccatggtttaaactttaaaatggcatttataattttactgctgtaggttggcatttgttatttgcaatcgctttcatacggtcagagatgcttgtcatattctaccctttggcctccatctgtttctcgttttgctttcgttacggataatatgggaatattttagaggacaaagtggccatccggtgagccaagtttcataattgtttaacccgttttatggtgtggagtgtacccttagcattgcgacatgaatggctgaaaaatcatagttagatttttctaaaatgcagtttagtcatattttaagcaaacagccaacagaaaagacatgtgaaaatggaaattttaatatccactcttcgaaaaataacatgtaaatagcatgggggttgagctgtcaacagcagagagagcactcccctgttacacccataaaaaattctatgaaaaaaagtaaatattattgttacatccgtcccataataattataactgtaagattcaaattaattctaaaatagttattacaatagagtagtaattatcccatcaatcactctcattcaaaattttcactattttaccatcattcatcctcccagtcctacctatatatattattaaaccttaatatatattaaacaacctagaattaaaattattttgggatggagataatattatacgcgtgtaaaacctcaaatttaaatttaacaattttaagagtataaatctatcataattttatcttttttctttctattacgataaatttcaagatgagacttagatgcatgttacttgtaaaaacaaatataatttttattgatatctgttaattggtgtaaagtttgtgcattcatgatacattccaattttgtaaaagcttactattttactcatgaactttaagcagcatatatgaagggtgtgtttagttcacgttaaaattagaagtttggttgaaattggaacaatgtgacagaaaagttaaaagtttgtgtgtttaggaaagttttgatgtgataaaaaagttggaagtttgttgaaaaaagtttggaactaaactcagccgaattttagggaacatttggtttggtatgaactttggaattcatgatccgacccgtttgttgccaattcaggtgaccaaatttcagtacgccaaccatttgcagttgtttttgacgaacctaacttcaaacaaatgcaatttggagcaacaatactattattatagccactatcagagcaaaaacaactactaccttagatgaggaattaataaataatccaaactggtcccctactgctaggttgctgattaagatgagtgattaagcatcaattaaatcaagacgactagctccccactcactgccaggtgggcccaccttgtcggattagaggaaagtccctcactgccatacacaaccattgccggattagctgtccatcgattacaaaaatcccaaatcttttggcgccgccgtcgctgtcgccgacgacaccaccgccgccgccgtcctcgtcatctccagatcgccctctccttgatccccacttgcatcgccccggaggcgcggtggacgagacgacggcgatggccggaaaggatgaggcggaagggctcgaggcgaggctgctgctgctgccgcctgaggcggcggcggaggagccgacgaggtgtggcggcggcgacggcggcggcggcgggaggaagcggaagaagacgtaccttgatgtccttggcgtgtgctgctccgcggaggtcgcgctggtggagcggctgctcgcgccgctcgacggcgtccgcgtggtgtccgtcgtcgtggcgtcccgcaccgtcgtcgtcgagcacgaccccgccgccgccccggagtccgccatcggtaagccaccgcgcgcgcgcgcgccattaatcctccacgcgattctcgcgcgagattctcactgaatcgagtcgtcgtcgtcgtctttgtcttggagtgcagtgaaggcgctgaacaaggccggcctcgaggcgtcggtgcgagcctacggcagcagcggcgtggtcagccggtggccgagcccgtacatcgtcgcctccggcgtcctcctcacggcgtccttcttcgagtggctcttccctcccctgcagtgcctggccgtggcggccgtcgtcgccggcgcgccgccgatggtgcgccgtgggttcgccgcggcgagccggctgtcgctcgacatcaacgtcctcatgctcatcgccgtcgccggcgcgctctgcctcggcgactacacggaggccggcgccatcgtcttcctcttcaccaccgcagaatggctcgagacgctggcctgcacaaaggtaggagtacatgtcaatgtcctcttcaccaaatccatggcgatcttggcacgaacccggacgaacactcacgttgcgaggtgtgcaggcgagcgccgggatgtcgtcgttgatgggcatgctgccggtgaaggcggtcatcgcgacgacgggcgaggttgtcagcgtgcgcgacgtccgcgtgggcgacgtcgtcgcggtcagggccggcgagatcgtccccgtcgacggcgtggtggtcgacggccagagcgaggtcgacgagaggagcctcaccggcgagtccttcccggtgccgaagcagccgcactccgaggtctgggccggcacaatgaactttgacggtaaacaaacaaacaatcaaaaaaatctctcatctcttagtttcagagttcccaaatgtacggaactctgaaacgtccgtgtcgttgaattgtccgtcttttctcatcagcttaagttctggtaaactgattgacgcatccaactcaatagtcacaatagcacacatttgttcatgtcatgatcaatgggattgagaggctgtcacgtttcaggttacattgctgtgagaactacggctctcgccgagaactcgacggtggcgaaaatggagaggctggtggaggcggcgcaaaacagcaggtcgaagacgcagcggctgatcgattcgtgcgcaaagtactacacgccgggtgcgcaatcggcatcgcctaaactctcaacatctccaattttacaacacaaaattcatcagtaacaaagacatttctgttcttggtgcgttgcagccgtggtggttgttgcagcaggagtggccctgatcccggctctgctcggagcagatggccttgagcaatggtggaagctggctctggtgatgcttgtgagcgcgtgcccctgcgcattagtgctgtcgacaccggtggcatccttctgcgcaatgctgcgcgctgcgaggatggggatcttcatcaagggtggagatgttcttgaatcacttggggagatcagggccgtcgcgttcgacaagaccgggacgatcaccagaggagagttcagcatcgactcgttccatctggttggggatcacaaggttgagatggatcatcttctttactggtaagactgagaaagaagatttcatttcagctcttggaatgcagctgctacactgaacaaatttgacagattttcaactgttgtcggtttacgacttgtcgaaaaatccttagtacttgtgatggtttgaattgacttgaacagtgaaatgcttggcacaaattatgtctttggttattgcaggattgcaagcattgagagcaagtcaagccacccaatggcagctgcacttgtggagtatgctcaatccaaatccatccaaccaaacccggaaaatgtgggcgattttcggatatatcccggggaggggatctatggagagatccatggaaagcacatctacattgggaacagaaggacattggcaagagcgtcatcacctcagtcaagtgagcaaaacacatcatttgtagtagtagtacagttcctgacaattaagcttcagaattagctgatcagctgaagctgagctgactgaactgaaatctgtgacgtttacagctcaagaaatgggtgagatgatcaagggcgtgtcgatcggctacgtgatctgcgacggcgagctcgccggcgtcttctcgctctccgacgactgccggaccggcgcggcggaggcgatccgggagcttggatcgctgggcatcaagtcggttatgctgaccggggacagcagcgcggcggcgacgcacgcgcagggccagctcggcggcgtcatggaggagctccactccgagctcctcccggaggacaaggtccggctcgtcagcggcctcaaggcgaggttcggcccgacgatgatggtcggggacgggatgaacgacgcggcggcgctggcggcggcggacgtgggcgtgtccatgggcatctccgggtcggcggcggcgatggagaccagccacgcgacgctcatgtcgagcgacgtgctcagggtccccgaggccgtcaggctcggcgggtgcgcccgccggaccatcgccgtcaacgtggccggctcggtggccgtgaaggccgccgtgctcgcgctggccgcggcgtggcgccccgtgctctgggccgccgtgctcgccgacgtcgggacgtgcctcctcgtcgtgctcaacagcatgacgctgctcagggaggagtggaagggcggcgccaaggaggacggcgcgtgccgcgccacggcgaggtcgctggtgatgaggtcccagctcgccgccgactcccaagcacccaacgccgcagacgctggcgccgccggccgtgagcaaacgaacggctgccgttgctgtccgaagccgggcatgtcgcccgagcactcggttgtcatcgacatccgagccgacggcgagcgtcaagaagagcggccggccgaggcggccgtcgttgccaaatgttgcggcgaaggcgccggcgagggcatccgctgcggagcctccaagaagccaactgcaacggtcgttgttgccaaatgttgcgggcggcgccggcgagggcaccaggtgcgccgcgtccaagaagccggcaacggcggccgtcgttgccaaatgttgcggtggcgatgccggcgagggcaccggatgtggtgcctccaagaggtcgccgccggctgagggaagctgcagcggcggtgaaggcggtaccaatggtgttggtcgttgctgcacgagcgtgaagaggccaacctgttgcgacatgggagcggcggaggtgtccgattcttcgccggagacggcgaaagactgcagaaatgggaggtgttgcgcgaagacgatgaactccggtgaagtgaaaggatgatgttgcaagattgaccagtaattcactctacgaaatgttaagttttaactgatcattattgtgtcattttccttgggctgaaatcatcttgtaatgcatcaatgattgttgtacagtactagtatcattgaaaactgccaaataacatgtaacattcgaaatcctttttttcaatgttgatacgtagttcacgattgcataccaaccctcgtacatgtacatcgcactcaatagccacaagcgtgtcccatttgagatagattattgacagaattattggtttggagtatctaatttactagatgatgtcccgcgtcttgctacgggatatatgttagatatctattatctatctattctattctattctattatatactaaaagtccattaaacttcctacaaacgctcctaagccaccacgtggcactcctacaaacgctcctaagtcgccacgtggcacaatctaatctcaccgtcgatttttactaaagttggtggacccattattttacaccattagattagatctattattgacaaatacttcctccattttttattagatgacgccgttgactttttctcacatgtttgaccattcgtcttattaaaaaattttatgcaaatgcataagatataaattacacttaaagtaatatgagtgataaaacaactcataacaaaatatattataattacgtaaatttttttaataagacaaatggtcaagcatatgagaaaaagttgacggcgtcattgttaacagtgaaatttggtaagcccggagtaatcatcggcttagagtcaacatcggcttcgaagtcctgagattagccgatgagagttgtcaagatgtcagttgtcggattcttgctatattcggttaagggaattgattaaggaagcttgtccagaagagaccaagttcaaataggatacggcatggcaagttatctattaattaggaatagtttgttagtttccttttatctttaggaaagtgtgtttagtgtcctataaggactttatcttttccttttatctttaggaaagtttctgtcttgtccgacaaggacttgtatcaacccatgggtataaatatgtacacccggggtctatgtaatctatcctcacgattaatacaattcggcgcatcgccaccttttaccttttctactttattttatcgtccggcgggacttggcacctgacgcagggctgcatcagtgttcgatctccggcgaagggataagtccaatgttccgtcggttcaggcaattgtatcgtctacgtcggcgtcgttcaaggctgcatcagtacattcaacctcttggattgctctggtttgaatgatatatttgcctacccatttatcatatgtctctgttaatctagtcttagcatatcaatttagctctatcggttgcttctcgttttagggtttctaccgatatcggctaaatcgcgttgctagattagattagcttagacatctaccaccctgaaaatcagtcaacggtttgattgtctggatattggtttcttttcatacttagtgctgcatcagttaagtttgatctactaagtcgtgcttagaaccgtaatctctagcatgctttttgactgccaataagggtttcatcgaggtttcagccggtgagttatctggacgttgtgtatgttcccccgccctcttctagactttatacatttgtaaaaatatgttcggctcataaggattgcatatacatataagttggatttagctgatgacaacaaaggtttcactgtttaatctaatctcgtggatttcatgacatcggaccaccagccgatgtgtgctttaatcttcggatcaatgcttattctatcatatcaatgctagccgattggtttatactagactatattattgttatattttattatcagtagccgattgcctatatatcattatttactaaagtgttagaatctacattggatgtatagccgattgcttaaactctatcgttatcggctggtatcggcatcggctattatcggctatcggctggaactactccatcggcttgtcagccgatcagctggtttatctgctgtttacatattttgtcagttgcaggatcaaactgactggcacgcccgcatctcatcaagatttggacctgcacaggagctaagcagatctcccaggccgatgtgttcgattttttcgtcaacagtcatctattaaaaaacggaggtagtaactacctcgtgtttataacgtacaagcgctactactgtccgtacatatttgtacgatgcaaatgttactgttgttctttccatacgtacaaacgtacatgattgtgaaaacaaaacgataaagctttcctaatcttcacttgaagaaaaaaaaatacacatgtacattaaagacaggaaaaacatacattcataaaaatcaatggtctttaaaatatgattttctacaatataaagataaaatatattacttcataaatataaatatgtttagttaaattaacatgtataataaatattcaatgaattttcttccaaatctatatattatatactaaaagtatattaaactttgtacacacgcctttacaccgctacgtggctcttacataaattacagaaatcttagaaatctattatatactaaaaatctgttaaatgtcctgtaaacgctcctacattgtcacgtgacgctctaataatgatagagaaatcctagaaatttagagtaaaaaaagaaaagcatccaacctttaattttctattaaattagtggatccgttattttaaacattggattagagctcttagaattcccatgctgctaatatctatccaaaaaaaaacataacttgcttacgtcgtacgatcgtctcccacctgaaaaaaaaacttaaatacctacaccatatacgatcgagaaaaagataaagccaaaaaataaaaaaaaacatgcacacatatataggggtgaaaacgggtcgggttcgatcgaatgtcacccttcccacatcctaacccatattttataattggaatcgggtcggacacggatagtgccgaatacggatagaaactcggataatgtcgggcaaaaatacggaacttatacataccaaaatagatatgtacactatcggttacggatatttattccgatatcaagtcgaagcaacaatcttatatatcatataggcaatcactatttaacaatttcatatatcatataataagattatattaggtcattaggaccttaggaaataaatagggtacaatacatcatagtataaccaatacatagtaccaaaaagtacctcacaaaaacgtaatacgtgtaatatccgtataattatccgggtaacacccggattttttaccggataatctgtatccgtcggatactatattcccgaacccgatctcatatccgccaaaaaagtctcaggtacttgaatttgtcccgaaagtaatgtgaccgggcgggtgagtgggacatacccacgccattttcacccctacacgtatataatagaatgggaaaaaaatactaataaggaaaaatcatcagtgccagcactgatttgtggtcaacaacctttaatctatgattttattaaaaataatactatatagatatgcatagttaaacttaatcgtaaacttattgtagtgataaatatatcatgacaaatgacgccaacatgtaatagcaaatgagatcataatgtttcaaataatttcatatcaaattttatggtgtcaaatatcacttgacaaatatacaccgttaatttgaatctacatatgtaaaaatcaaaataacaaaacctagcattgttttttaagtacatcgatctattcaggtttatttaattttgggagagaatgagattctcaaagtatttggaattttcaaaatttttcttatttgagctgtgagaagcacaattaatagatttatgagaaaataaattaaagtttatccagtgataataaaataacagaatttagatttggttaatttttaagtggatctttttaagtttattttgggtgagattgagattctaaaagtatctgaaatttttcaaaacttttttattgctatttgaggagtgagatgcatacatgatagatagatatttcttatatgccactaaaagttcaccggtttccttatatgccatcgtaaattagctattcccgtatatgccatcaaacgaaattttcgctcacctatatgccatccacgtcacccaagagtagaaatagtgttagtttttttgaaaaatgacaaaattgcccctggactccctttcctgctatgtaaagaacaaatcaggatgtgttgcagttaaaactatgactataactttagcaatcattattgattcaacacacaaccaatttaccaaacaaatcaggatgtgttgcatttaaaactatgactataactttagcaatcattattgattcaacacacaaccaatttaccaatgactggatgcaaagttttatttctcttccatttttatagtttatttatagattatagaaagaaatagtttgtattcttttttaaatggcactaagaacaataatttaattagtcctaatttaatgtatctaactggatgtaagcattcagtttagaaaaaaaaatctctcggcttagcaaactgattgtgtgcctaatttgttcacaaaaatagttatgctcaactaaaaaggttaagtgcttaatttagtctcaccatggaagtaagtaacttcatgataccgacatcagttgaataacatcaaaatatgcatcaccttttttaattcgtggtaagaaaactaagacaaaagaaaggaaaagaaagctaagggtaatttcttactttcaatgccacctaaaatagtcagatgacgtggataacatatgaggaattgaaaaaaaaatcatttagtgggatatacgggaatagcaaattttcaatggaatatgaggaaactggtgaacattcaatggcatataaggatttttttaataaataaataagattttagatagttattttgctacaatacaacccttaattcatcacgagaattacgtatttgccaagtagcattggcaaaacatgaataatacaataaaataagcataaaactacttatgttatattttttatggttgataaaaattctaatataccgggtataattgatggacaaatgctatacaccactaaacctaactgtaagtgcactctagagaattagttggtgtaaataagtttgtgaaaataagtacattcttagaattagtaaatgagtctcatatagttgaaaacaacatatgatggaaacaaatctaccgctaaagtataaatctttatcgaaatataattaatgataaggtgttttgcagattttcatggtctctttagctatagtttttattaagtactgttgaatgattaaccccactcatttgaaaaacataatattgtatgtattctattataatttaagaagtacttattactaacttcatatacacattttgcctattctctaccacaaatcgactcaaaacttaaaaaaaaaccatttttatcacctcctttatgtccctctttatccttcaatgcagggtgcagtacttgctataccattgtaaatattgcatgggcatgtacatggttgtgttaaggtggtgtccatgaaaggccaccataggcaatgtaactaaagtgacataattaccatataatcatttgtgattgtaccgatattgaactaagtgttaaaattgtactctaggatggtttttaggggtatggctacatcgacgcgggacccatatgtttcaaggcattacatacgaaagcgttggttggcagatacagtcgacttcatccattaaagaggcattcatgtttattttaacggtgttatcgcattattcggtagatatataaggtatatttagactatttatacatagatgtgaaaataagttatgaacaccgggttatgtaggtagatgaatttttttagtatattaataatgtgtcatttgttttagtgatactaatacagtttcatttattaaaaagtgcacctaactcgatcttaaaacaataacaatgatagtaagtagtggtgacaaacgatcggtttatatattaccaggacaaagggacttttttttttaaatgtaagagatattcttatcacattagtagtatactaaaatctatcatctattttacggtaaatatatttctttttctattgtaggataatctaaattctcttacagtatatacatatatagtgatgtataattccttttagcattttttaataacaaataagatgcccgtgcatctgtacgaaattcctttccgatttatgttttggaaacacaaactataatacatgcccgcgcattcgcgggggctaccttcctagttggagaaatgatacaatgatttggtttgaaatattatgaatatgatttagcatgtttatgtttagtttaagaatgaaataaattatagatataattactatatgcttgcatgttgtgttttgtgtgtttaatgggttgatgtggcagcttgcatgtatgttttagaagtgtcaataaatactaagtttgcatgttgaactttagatgtttagtggatattaactttatagaaagaagggataatatgaatagattaaatattttaaaaataagccaagcaaataacttataagcggtctaaataatagagtgatttttttagtaaaacatattttagataaatagagaaaataatcaataataataggccccgaaaagaacaaggcatatgacaagtacatgacacagcaaagacacatattagaaaagtacaagtcatatgacaaatgcatgacacacgattaatgcaaacacatagagtacaaagggaaagggtaaaaaggtgctatatttataacatatatttttcaccaaaacaattatattttttaactccataaattacctacacttacattaactatattgtaaatttaaaaacttacattacaagtttcaatttttacattgtaattttctaatacatagagtaaaaagaataggattaaaaataatttattatgtacttaaaagagtacatagaaaatatagacatatacttattatgtagaagagaaaatcacatagaaaaaaaggactcaaattaagtgaaaaataagtgaatcaaattttagggcttgtccactttgatgtcattttcaaccttaccaaattttagtaaagttgccaaaaaagtggctacatttagtttgctaccaaattttggtaactatataggagatcctgccaaaattttgataagttgtcaaaatttggtaaggatttttttacatcaaagtggacatgcccatagttttagcaatcccgaaggggaaaacaaacaagatttcattgtgggaataggttccatgtttatttacaacggattttcggcatgtcatcagttgatttaccggttatgagattctccttgggatccatgctcaaaatggatattgaactgaaattccaaacaatcccacgtggatgggctgttattcaggcccatccaaacaataccttaatgggctcattagcaaaccccaacaggccaacactgctacatcaactcagcccagatacgaaaacaaagtccagaacagaaggcccaacaaggctctgcactctgaatcttacacatctcctttggtcagagtcaagctctgaatcttagcagccatgtcgtccatgaatttctcatcactgtcctgttgcaggatcttccatctttctgttgcttcctggacgggtcaaaagatatacatctccatcagattcagcaggcgcggatctcgtggactgcaaagcatggcgacacaatgtcgacattgcttgataaccatgcacacattcttcagactttcagagttccagattcaacagagtctgctatctcgtttcaaacccacaaaggtaggcaggtgcaccctcgatcacaatcagtacccccagttttagtcacacaccaccaaaaaaagaaaaaaaaaactacacacacctctacacattaacaatatataagttcaattagaatgctacaaatactacaaaattgcgacggcgagtacattcacttccattttttcttctcgacctataatttaatttcctctacattagtccctgagtgacgcttgtctaggcccatttggcgagcatggacatgaggccggcgccggcgagcatggcgaggttgatgccgagctggagcttgcctttgctctgcaccctggggttcatgaagtcctcggcgaggaggtcgacgagggccatgtagatgaggatccccgccgcgacggagttgaggatgccctccaccaccagcgccgtcgggctgctctcgttgtacaccgacgagatgcccacgccgacggcgatccccaccggcgtcgtcaggcagaagaagaggaccatcgtcacgatcgacctcaccttgaacttcgcctgcatacattttcaggagaattaaattaactcatgctgtgttattaaatacatttttcaggagtagtatgcaaaaggttgatattgccggaactaggcaacttgtaaattaagccattccatttgtatacttcttcgggccgttctaaacagaggttggaaaccgctgattagccgcattgtatatataattaagtattaattattaaaaattttaaaaaataaatttatttgattgcataagcacattctatataaaaagttttcgtacgaaacatatcgtttgtagtttaaaaaatgtgataacagaaatcgagaagtaactaattaattaaccgatctctgatttgaaacaggcccttaagccctattcatcaggttacatttcagcttttctgttctttgtcttatacatataccagtccgaaatactatcaaatcatgtaaagtttcaatgctttagatgatcactactttgactcaatctcgagccagttagtcacatagccttccttggtcaaatcatcaaagtaatatagctcccttttccctctttacatatatattgtttttcaagaataaagtgccctatcttttccatagaatcaagcaagtggattagtagcttagtcttttttttgcctcttttgatggagaccatacaatacaagaccaaatttccagcttccagtgcgcgaaacataaaagattagcacgaaaacactaaatcatgctacgacaagtttagtgtaaataagtttcattcatcggattatctactttatagtacaaataaattaaatattttaaaatataaaaaaataaatacttctaaaaacaagtggtgtaaataatatagtactagaagattttttttagaaaaaacatattttgaagacgctgaggaaataatttatgacaataatccggtgaaacagctgaactacatgaatgatttgagccaacaaggctatatcttttaagatgccgtgcaagataccatttttacatatatgaattttgggtaaaaaaaaaacaccatgtagtaaaagaaaaagagagtagaaatatacctgcacgatgcagccaccgagtcccatgccctcgaacatttggtggaagctgagggcgaccaccagcggcttgatggtttccggattctgtgacgcgccgagggagatgccaatgatcaccgagtgcaccacgatccctagctctagaacctaattaaaatcaatcaattgtataagtcaataatgatacacaatatatattattctgaatattgcactcgtttgttaaattctgcacgcatttttctttgcattttacatcaccgaaaatgatatatgtacgacacacattgaatttgaaacctttgggcgcatgtgccctcgtttttccgcgattcggctctttcttctatcactccataatacgccgaaaatttgatctttggtataaatgctattttcgagaacgccaatttataatatatggtgggatctcttataaaaaaaatatatgtgcaaaagaaatgaatacacttaaattccattttaattctgcaatatttatttgaaacgtacatactactccctctatccctaaatataagggattttgattagatgtgacttatcctagtacaatgaacttggacatgatttatatctagattcgctgtcttagaatgtatcacattcaaccaaaatctcttatatttaaggacggagagagagagtagtaatgaaagtgtggaaaatgacagtaaaaaaaacagaaggttactgagactgctgtttcttacctatgggttaattaaaccaggctggcgtcatgaatgaatgcatggtaattagctaggtgttacgttaattaaaggaggtggcctctcacctgagagatgacacgatgccggagagttgtctccttgtcgtcctcgccgacggccgcgacgagcgccgacgagccgtgcgcgtggccgtgcgtcgcgtgggtgtgcacgtgcacctgtccctcgtgctcctcgccgccgccgccgccatcgccgacgacgtggtgattgtggtggtggttgtgctgctgcgtcgcggcggcgctctgcttctcctcgtccgcgacggcggcggcggtggcggcgtccttcttggacagcgcacgcgtgaagtagccggtggcgagggtgtcgacgacgagcgtgccgatggcgccgaccatggcgccgaagccggcgaaggggaactccttccacggcccgccggcggggaggcagtcgtcggtgaggttgtcgaacgcgtcggggaggatgtggatgaaccccgtggcgaggatgacgcccgccgcgaacgccttgacgaggaagaacacgtcgccgtcggggcgcagcgcagggacgtggcgccccagcgaggggaggccgcaccccagcgcgccgcacaccaggatggagaagaaggccgcgatcttgagccccctcgcccgcgcccggtcccgccccgccgccgcatcctccttcccgcacccgccgtcgccgccgtcgccgcgcgccgccgtggcgagcagcagcgccacggccgcggcgaggagcacggtggcggtggtgttcgtcctcatggccgctcttctgctcctgctgctatcgcggattcgcgggttttatagattcggatggtgaaggtgaagggagtaattagggttttaatcaccttggattagtcgctcggtttaaatggggggattaaaaggtgaatggtagtagtaacacagagtgacgacacttgacagtaactcggggtgaaatttttggttgagggagatattttagtttttgttttggcaagtaattacggcgtagaattactaattacgcaaggatgacgacactatttgtcacgaagtgttgacatgctgagtaggagagagaagtgtagcattcgagggtacgcgtgtgagaatttcaggccatgaaacgcgtaacgaccggaagtgtagcattccaccgccgtcgccgtcttctcccattccacatggatgaaggtactcgatctattcaatgacaaatgggttcgaggagtcttatgtatcgttaagtactcccctccatttttatttttttttttacgcttcccacaggcccgattaaactaaggaagctgtgaattaacttgtttgcccttcactcttgcccctttgcactaatgcgtttcgtccatacaggggtgaaaagggcaagggtggaaattctcgtatgggaggagggcgtctgaactgcaagcgtcaaaaaaaaaaaaacgccttcagagcatctccagcaggaaccttaaatccagcccctattcaatttttgagagttaagataaaaaaactagatccagcagggaccctattacagccccaaaataagaaggccctcaaatcctcccctaaggcctcagtcctaggggctccgagcacggccccatcattctttttttttggcgtggataacaattttgcttcgcgctttttcgtgttattcctgcgcggctgcgacgagggatcttctccggcgaccaccggcgaactcccagcatctccgccaagcctgccccaaaaggtaagacttttccacacatttgttcgcccgtcgtccacaaggccggcggcggtggtccatgcgtacgcctggtcaccgacctccccccatccgcctggccatacgccggccgtcgcgtgccctctgagactgcccgcacgcacatcacccacttgcatggtgtttgcccccacgctggcctctgcccgatcatattttcagatttcactggccggagcctgtacaccgccgctgccccattgatttttctggaaaaaacttgaagttggtcatgtggtgtggtggttgagtagtagaggagatctcagtagtagagtaccagtcaatttttctgaataaactcgttcttgactacctgtggacgtggtgacagatggttatggtggtgaatgatttgtttttaatatttttttgaagaattgtagtggactgtcggccaggacaatctaaattctcaactagtatatatcactgtacttatagtagcactgcattgtgtagcactgtacaattgttgcaatggatcgattataaccatatatatatgcactgcttttcatagattgaatgttgcgtactgtatatgtgtagttggatacgtgtgtgtatatgctctaaattttcttattaattttatgatcttgtgatggcagtgttttttacatggacttctacgacggtgacgacgacgacgacgacgatcttattaccgaatggtgggatcaagaggagttgtttgacgatgatgactactacattgcagctgctcttcttacggacatagagcataagaggaccaaaagaaagcgtcgtggttcagtcccaggtcgtgagataatttatagggataggtttgctggcaatttgcgcatagtggctgattattttgcagatcctcctgtatataatgcaaaattatttaggagaaggttcagaatgtcaagggagctcttcttgcgcatcgtggctagtgtggaggctcatgatgactacttcaggtggagaccgaatgcagtgggtcttctcggtgctactgcattgcagaaggtgtatggtgcaattcgcatgcttgcatatgatattccagccgatagtcttgatgaagttgtgaggatttcagagagcaccatgatagaagctttcaagcactttgtcaaggctgtggtagatgtgcttgctgatcaatacttgagggcaccaactgctgaggacactgcaaggttgatggctataaacactccaagggggttcccagggatgttaggttgtattggctgtatgcattggaggtggaagaattgcccaacaggctagaaaggacaatactcagggcatgtggatgggccaaccatgattcttgaagctgttgcatcgaaagatttatggatttggcattccttctttggactaccaggttctcttaatgatatcaatgtactacagagatcaccactctttcaaaggcttacatcaaggacagctcctgagctggagtttatagtgaatggaaagaaatacactatgggttactatcttgctgatggcatatacccttcttgggccacttttgtgaagaccatttccaatccacaaggtaacaagagaatacatta

SEQ ID NO: 71871 - DNA, 846 bp, Oryza sativa
gcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatcatgcccatgaacattggcatcagtaactgtaagttgatgaatggttcatatttgatacatatttccttttgttgactacttggatgagattctgaatctttttgtagacattttttgctgttgaaataactacacttttgacttgttgttcatggatggcatcgatattttctatctgaagaagactaaacctgatgctttacagtaagctgcactggacggcgaatactaatcccttatctcaacaatggtagagcaggtacaatagcaggctataaaccagctataaacatattttaaaaagataaagaaaaatagagaaaagtagcgggctatagatctgtagccagctgcagcacggactccaagacgtaatgtgtgtatgacaggtaagattaggtattaatagtatagtaaacaattgtatgaattggttattacattagctataaatgatttggagttagtattgggctatattattaaacttgctcttaatagcttatctactgcttgaccatggagtacgtcacagttgctgtcacatgaatacttttaacttttcttgcttgaaatttccaagctgaaagaaactcttacaaatagaaaccctagtgttttttttttaaaaaaacagattgctcaagtgagttcttacatttttttatttaaaaaaattcacttataaataga

SEQ ID NO: 71872 - DNA, 5245 bp, Oryza sativa
cgcctaacacgggggacagccctgtcattccctcattaatgggtgaagacttgtggtggccgccctccgaatgaccctccgatgggacgggtcatacctacctccactccgccggtagcagatgcgacgtgggagcacggttgtcagtccagtcagacatgaccggcgtcaggccggtcacagaccggtcattcttaaccatcacgcgccagacggacacgccgcacgtctaccccactgcattaaatgcgacagggggcagttggggggctgcgcgcattaaagggggttcagcctgggccccctcctcgcttgctccccccgccaaatggcggctaggcgagggcctctgggcaaagcggcgcaagggcctgaggggcatgacgtggcaccccgaggcccctcgccatcccggccgctcctgcgattcgcagaatgcggggataggactaggctgtagggacacgtggcaggatgggaaggtagattcccctcacctcacatacccccaggcccatatctccgacaaaaattgttaaatatgttatccgaatttcagcatacaatatatttgggttagttacgtaataagactttgtattacaggattagtttcctaataggactttgagcgtttgcatattaggactcctagattttcctttatgtatctcttttatgctgcatggaaacggtgcggcaacccaatgaatctgttactttcgtatctaactcctttatactgatatttgccggtcgacgcacatggtttttttcccatcaggattttcacataaaatttgtatttctattatccatctattttcataataagaaagacttaactgtctaattggttattataaatgcactcatacgtataggttgtgcatgcatgcaaaaatcatagcagggctcctattttcatagagcaaataatggtcagctccttttcgtcaaccttgagcttcctttctagagtagaatatcctacggaattaagtaatatgtaagattaaaattcctttaacccgtcgtaacgcacggatactttttctactaatttgaagatgaaacaaagggggcctatgtaccactatgaggattcgatatgatacaactttttagtagtgtcatttgttcgtattgctatcaggcttactgatacaaatttttattagcatcatttattcatatctctatcgaaaagttgtgctgactatgaaacaaagggggcctatgtaccactatgaggattcgatatgatacaactttttagtagtgtcatttgttcgtattgctatcaggcttactgatacaaatttttattagcatcatttattcatatctctatcgaaaagttgtgctgactatgaaacaaagggggcctatgtaccactatgaggattcgatatgatacaactttttcgtagtgtcatttgttcgtattgctatcaggcttactgatacaaatttttattagcatcatttattcatatctctatcgaaaagttgtgctgaccacgtctcatgtctctcattaattatgaactaccaacaatttcgttttcaagtgagatgactgctcggttacatgcgctgaatgcactgaacaagtagacttgttaggtagctttcagttcagcgtctcggattagctaagctagaattttaacatgtgagggggccgacttgttgagtaataataatacttaattgttgtagtaactaggaaggtagcccgcgcagttgcgcgggcatattatttaaactatcataatttttgttgttattagaaagaatttagggtttcctttgtaacacaggatttttagaaaagaatagaaaatggtatataaatgattttgagaaaagaaaagaaaatggtatataaatatgatagaaatgaatgtttaaaatatagtatggaatagaatggatgtttggatagagtgtaaaaaatttaaaatgtattaacccagttagatcaaattatcatctggacaaataataatcaaacaacctttgcattagtagcttgacgattgtctcgatggtaattttttaaaattctgttatatgcaagatatatatcttgcatgtacgtacagatatcgtggagagacgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataacaggtctaagattttaaatcatgtgatagcgtaggattttttagaagcatgtgtaaaatagaggatagagaaaagtggttatctgaattattaacacatagattattaacaaaacaaattacataatccgcatataagctgtgagacaaatttattaagcgtaaataatcggtcattagcaaatgtttactgtagcacggcattgtcagatcatggcgcaattagttttaaaagtttcgtctcgcaagtacaggaaaaacagatgattgttaaattttgttatctatgtagatgaaataattatgcatttgtgaaaaaaaaactgcacttaaccaaacaaattttgcatcactttgctttgactaaaatactaattagtagtaggcaactaatactctgtaactctgtctaagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggcggcggggacggcgtcagacggcggggatggcgtgggttgctggcgtagatggcggggacggcggcaggcggcggggatggcgtgggttgcgggcagagagcggtagcggagagctgcaggcgctgtggacggggggacggcgacgcgggtggcggggacggaggtctcgatctgacgtgcgctcccgcaaggttgtggagtgcgaggccgagctggttgcgccgccgagctactgcatcgccaaccgcttcactcgcgattgggctgtacaacgggcgctgtcctcaggtattgcatcgtgcatccctgcatcgtcaatgtgtactgcactaatgtcctgttgctctgttcccatgtctttgctctgtatcgatttgtctctgctttacgttcaagttatccctcttgtactgcatatttgagattttttggcccatcatgaagggtgtctgtatggctctgtataattgagctttcgtagttaactaattgtagtaaaaaaagcttgtaacttcaaagtaaaaaatgctttcaatttgataattttatatataattaccataccagaccttcacaaaacttcatatggtaggaggcggggatggcgtggtccgcgggcggagagcagcgggtggcggggacggcgtgggtctcctgtagtttcccgtctccctccctccagtggctgttgcaggcttgcagcgccatgtccatatccacctcccatgttccgtcctcacctcaacatcctccttgaattatctcctagctcagtgggtgggttggcggctgcggtgtgtcgacctctctatcttccttcgtctgtattggttatgtcctctctattttccttgattagtggatttggcatcagctgctggggtgttcgccaggggacaattggcagcgatggagttgttgttcacagctctatggaaagacggtatgtgcataatacgaaagattgcggaattatgatgtgattaaatggctcattggctgtgtacatgtattttggatgtttaagcctgtttaatccattgtctaaaaaaataaatggttcatggatgtttactttctggggaaaaatgttataatagaaggaaaatgtaattatcctataactttatatctctccatttctttttgtttgacgccggttagttcaaaattgcactaatcaacgtcattcatttgaaaacagaggtagtaattattgaatatagtacaaagatgaaatatattgtttgtgaaaggaagatataatgtttgaaatatcatcctatttcagctggtaaaaatactcactgtaaatggtaattttgaattgcagcctttcgctagagtatgttgtagcacaatcaatgttgtactggagagaagcaggaatagagcagctgcaatgaatatttacaatgataaggtacccatgagtagtttgcaacatagtttgtatgatcaatatagatgaatgagaatgatataataccttctagaaaatctctttgtacactatgttcctgaccatatgttcacctggctttcattgtcatctagcattatccgtagcccatctcgtcttgtaactctggagaacgttacgtagagctgcccatgcgtgaatacttgcttaggcagatatagtcctaccatgtttagagactgtccttggcttttattgatggtcatagcgaagcacacactgagtggatattgtcttctttttagcaagaagggccatcctgactctgttggcgtcattattattctagggatatataccttttctcctacatgtgttcctgttatgatctgtgcttcaatgaatcttttcccgagctgagtaatggtcattcgtgtaccattacataaccctgtactttggttaatgtttcgcagtagcatcactggaaggcctagtttcagtttcagcacatggtttggcattccagggaagtttagactatttagaaattctgttggatataggacatcggtttcactgtcattagttgttgctttgcatacagtgtcgcagctcagatatgttatctcctctccttctatcatgttcattataaattcattaatttccctcgctgtctcatttcttgggcatagaattgctcgctgttctaagaaatctcgtttcttataattctgtaccaagtttggatatatgctcttcacaatttcttcctttggatcacctcctttcttcagtatcaggtcatcaggtatttctatccattcctctccatccgctgatgttgttttgccatcaccaatgttcaaaat

SEQ ID NO: 71873 - DNA, 748 bp, Oryza sativa
tatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttttacgcttatagagtagtaattgtactctattatcaatttgttattgtgtgcctcggctgattcctggacgagggttcacacacatgtaagcgtttggaattttggatagaaattccgggcgtgacagccagccatggctagcggcgacggcgcgcgtgcgaacgcgttgccggcgacggcaaccggcggcagaggcgacggcgcaaaagcgacgcgaaagcggcggcagcggacggcggcaacgaccaaaggcgacggcaagcgcgggcggcggcgacgcacggggaatcggggaagtaaaggaaaggggagggagtcctcaccgaaggggacggcggcgaccggcgacgaggagcgacggagggaagtcgacacgcggctgacggcgaccgggacgacctaaagagcgaaaagaaagagattagagagaaagagaggggccataggaggcgggaatgccggccgaatgcggcggacatggcaaccctcaccgtcgcacgacgggaacggctcttcggcgacggacctcgactaaggaggggtggaccgggtggat

SEQ ID NO: 71874 - DNA, 14048 bp, Oryza sativa
ataaatacatttgatctcagatctattagaaaatactttaggtattgtatttttaattaaactacttaaattgttctaatttaagtgtatattattaatcagaaggtttaaaaatctatatgatttttttcttaaaaatgtatggattggatcagtgaacaatagctagtccatagattatatatgacccaaagtaatgattatttagattttactaaataatctaatggtgtgcaccaataaaaagtttgctatatgatttagataatataattgtttaaaatttatcataaaatattttttccatctaactaaatgaggaaaataggagataaaggatataggtggggaggtacatacgcacaaccagatgttttgattattctcataatttttattatttttctaatttaacaaaatgtcacgtggcagcgtagaagtgtttgtagaagtactacatggcggcttgagagcgtttacataatgtttaatgggcaaatagctaaatttgcttccatgtgataattttcaaatgaaaatatagttaatatcaaatatagtcgtagtattttccctatatacatctaattctgataagtttattagggtcgggtggatgtttcttgtatgtataaaaattcgaggagggaagaattgtccgtagtatgtacatacccaggagattttatttttctcagtcgtggatagtagcacgtattatacatgtgagaattttttcattttttttgctgagcattacgtatgcacggttctctcgttgcaattaggtgggaccgtggcatggccaatccttcttcttttttttcaatcataattatgtattttgttcctttttttggtgagtagcaaaatacggaagtacatatatgtacgtatatgtcacgccccgatttttgtttgggattaaaaatcattaaataatgcatttctagaaatttatattaaaatttaaatcaatttaatcaagtaaattattgagggtatttaaaatttgctttaaaaatcatggccaggaatattttataatattctatgtgccctaatatattctctggaatttcctgcgaatttttggagctcgagaagtaatttcaacaatataaagttcatttaaccaattaaataaaaagaaaaactaataaaaaatctcctctctccctttgggcctcttccggcccaaggtcccttgttcctccctcgcagcccgctcggcctccctcttccctccttacagtcgggccggcctctccccctcggcccgaccctttgccaagtctatttcgcctcctcccatcacctctgttcctccctcgccgacaggtggacccatgggccctacctgtaagttcttattcccaccccaagcccgtctccaaccgctagcatgccgccattgccgcccccacgtcgccgcctctcccgctcggttccgcctcccgcgctcgcaaccgacggcgtggaccggcttccctccacctccttgaccaaactcccccgctcgtcccacaaaaaaggaggcggccgagccgctaccaccccacgtttgcgccccacttcgctgatcgttgccgccacgcccggccatggttttccctccctgagcctataaaacccttccccggtgtctcctttctcgtttcccctaactcccgagtttccccacgctaaaaattgcgcccacatcgccgagcctatgcgccactgcagcgtcgtgaaaccaccaccaccggcttcgccgctccacgctacatgccggccgctgcaccacctcgtcaaaatagcgccggagctctgtttccacctccaacccgagccaccattgccattcgcagactccgatctccgattgtcgccgttaccgaccacctcgcgccgccatcatcggtggccgtccgggcaggccgttgccgccgctcctgccgcgcgcctctcccgcgccgtcgccgactatgctgggtcgccggctggccgcctccccttggtcccagccgcagccgatctgggccatcggatcagcctcggtctccatccgggccgtccgcgtggcatcccctctcagcccagcgtcggtgcctacgtggcgccacgtgggcgccaccttctccatgctaggctgccgtggccgccacgtggctgccacatgctgctcccgcgcctagtgcgcgcgtggaccgggtccaccgtgcgcccacctcccttgagccactgatagatggggcccggttgtcggcgccacctatcccctcggtgacatcataaatgatttaaattgcactataaatcattattaattctagaaaatcatttaagtagctcaaaacttctattaattcatatctaattcatacgaactccaaattgagccgttcaactggcaaaatgcatctaaaattgagttctacatgttcgtttacttttcatgcactatttgcttttttttattagtgtttttccttatattgcgtgccagtgtgtagtttctgccattttggaagatcgtggtcgcgaggaaaagatataaggttgttttgaagaagcaaggcaagtcacacattccccttgagcattttgatcctagtttacaaatgttttatcgttatcaaataaatatgcatgttttgccaattacatgagaatagggtttacctatctgctcgcttgtgccatgtttacttgttacccgtccttgtcaaccttgggtgataatttatctagctcgtgatactcatgttgacctagttagaactatatgcttagcaatgcttaattaccactagctcacttgatgggataattgcagtattagtccttttagtatcatggcgagctgcgtgctcgagacatccggccatgtttcattggtcgtagttatccaactaaaatgcgactgaatggtgagctgtgggtgcatggttttctagtctgtcacgaccggaaataacccaacaggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtagtcaacaagacacacccacaagtgcagaataaatgcaagggagtacaagggagttataatataaagggttagggtttaccgtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcatcccaagccaacccaggccaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccacctcggtatacagacggaagacgtgacatagtttccaacccatcctagccatagacaagagtaccgacccaatcccacctacggccggaacccccgggacaggtaggcagggctgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaacaaagccttacccactagacatgtggaagtacggtagtgctttacaacagaggcccgaagaccggtccttatatggccgaggtgctactatcaaaaccatgcaccccgagcccagcctaaaaccattttggggattttgaatagagggggcggggtgaattcaattccacaataatcaaaccattccatagtgtccaggtgatgagaaaattcccaaagtttagagttgtaaaaccacctaacgttgcctaattaaccagcgaagcatctacttaaattcataccagtggtaccaagagtagagtgtccattagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaagaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaatggatttattgcgtcagccgaggggaggggcgcgcgtaccgggtccacgggggtggggcccacgctgcagccccacggtccacggtggaccgggcgcacccgggctcacaccggccggcgctgggggtcccacgcgtcagccgcacctaagggcgcgggcggctgacagccgggccccacgcggcagccgctcggttcgcccgaaggcgaccacgccggcgtaggcgggaggcggcgcgcccgcgcccctatgctcgccggcggtggccataggcacggcggagcggtggccgagagaggggagggaaagggggaaacgaagtggcggtccacggctcaccccaggtcgacggcgacgacggaaacggcgaccggagcggaggaaggcggcggcgcggctcgggtggatggggtcggcggtgctccggcggtcggcgagcgaaacggaggggtggacgaggtcggcgaggatgcggcgaagccgaagaaggcggcgccgagggggaaggtggtccgggacgacgacggcggcggaccggagctcggcggcgacggcggaaagagagagcgacggcgcgagctcgattccgacggggagtgagggcggcgagtggcggaaacggtggagggaggcacggggagggtttatatagggttgggagtgagagggggtggccggaggagggggaaacgggcgcgggagtcccggccgccattaatggcgccggcgaggttaggggaggagtttccaaacgaatccgagggagagagggagggaaaaatggggggaaagggggaggggatcccggggaataattcccccctattgattgcgcgcggggcggacaggggcggtgggattcgcggcggtggcggcgctagggcgcggggaaggcggcgggagcggcgggaggaaggggatgacgggtgggccccacccgtcagcgagggtggcgggcgggcccgctcgtcagcggcgcgcgcgcggggagaggccgaatgggccgcggggagaggagagggagggggaaggagatgggccgagccggcccaagagggagagggggggaaaagggactttttagagcttttctttttataaaaccattttaactttgtttatttcttaataattattatttgtgctctgaaaattccactaaaatttatttatgcattttagactcttatgaaatatacaaaaatcctccaagccttatttgacttttaactttgcaccttttaattgttggaggctttcacacggattttaattattctaggcataatttagaggatgtattttagggtcgttttgggacgtgacatagtcgcacccatggcaattaagaagcggttcgcgggatgcactagaggacttaccgcgcttaccacaagcgggaatgggtgactgcttgatctgtagtatagctttcctctggctgacgcatccaggcaagggtaagcgtgatggagttcagatgggccttgcgatggcctatgcggcttgctgattcgcctagccacgaggggggctgctcattgcctgttgaggagtgggggtgaaacctgaggtgtggtgtgcttggtcagagggggttatatgaagggtctcgtcacaatcactcaacatggtgacgtgtccggccgggcgcgttgacatgccggtggattgtgtcttgtgagtacagttgtgcacctctggccaaactaaaactattcaaatagctgtgcccgtggttatgggcgatcgaccagaatcaccgtgattagtctcactcttaataaatcgactcaatgcataggttagttcaggtgggatggttggtcatgttcaacgtggtgtagcgttgttcagtgcaggcataatattatcttaattaatcgaatgttctattgtttgctcaataaaatgctttgcaaccacctttatatcaatagccacaaacccctctttgtatccccttgcatgtctgcatcgattgttggtttggcttgctgagtacggtggtggtactcagccttgctattattctcccttttcagaagtgtagcgcttttgagctgaagacgaagttagaggaccaaggctcagaccctagttgagttttgcctgtggagtggagctgaagccccccgctaggatcgccttttttcgcttctgtcactttcttttcggtgtgaggactaaccggctcttctgtaagtatttacgctttatttacgtttggatctatatattaatttattgttttgtgtatcctggctgattcctggacagagatttaatacacaagatattccggaaatttgggctaaatttctgtgcgtgacagtatatatacgtgggatgtattttaaataaatctatataattgttttaaaatagtgggtccaccgaattgaatgaaaatcgagggttggatgtttttcttttttctcagaatttgtaagattttttcttctttattagagcgccacatgacatcttagaagcgtttgtaggagtaccacatggcggcttgcgagcgtttataggaagtttaatgattttttttatataataatagatagatgctgattctttttgaaaatttttttgacatgattctttttagaattttggtatcccagaaagttctcactccaaaaaattaaaacgtagtacgtattctggtaatgatatatagctagcaggttttcatgaacagttatgcggaaagctaatcgtcaagagtagaattcaatttcttgtaatttctctgggttgataatatttagagcacggtctttaaaaaccaattttgataattattttctattataatatgtataaaactgttaacaaatactccattcgtttcatattataagactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgacgccatccaccaccacggcggcgccgccactctgtcccagatagtcaccagggtcgcgctccacccgtccaaggttccatgcctgcgtcgcctcatgcgcgtgctcactctctccggcgtcttcgccgtccagaagctggcgcccggcgatgccgcagcccctgccgacgaggccgaggcggccgtctacgcgctcacgccggtgtcccgcctcctcatcggcgccgggaaccagggacacatgatgtccatgctgctccacccgaacttcatcacccccttcttccggatcagcgactggctccagcgcgagctgcctggcccgtgcatcttcaagcacacccatggccggagcttgtgggagatggccgacgacgacgccgcgttcaacacggtcgtcaacgacgggatggcgtcggacagtatcttcacgatggacatcctggtcagggagcatggcgaggtgttccaggggatcagctcgctggtcgacgtcgccggcgggaacggcacggcggcgcaggccatcgccagggcgttcccggaggtgaaatgcagcgtgatggacctcgcccacgtcgtcgccgaggctcccggtggcaccggtgtcgagttcatcaccggcgacatgtttgagagtgttccaccggcaaacgctgtcttcctcaaggtatattaattggtctcgcaattctctcaagtacatttccgtttttttctaaaaatttggcgtcacacatatttaacacattttcagtcatttttttatgtgtagttgctatctctgtatatgtttatttctcgtttagctcctactcgacgtaattaattaatcactttcgatcctattctattacatgttgtgcattagaaaatttatagttttattacagtataaatgctggtgatttaaagtttaaagcgatttgttttgttgaaaaatatggcaaacccccttatttttgttgttcccgtattgctgtaacatatgtctaccaaggtacgtgcttttgctatggacagtgtcgtacaaattgtcgatggcgattgcaattaaagtcacgcgctttttttataaacattactgcgtaccaagctttttcaatataattagcagttgaattttggatataatgttcaatcattcagcttatttataaaaatattactcctacgtagacatcatcatttattttgctatgacctattgaaggtacagaggactttaaacatgacttatatattttatagtagtattggagaatactattattgtaaagatttcaaagttggaaaatatcatcgcatatgtccttgacacgttggtcagggactcacatttcattctcacaaatgatggtatttttcaactcatacatctttatgatggtattctcctaatatttgctatctgctatatatttatagtaaatttttaaataaaataaatggtcaaacattatgtacaaaagtcaacagagatatattctacaattatgggagtactggttagaggtttcgtaaaccacacaaattaatactagaagattcagaatgatagaaattcccttgttataaaatatctgagaaattttcatcttaatatattaaaatcatgtgcgtccatacataaaaattgatggctgagatggaaaatccctaccatcaaatctgtttaagatcaaatacaaatgggtcataaattaaagctattcgaaggcaagcatatatattatcagaataatatatgcctgatcaaaaatgaaaattagatacaactgtttagaaaaaagaatttcgtatatatatgcctccactgaaattcactaaatttatcttcaaaattgaatgtcactttcggtgcaaattaaggttgagaccagtgcaatgctaattatatttttgtaattgatgtcagactcttaaattttgtgtaagtcattatactttggttccaccgataagttattcactattacacctttaattcacattgggaattttagaaatgtccaattagtacaaggttagatgtacatacagatacatatatttacagaataatatatagttatggagggactgttatatatttaccttctgtctctcctgatataaatttattatatatttagtggattatgcacgattagggtgacaacgactgtgtcaagatactggggaactgtaagaaagccatcccaactagagacaagggagaaaaggtgataatcatggatatagtggttgggacagggccgtccgaccaaaagcatagagatgtgcagatcttgtatgatgcatacatcatgtttatcaatggtgccgagagagatgagcaagagtggaagaagcttttccttgaagctgggtttagtgactacaagattatgccaattatgggattcaggtcaatcatcgaagtctacccttgaagaagttgctgattcttccatgagcaatctgtgtgtgttgcttgggttgtttgtgaaattgtgatcagaccaatcaaataagtgtgtggtgtagccccaatcaaataagtgtgtggtgtagcttcatatctatgtattcgcagttctacttaatttgcctttgaaaatttcatgaaaatagtaggaataatgtatgtaccccaggacataaatatccgctcacctctgatggcccatcagtgacgggccaaagtgctagtcacggatggccgtcacatttgacgcgttctagggatgccgtcatcagtaagccctttgtctgtggcctgtcagaggtgtggttcagtgacctcaaacgggcaactgtcaactgctttcgattccaacccagtgcactattcacatttcagatgggacaggaaagagggcgattgtttgctggaaatcggaggtaaaaaagaactgtgaaaattattattttctaacgtgtactatgtgttggcaactttttgtgacaagttgacaagcacgattgtagcaccttatgccttgcggtgatcctagagtcgcgaaccacctcgatctagcaaagagctaaacctagatggattttgacaaataaaccggctagcgtagccgattttagataactacttgtctcgtgggcaaaacggaaggttttcaggacaaacctacaaagagatgtcgcactctcgcagcggcggcggatggtttacggcgcaaactgacaaagatggacaaattaagagaaaactaaaagcaatatgaaaaacgataatccatttaccggccatagtaccttctaagcgtcttgccaaactctcgggaagtatttcttcaagtatttcccgttgattgctcgctgaaaacgctccccttgaagtgtctccaaaaaatatgcgttccctcgaacaatgccgcatacccgataaggacctttccaactaggagaccacttaccgaactccctggatcgagtacccgaaggcaaaattgtcttccaaaccaagtctccaacttgaaacaactttgctttcacccttttgttgtatgcctaggccaccctcttcttctctttgtctatctcttccaaagccttcaaacgcttgtcaatgacatcatcaaggtcttaacaaatgtcttgtaatcttcacttaacaaatcatcttgcttgatataacgaagagaaccaagatttacctcaatcggtaaaacaacttcttgacaataaaccaactcaaaaggagtgactttagtggcaccatgtttagatatcctatgcgcccacaatgcttcggaaagcacttcatgccacctctttgggtgttcctcaatcttctttttcactagctttaacaatgtcttattactcgactcggcttgtccattagcctgagcgtagtaaggagaagaactcaacaatttaataccataagattcggtaaaactctttacttccttagacataaaagaaacaccttgatccgtagttaatgtttgcgggataccgaatctatgaataatatgcttcaaattaaaggcaattacctccgtataagtcatattcttcagcggcacagcttcggcctacttggtgaagtaatccgtagcaactaccacgaacctatgcccctttgatgacgaaggataaatttgaccaataaaatccaaagcccaacctcggaacggccatggtttgattatagagttcaacacggcggcgggcaccaattgaacattgccgaaccgctgacaagcttcacatcccctatagtatttgaagcaatcctcaatcatcctcggccagtagaaccccgctctcctaagcaaccaattcatcttgtgggccaattgatgagttccacaaattccttcatgtacctctcccatagccactttagattgatcttcatctaggcacttcaacaagacaccatctatatttcgggatataaatcttcatcaagcaacgtgcatttgagtgcttgccaccgaattttccgatcaaccttaagtgtgggatcttttaaatatcgaatcaaaggaattctccaatcctttaaatatcgaattttccgatcaaccttaagtgtgggatcttttaaatatcgaatcaaaggccggtcagaccgctcggggtcgccggtcaaaccggcggcatgtggccggttataccgcacttggtcaccggtcagaccggccgcgcaacgtcggtcagaccgcccctggtctccaatttcgccaatttcgcacagagatttaaaatcaagcaccggctcttccaataccagaaataatcccttcttcacattatagccagatgcttgttgagccaagtcatttgctctagaattatcatgcctagcaatatgtctaatagtaaaattatcaaaattggcaatgatatccaagcatgaatcaaggtacctatttagtgatccgtccaagcatttataaaatccggcgactcgttgcaccaccaattccgaatcaccaaaagcttccacgtgcttagctccaaccatctccatgatttgtaagccgaataataaagcattgtatttggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaggcaaacctcttcctcataagcaatatctacatgatgttctactataaaatcacatacattttggcctctcacagatttcaatggttcataagccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaa

SEQ ID NO: 71875 - DNA, 691 bp, Oryza sativa
aaattaatataaattaatcatcttaaaagtaaattttataaagcctcacgttttatgatcaaagttacagaaaatcgtaggtattatgacttgtaaaacataagagattttatggtctaatgttttaaaaattcccaccttgattcgaatttcaattgatttcaatacatctgaaataatacttttcaaagtagtgaagagttaaaccgacaaacttaatgaagaaataaaaaactaaaagtttcatatgcattacatgttttgaaacggtaagtaaatatttaccaaatatgtataggcgtgggattttgtcaaaataaatagatgaggctatgtgccactggccataatgctcaggattttatgcaacttcgatattataaaaatatggggtttgatgaaatttgctctaaattttaacttctctgtgtgaattgcagggagtccgtgcagcgatctgagcctgaacctgagctacgcgatcctgccggcggacgccggcgcgctggtgcacctggcagcgccgggggcgctgccgccggcgctgccgccggcgccggtgctggagccgggcgacgtgctggacccgccgttgccgcctgtcgccattgccagcccaccggaagaggcggcgacggcggcgaagcccaccgacagcagcagctcggcggcggcggcgagatccagcgcc

SEQ ID NO: 71876 - DNA, 712 bp, Oryza sativa
acctatggggatatcgtaacccatgacctcacatgtctcccgacattccctagggagaagtagtggcactacaggatgtaaccttaaggtctctttgataataagttttaagtacttcaattcaactaagtcatcttcagatatcgtttgctttcctttgatgacgttacttaactcagcttgtgccttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagca

SEQ ID NO: 71877 - DNA, 965 bp, Oryza sativa
cggcatacgatgccatgttattttactacaacaagaggctctccaatattcaggatttctacttggacatcttcaacacatatcttcaatcaagcaatgactactcgacgacaagaagctataattctcgactctatgttcagttgttccccaactaaccaaagagtcgggggctacacaaatataaggctcaaaatttgacaaattttatgtcaggctgaagaaatcaattcatcaaccaacgagtcaactccaggagtcattatcttcatctttgattcggagcagacattctacttcaacaactttaaatatttcggtttagacgagttgggcaacaacatcaactctcctccaagtgaagcatctacaacagttataacactaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggctccttcatcttcattgttagttgatctgtctgccgccgactggtttcttcgcctccatggctatgcgacttcattacttttgattggtatcactatcttcactaccaccagtattgttgccacctctggtgggcgatattatctctatattggtcgtcttgtctatatgccaactgcgtcagctaccatcaatggacgattgtgactacgacagaaggacaagctatat

SEQ ID NO: 71878 - DNA, 3810 bp, Oryza sativa
agccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaagcatcgattttacctgctaggttagaaataaatcttctcaaataattcaccttacctagcaacttttggacctccttcttgcatgtcggcgctttgaaatcacgaattttttctatcttcttaggatcaatctcaactcctctctcatgcaccatgaatcctaagaatttccctgccgtcaaaccaaaagcacatttaagtgggttcatcttcaaaccataccggcgcatcctctcaaaagccaacctcaaatcggctatatgttcctccataccatccgatttgacaacaatatcatcaatgtagacttctaagataatacctagtaaatcatggaagatcaaattcattgccctttgatatgttgcaccggcgttcttcaatccaaaagtcatgacaacccactcaaacaaaccaacaaatcccgggcacctaaaagtcgttttatatatatcctgttccgtcataaagatttgattgttgccggcattaccatctaaaaaactaatcactttatgacccgaagcatcattgatcatcatgtcggctataggcataggatattcatctttgggagtagctttattcaaatctctaaagtccatgcaaactctaatcttaccacttcccttcttctccaccgggactatgctagaaacccactccgcataatgacatcgcctagtaaaccccgccttcaacaactgatcaatctcctctttgactcggtcatatagcaaaggattaaaacgacgaggtggttgcttgtaagggctaaaacccggtttaattggaagccgatgctcaacaagctcacggctaagacccggcatctcatggtactcccacgcaaagcaatcaacatactctttaagtagctcgattatcttaaccttttaatcggctctcatatttttgtttacaaaagttggccttggtttagttccatcacctatgtctacttcctccaatggatcggccgatgtaaacccttgtccaagtttctccacttcatcgaaatcttcaatagtctcaccaatatcattctttgtagaccgatattcttgcaccctcttttgtaaccactctaaattagcccctttactcattatacaaatttatatggcttagctgtgctacactagccggctttacagaggtagatacaaatttgccatcggaaatactaataaaatcatagctagaaagatccatccccgataagcattgaatattcccatgatgccactcaaaagtagcatcagccattgcaacctcggccgatgtatccgcttgaacaatctcaacatcatcgctgtcccattgaattaaacattgatgcaaggtagaaggcactcaataattggcatggatccaacaacgacccaaaataacattgtaattaccttgcacatcgacgatgaagaaagcggttggtaacgtcttgtttcccatggtaagctccaccgaaaagatacccttcgcctcctttggttcaccattgaagccattgagaatcatgttggtcttcttcaactcattatctccacgccccaacttattgaacaacgaatacgacatcaaattcacggcggtacctccatccactagcatcctagctatggtctcaacgcccttacgaggtagtgatgagtttcacgcgctctaagcccggccagcgcgcagttaggaggattggccgctatctgagcggtaccacccatcctaccctactacctatagggggccgtccgtcctacagccgcccgaaaaggaactgcagagaccggcttcccatcaatatgacccttgagatagagaggcttcatatgacaatttgactcatcgggtttctcaaaaaccgcatctttaggacctagtgaaaattgagcaacctcggcttcatccatagcacaaaactctataggcaacatatataccatgttgatatccatgtcttcttttgtagatggctcatctttagcaaccgattgttcttccttctcctctacaacaaccggttcttccttctctatggatttacgcctccataccggtggtggtcgcaactcattaaacctcctatccctttgctcttcggccttttgctctcttatttcttgggcccgaagacgttgcaaccttctcctttgagtagccgttaaatacttaggtatccacctaggtttcagctccgttccaggaggtaaatagtgccctctattgagtttacttgatgacgataaagcccccgcattgcccttagcaaacctcctgtcaaactggcgctggagcccggtcagaccggatgtagaccaccggtcagaccggccagatacgccggtcatatcgacatttggtgggcggtcagaccggcctgaggcgtcggtcggaccatcgtcgggtcggcagtcagaccggccagatggcccagtcagaccggccgtatgattgcggtcagaccggctagaaggcctggtcagaccggccgactgcgatgagctggtacctgcttcgggtttgttgcttgaggactctccaacttcatctcaagaaggtattggcacatcatgagatcccacattgatggtaatcacttccgaagttcttgcctccaccttaatacgctttccttctctcttttcttcattggcccggttcttaccataaaaccagccattgtttggtgaagacaaatgctcatggattgtcctccttggtcctccccacccttgattgaattgtattggaggcatatgattgaacattggcggtgttgccccccatggcatgtagtaaggataagtataacccgacggcggcattggatatggaccccatgacatgttttgagaacaattatattgaggtgattccgaccgtcttggtgaatgaccaaattgctccctaggaggtgatcttggtcttttccctttgttgcgagctttctcaccaccttgtttctcgtacttccccaaaagcatatcaaaggtcactttggtcttcctaggggttttagaagttgaagcttcactattattttccttccaaacaccaacctccggtttctttggcactatcatctttggcctcggttcaccaatgacctctccttttcccttagtagattcggcttgctctggccgaatcaacaccttcttatcattgaaattaattgtattcatcggaaaaggatcatgatcaagcttcatcttggaaccatcgatgaacttcaatcgtccttcatctatggccgattgaacctgtcgtcgaaacacattgcaatcattagtagaatgagagtgagaatcatgccatttacactaagctcgacgtttcaattcttcttgagatggtacgatatggccttt

SEQ ID NO: 71879 - DNA, 1207 bp, Oryza sativa
gatgaatgcgggaaggaaatcggacgaatcggagggagagagagaggggaaaacgggggaaacgggagaggaaatcacgggggtgatttccccctctttattgcgcgcggggacggcgggaaacggcgagattcgcggcggcggcggcgctagggcacgggcgggcggcgggcgcggcgggaggtaggcgatgacaggtgggccccacccgtcagcgagggcggcgggcgggcccgcctgtcagcggcgcgcgcgcgggggaggccgatgggccgcgggggaggagagagagagagggagggagaagtgggccgagccggcccaagagggaaggggggggaaaaagaacttttaggatttttcttttttttataaaccttttccactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacacctagtaatgtggaatccgtaaccaattggaaacaaccaaagacagtttcagagatccgcagtttcctaggcctcgcaggatattatcggaggtttatagagaatttttccaagattgctaagcccatgacacggctgcttcaaaaagatgtaaagtacaagtggtcagaagaatgtgagcagagttttcaagagttgaagaatcgcttgatatcagctcctattttgattttgcctgatccaaagaagggtttccaagtgtattgcgatgcatccaaacttgggttaggttgtgttctgatgcaagatgggaaggtggtaaattaagtaaaccaaactttgcaagataagttgaaacagttggaaacgaattttgtacttttgaataacaggtttcaaaagaaataaaaagaaaagttataaaatcaacttgctaaattcattttattgctgtaagattaaataaaacaataaaaacttctgctggtaaatgagccatcagtacagtaatagatgtacagtactaataacactggaataaattttaaatgagaaccattaaaagagattataaagtgcatgtgccattagtttggt

SEQ ID NO: 71880 - DNA, 689 bp, Oryza sativa
tgtaaaagataatcaaagatcttatcacacttggccacatcaaaactatatttaacctcactttgccgatatttgcaaggagtcggcattagattagaacaaacaaaaggcttgtttttgttagtccatgaccactcagcaacatacatatcatgatcatccttaccctcactatcactagcctcagggtaatcaataaaattaacattaggctttttctcatatggtctaacaaattttttattatccttaacccagctttcctgagctagagccttttgcataagttgactaacatcaagaaattgttggccatctaatctttctctaagaggagcaattaaaccattaaaagcaagaccagccaaatctctatcagttatattcaagctataacattggtttctaacatctctaattctcttaatataatcaacggcaggctcattatatttttgcttaaccgatgtcaaatcacataacctaagctcagtttctctagtacagaaataatcatgaaatctttgttctaattgagccaaagtatgaatagaatatgctggtaaagaagtaaaccatgtaaaagcggtaccggacaaagataaagaaaacaagtgcaatttaaatgtatcactattagcctctcaccacattgcgctaaaaattgacctacatgctcccatgttgtc

SEQ ID NO: 71881 - DNA, 939 bp, Oryza sativa
aaagtagaacgatattgtagatgtgccgataggtttctagtcagcagtatagtctggtgcaagatctttggtttcggaaatttgtcggcttacaacattgaaatgcatttttcttttcatctgatacaggaacgaatttcctgttattagatgtgactgaaattgtatgttggttgtccatatcttttgtaattgatcttttataattgttgacgtgcatatgtctgtctttgcagggtacttcatatgagaacatgacaataatagttaaggattatgtggaaggcttgataaacaagtatccttactggaacaggacacttggagcggaccatttctttgtcacctgccatgatgtaggtgttagggcttttgaaggacttccattcatggtgaagaattctattagagttgtctgttctccaagctataatgttgactttataccgcataaggatatcgctcttcctcaagtattgcagccatttgctctgcctgaaggaggaaatgatgttgagaacaggttggaatgacacttactgcttcttatgctatatatgtgatcttatattcttctatggttgtcttcataaaaaaattgttcatttgggacttctgaatgattctttttcctagactgactatatatgtgtgcctccatgtatgattctagacttttctagtaatagtgccttcaagtgaaaaatatctgtttacttgagaaattctgtaaaacactcacacttactcacgtggttatcttgttgatcatgccttgaatcttacaacctatgattaattcagaagactacatggttttacatttagttcagcactttgttcatgtgcaacgaatcaccttgtagcaaaatgaaagttgtcatgaccataaatttgtgacgatgctatggtttgaacatctatttgcactcctacaaa

SEQ ID NO: 71882 - DNA, 1287 bp, Oryza sativa
tttacaggtttgaatctttctttaccatgctatttctcacacaccacaatcttcatggtacttcacttccaccactgctcctttcttcctccaatctacgctcttcggcagaatatcatcactgctctctccaggcattgctctgaggaattgcgacatgaggtctgaaccccaacatcttggctctgaactcctcgttcgtcaggtcggcgaacgtacttgttatcagccagcttgtagccattgcccatggagttgaacttctcaacaagctcaacgttgctcctgtacacctcgaacctcctctgcttctcgtcggcggtcgtgcagctcccggcaccgcgctcgcacgagctcagttcatcggagacgggcggcgccgcggccccgatctcctccacgagcccccgcgcggagtccgcgccgacgccgtgagcgaagacccagcgctcccgccgccgacgccctgcccactgcccttctcccgcgtcgccggccgccgccgccggaccttcccgtggccccgtggcgcctggagggaggagaggggagagatggtgagagaggaggaagaagaggaggggtgagaatgatatgtggggccacgtgggccccaccattttttaatttatttttttgggtgaaactgacatgtgggtcccatgagatttattatttttcagatcgaattgccacgtaagcgccacgtcagccctacgtcagatgaagaccgagtcaaattagctacgtaagcgccacgtcagctaaaaccaccatccaaaccgccgagggacctcatctgcactggtttttcagttgaaggatgaaaatcggattcgttgacaagttaagggacctcagatgaacttattctttttttttcgcccgcgctatttgggccacatttagtttttgcgtgtttaacgatcaagcttttttttttattttctatatggattttggcagtttttagtgtttacagatcataccgaattcaagggaggttagcccacctgcgcgttttttttttcaaaataaattttgaattttttaagatccataagtataaagtttatttatacgtgcaaagttcggatataatgttacagtaattaatttttttttctaagtgcctttatgttttaaatttgtacgtaaaaaaatgtacgtatatatgcgtatactactcatgtatgaattttccatatatgtacaaagtttatacatacattgtatgcataaagttgtcatacatataaaatttctgtgtataaaatatactccctc

SEQ ID NO: 71883 - DNA, 57233 bp, Oryza sativa
atcactcatagtactttaagtgcgatttatatcttatacatttgcataaaatttttgaataagatgaatgattaaacatgtgaggaaaagtcaatggcgtcatctattaaaaaacggagggagtatgtatataattcagcatcaatccatgtatcagtattatatctcagtgctgacatgagtaaaaaaaattgaggtagcaaattcttatattaaaggagaaaaacaacactcaccttcctggttaatgggactttttagcccacagtgcacaaccttttctgtaagcttgcaattcatatctacagcaaagcatttgtagcttgcaattcatctgtaggacaggcatataataaaatctgtcagccatcggcaatggcagtgtgagcatttctattttctttacttaccaaacactgtgaggctctcaacagaactggatagggctctctcaatcatttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccacagtttcatttcacttttcaaggatgaatacaaattaccaaaggggtccgtgattgagccctcaagagaatcaagacatgtgcttaaaataagtagtaagctctatcttcaccatttcttccctttctttgtcgtttttttattgacagctttgtagttgatttgagacagtgcagatagtatttactttgatggcatgaagaattttgagaatcaaactgaaatgttgttagaatgaatgggcatgtgtctgatacagtttcccgatacctgggactattttctcattctattcatgcatttggttagcattgagtgcatgaagagtagcaaataagtcaccacagataatgctgtagaaaatccatggccttttcataattaaaccaacttctatcctgttttcattttatcatgccaaaaggaaaagaaagaagaaagaaacatcataatcatgtaacactgtgaggtagcatttcaatgcaatgataaatccctgtcacgttttattgctgcttatttcatttcatattagttccaggtaaaatttaaacaggcacactccgctcttcattaataagcttatcttctgtgtttttgtgtagttgaaggagaagaattggggagcatacacaacatgcttttgtgcaagtctattttagatctctagaaaggagacgatccatttggcagaaaatcaaaagaaatccaagaagacatggcttctactcttaaaactgaaaggggcacttaaggtttaaatggcatatatcatgtttcgaagagcttgacgttttatttctgggagttcagacttatgacttatgagagcattcttagctctgatcaagtatattctttgcatcatttttatttgcttactaactttactcttctagccttgaactctctcaaaacagaatgagcggagtaaccttgaattttaatcttgcaagacatttcaatgtctggaaattgacctaagtaaacatgttcagaggggaaaaaaggaagaagagagaaacagctggctgctgggttatgcaaatgatctatagaatagttagcagaaactcgtctggggaagcaaattatgtgcatatttcacgcaggatcatttgcacaaggcccagcttgcgaagccaataatctaatgcggtaacccagtaataaattcgaggttcagagagcattgacattccaactcgatgtaatcgaagtaaccaaatcaccaaataccccccatgaaagcaaggacagcggtattgatttcagtattttacaccccaaaatcagaacacgaattcggccacagtaatccagatcttcagatgcatgaggcccgtcaaatacagcagaataaaaattatcatcagaattaatttagagcctcaactgacctgaatatattgatcaatacagcagggcctaatctggaagctcaggacgacattagcatgatgcatgtttgcatggctccaactcctggactcctgagaaaccaaacatggccttagatattttctcctttaaccacatcaaatcattgaagcaaattacattcaaataaaaagaaataacagaaccagccatagaatatatgcatcacatcattagtaattagaagtcatcagaacactgcaacttaaaatgccagagaaaacacatgtttactgctatcaaccaatagcacttggtttcactggatatattggcatgatttaatttccatatagataccaattaatagtgatgttatcgtgtaataaaaatatactgcatatatggaaagcgagtgattcctttaaaggagcagcttggaatatgttgctcatacaattgaagatgattctaaggaacaaaacctctggaccgatacaatgtaaacaagaccaaaaatcatctggctttgcatcacttgaaacaaaataaagtaaatacatagtctgaaatatacacttcctgataatcttgaaaaatctaaggcttgatgacatattttatatccacggatagtttaacctgccatatttatcttcgccctagcttatctgtattccacaaatttatgaagtagaagaagtatatctgcatatctgacctcatagtactgaatacacataggtaaaagagaaatgcattcttcagtcttggtgagacagaatcaacagttaagaagacactacagatggtcgacatataaaaccactcagacattgttgtggcttggattaagaatgtacgtaccctgaaattagtgtcaggttcaagaaaattaccagcataactggtgcccgtcgcaatctgtcaaattcttcacttacaaattttcctcacttccctttctcctctacacaagccatagaacaaataaatttacatacttttagtaaaagaactatagcagccacatcgaacagtacactgggggaggttcggtttggaattgtggcgcttatgacataggtttcactagactactctagaccttgcaacacatcacgagcttgcaaataagcattgtggtagctaaagcgacaacccataagaaagatcaatgttgcagtgctgatcaatttattttcaccccttgatgcaaatcatctaaaaacctggactaccatcatattacctgaagatgaattattgagagctgaagaacatggaaaattctggtatgcaatccaaaggtgtcaaacctgacatgaaaaaggaaaatgatcagatcaacagaggctcatcataccacaccatcctcaattttaagtcaaccaatctcatattatttgcaattgactgaaacctctgcatgaattaattatttttgtctctcttttccttatggctatcaagcaaccatcagtgaccaactgcagtcccattttaagtatttaacatttaagaaacattaagtacagtaaaatgggagattgagattaacatcttttgaataatagtgccaaatataagctcatcctcctaccagttgtactaaaaaaatttgactgccaataaccaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaactttccaatcacccctccacaaacccactccaaaaccctattctataactaagccccaagaaaacctaaaataccaagtaaagtactaagaaagagaatagattaatgcatctggaaatgaatcataacagattgctagaagtgattctctattgattgttcagagggcaacgagtatgaaatatggctaaccaacctggtcctctgtgttttcggatgtcgtggcatggtcacagcaagcagagcaaccagctaaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattgtagtccctttctttacttggcactgcatgagacaccttgatgtgagtttatggaaattgttcacaatttttttataaaaaaagaaatctctaaatgctatacaaatgggagaacctatggcaatgagcatagtgttgatattaggttccaatgttgtgattgcaatgtcccatttttcgaactttcttctagagttcacctagaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtcaatgttgatgtgcaacaattcatggtgtataggggaaaaaacgagattaactattcctcatggcaaccttaaaagaacaactcacacaaacctgcacatcctttgtaagctcctgtgccaagagtttagtagtcaccgtcgccaccgccgtctctggtgccatgagttgctcgctgctggtcattggccttgtacattgacggcaacgcggctgccgatgaagcgactacctgtgacccagagggcacagatgggagggaaggggaaggcattggtgcggcgtacggtggatgcccctgctgctgctggtggtgaagtggcttcttaacgcagtctgttggcgacggcgacagtgagggcgacgccgacgaccatggcgacgccgatgagtggtgggctggggtgtccttgtggagatgagaagcagatctggcgccgggaggacgaagaccgcgcccgcctcaacccccactccctccgccgtctccccctcgagttgatgcgtccggaacctcgcggcagtcccgccgccaggattgggccctcagcttttcgcgccgcctgtgatgcagccgtcggcgctccgacctcgtcgttgacggatgccggaggcggagacggctgcactcggtgacggcggtcggagacggcgacgcaatggcgccagcggcgcagggcgacggggacgatgatggcgacgacgcgagggggatgcggaagcagaggcgcttggagacggtgacgcgacgacagcggctgcgtaggcggaggcaatggcgcgaggggaaggcggaggcgagggtgggggaggagacggcggagggagagggaaagggagaaggagagagtgggggaagagagggcggaggggagacggacggcggcagctcggccggcgatggggacggcgggaggcggaggtggcagcgcgatggggaggcggcggcgggggtggaggcggcggcgcgaggcgacggggacggcgtgagggggaggcggaggcggcagtgcttggtagcggcgcgagagagggagagcaagcggctagggtttgaggggtctgcgctagtgggagtattttttcgaaaaagcccctcgtcttccacatatcacaacgaagcccctgtccgcgattttttctcttcaaacacaggacgcgaggggcctatacctgattacgaagaaccggagggctttttcgcaaaaatccaacctcgcactgtagctactgtagcaaaatccgacgtggacacgcccagcgtccgccccttccgccacacttaatagtttctaatgaaccatggcatatagaataatcaattcattatcagagacatggcaatccatttgtacataagcctaagagttagattatggatgtcattggttctgggtttcttataaatcggtgcaccagaaatatcttcacagaatatgtttttctcaaaaccggaagttgccttccaaaaatcgactctacaggattcggggaaaccgagaagtgtgctcaatccactacataaaagattaaactctttacggaaaagtcaaaaagtaacaccaccctctgcttctctaagtgtgcagagaaactgtatagttagtagacaagagcctaagtgtgcacagaaactgtatagttagtagacaagagccaagctcgtctaccgttgcaaaggcgtgccaacccatggttctccaaatgacactaaaatctacatccatacttgttttccggagtagctttggatcgtacgctcggttgtgagcgaatgatcggtccttcagcatctggtaggcttgtttctctcgtctgtcaacgatatcgaggtcgttgtcggtcaggagctgtggtacagcgtcagtgttctccattgacacgtcggcagatgcccgatcgctcgactggttggatcgggagccggatcccttgagcaagtgggagagccgtctcctcatgactgcacaaaggcaagaatacaaagcgaactcgagcaggggttagcacaagacaatatacccgccagttaactttgcaccaaaagcaacttgctaatgcgagaatggaggattttaactatgaggctgttggctgttgttaatgacagactttatgccaccaatacctgcataaatcaaggaaataaaacatccaacatagtgatagggttaaattctgacatattccacgagtgttggtgtatatttgtatgcaggtaataaaccaccaaagttggaccaaaaatagacttgagtgaagaataattcctatccataccaagagtgggccaaaaactaccagaaaacatcttcaaatgggctttccactcacagaaatggatagaggacgcagagaaggagcaacaggccgaagatgggctctgtcgagccagacctgggtttggtcgaacccatggttcggccaaccactaccacagccgttcgaactggggcttcgcgtggatggtctagatgagctcctaaatgacggttggagggcagaagtgtcttttcgcgttccataaccatcatacctgttggtgataagccctagaggcaatcatagagatgattgtatcacatactatatttacatatttatccgatattgttccttgaaatagataactcattattggttaatgaatatgtgattctttcatgagactctttatgttgtatgctactattttggatgaagcacaaagaacaactcgcactaaggtaataaagttgtttaaagtccaatggaatcaccatacagaggaccaagcaacctggaaacgggaagattatttacaattggaattcccgtatctttttgaagactcctaagcaaatctcgggatgagatttatttaaggtgggtaggtttgtaacatcctcaaattttaaactaaaatttgactgcatcatgctggcttttgactatattagcaaaattaaaatcattgttatttgaactctttttattcttaattttggttcaagtattatttctttagaactcttttaacctaccctaattatttcctttaccctaaaccttagtgaatgttggcggatgttaaatgcagattctataccgacaacatctgcataaagttcagataataaaacatccaatatagtgataggtgcttaatctcacatattccacaagtgttcgtgtatatgtatatgcaggtgtcggtgacatggggccgggggtatcgtgactagaggcttgggtagccgcggtcacccacgtggcctgaccccctcggggggggggggggggtcgggcccgagggtgacgtggccacccctccctctgtctccccaaggggtcgggccgctcccgtttcggccccgagggctggggcgcccccgtttcggccccgagggctgcgacgccccgaccccctgtggttttggcgccacgtgtgtgagttaggtgagcacagcggggctcacctaaccgcatttataacaggttggacgagcgcgccacgccgcatttaatgcggcgcagcgcacgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaactctggctcgctctccagctctctgtattccttcacgcacagatccactagaacacaggagtagggtgttacacttcccagcggcccgaacctatctacgtcgcccgtgtcttgtgcacttcctctctcgcggacgttcctcagatcgagggcaaagaacctcacttagcgcccccggccgaaccggcaaaggggggcctgcgcggtctcccggtgaggagccccacgctccgtcatctggcgcgccaggtagggggcgcgcgtgtctttttaagccctcgtcctctttcgtgtgcaccaagcttctcccgctcagcctaatggccgaacgggcagtggcgcacagcctctctccgaacgctagcggtgacgacggggagcagaacccgcgccgtcgggctcgcaccccaccgtccccctctcactgaaatcttgggcggggggaggcgctcggggaggtcgaaggaaccgcgacttcaccgcccgcgggcgacgggggaggacggcgagacggggcgtgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatggcggcgcagcagcgcctaggcgccggcgggcggtcctccgccaccgagagcctctggcgctgccgccgccggctccatgtcgtcgaggcggagggcgcggcgagcggcggccgttacccgccgttcgtccgccattccctcgtcaacgcctccgacccaagaagatgtgcgtggggggccggatgcccgcctcgatatcgagcggcggcgcgacgcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggccccaaggttccggccccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgtggggttggctaatgaacttgccacccgcgtcggtccactcttggaaggatttgtgccagcagttcaccatgaacttccagggcatatatccgcgcccaggcgaagaagcggacttgcatgcggtacagcgaagggacgatgagtctcttcactcgtacattcagcggttctgtcaagtccgcaacaccataccgtgcatccccgcacacggggtgatctacgcgttcagggggggcgtacggcgcaaccgcatgctcgagaagatcgcctccaaggagccccagaccaccgcgcagctttttgagctcgcggaccgtgtggctcaaaaggaggaggcctggacctggaactcctccgattctggtgtggcagcttcggccgcccccgggtccgccgctcggtcagggcggcgggacaggaggaggaagaaggggtcggcccgttccgacgacgagggtcacgtcctcgccgtcgagggcgcttcgcgggccccccgaaaggggaggcctgtgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaagcaggagcgctgtgagggcaaaaccccggcggctcccaccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggacatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctaccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacggctcgtccaagaccacacgaatcggtggtcttctggacgacaaataggaagacgcgctcgtctccttcctgcgggcaaacgccgacgtcttcgcctggagaccggcagacatgccaggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtgaagacgcgcaaccaagagaccttactctcggatctagcggaaactttcggaagtctccgctccacccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcggagctggccctccgcctgcttgtccgacggtgccaggcgcccccgacccccaggatggccccggggccactgcgggaaggctgcgcctgtcgccctctgaccccgaggtcatcggcacagaagccgagtgcgccccgcgtggcctctcggacgaagagcgccctggagatgcggcccctggcgaagaggattggccccgccgaaaggtgcagcggcccgtatacttcgttagcgaggccctccgggacgccaagacccgataccctcaggcccagaagatgctttacgctattctgatggcttcgaggaagttgcgccattatttccaggcccatcgggtcacggtggttacgtcttacctcctcggccaaatcttgcataaccgagaaggtactggacgggtggtgagatgggcaatcgaactctctgaattcgatttgcgctttgaaccacgccacgcgatcaagagctaggccctcgccgactttgtggcggagtggaccccagctcccgagcccgtctccgcccccgaggccagctcgggcccctcgcagctgcctcacaccgcctactgggtgatacagttcgacggttccctgtctcttcagggcgccggtgcgggggtcacgttgacctcgccgagcggagacgtcctcagatacctggtccgcctcgattttcgggcgaccaacaatatggcagagtacgagggactccttgcggggctcagagtggcagctggactggggatccgccgcctcctggtgttaggcgactcccagttagtcgttaaccaggtctgtaaggagtaccagtgctctgacccgcagatggacgcttacgtgcgccaggtgcggcatatggagcgccatttcgacgggatagagcttcggcacgtgcccagacgggataacgcggtcgccgacgaactctcaaggctcgcttcctcgcgagcccagaccccaccgggcgcctttgaggaaaggcttgcccagccgtcggcgcgacccgaccccctaggggagacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgtatcattacggataatggcacccagttcactagtgagctcttcggtgactactgcgaagacatgggcatcaagctctgcttcgcctaccccgcccaccctagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggtggtcctcccatctgagctcaccctgaggtcccctcgggtcaccatgtattgcgaggctgatcaagatcagcttcaccgagacgacctcgactatttggaagagcgaaggcggcgcgcggcgcgcgctaccagcagagcctgcggcgctaccatcagtgccacgtccgggcccgatcactctgcgtcgacgacctcgtcctacgccgcgtccaaacgcgtgccggactgagcaagctctcaccaatgtgggagggtccgtatcgagtgatcggcgtcccccggccgggctccattcggctggccacgggcgacggcacagagctgcctaacccgtgaaacatcgaacaccttcgtcgcttctacccctagtgggggtcgggtgtcatgtctcgggctcgggccaaccccgcacccccccgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaatggggcccagaaccgagccgtttcccggggcgtggtgaactccgggggggaatcggcaaaggcccacaatcgggtcatccataaccctcggtcaccgctctcccggcctggccagtctcgacacgtggatctccccaggcactagccccgacccgcgccgtttgaggctgggacctgggcactagcccttgttcaagccaagacacagaaggaccgcggcacagaccatcctcgtcttatacacacaacaaacagaactgacgcagaaatttcctctttacttgattgcagattaaatcagtctatacaaaaagggggcccgaaggcctcggaagaagaaggaaaagttattaagattggcggggccttgggggctcactccgacgcgcccgggtcgccggcctcgtcgtcgctgtcgtccgcactgtcgtcaccgccctcctcgtcgaagtcgagggcgaacgcgagccgaggggccgtaccctcaaagctgtggacgatgtggtcggcggaatcccggacctgcgcgcgcgcgccgtcctcggttccgggagggaaatcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggtgtacttcgcgtaccgcccgccccagaggcccgcctgctgcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgttcgccagtcgctgcgccgcgggctcggcctcttcgagagttcgcccccgctcggtgagcgcgtcctcgcggaggcggagtgcggactcctctttagcgcaggcggcctcgcggtccgccaggtttctctccttcgcgtccagggcgcgggcgcgctcctccagcgctgtggcgcgagcctcaagggcctcttcgcgctgccgggacgccgccttgttctccgccgcccgccgttcccgggcagcggcggcgtcaaggactccccgggcagcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgtgcgcccacgccgcgtcgagctccgcccgctccgcatgcagggcctccatctgggcacttaacccgtccagcaccgtgctgttcgcggcggccaaggcctgcaggaggggctccgcgctcagtggggcagcggaaggcagaggggagagccgcctcagtgtgggtgccgcgcggctcggcccgccgatcgacgtgccggactcgggggcgtcccccgaacctggctcgtcccaagcgtcgcccgaggggtcgggcccgagcggcgcgcccgcggcctcgtcgtgggtggcctcggaagtcggcgtcgcctcgggcggagtcgggtcgggggtttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggctggacttggaatggcggggagggcgcgacgggatctcgcttaggcagaagaaaaaccagaagacaaaaagaaacgggtgagtgaaaactcgccttgaaaactcgcggtgggcgcggggacgaacctgcggggatgtcggctaaacgaccacctcgggggcgagatgaggctctcccggcatggctcggtccccccatcttgcggagccgtttcttctttcgctccccctcgggctgcggcgtcgacacagcaccctccgggcgcctgctgctggcacgcaccgccccgccccctcggggaggagatgggggaggggtaccctcctgcttcctcttcccccgggcgtcggtagggcggatacccccgggcccccgtcgcggggcccagaagcacgaccccctcccggggtagattgttccctcctgcggctcccgcccgcgccatcgtggcctcggggggcccgctcccccgacgccccgaccacctacatgatggccaggatcttggcgcgctctggatcgcagcagatggggaggaccccttgggggatgagggatgcctccacggagctgagattcagcacccgttggaccaccatcctgaagtcctcagggtccaagtcccatttgcgcccctggtgggtcctcacgtagtcctcgggcccggtgtacacccaggcgccccgggcgcgccgctggagcagcgcgatccggcgatgaaggtagtcaccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcatcccactttttgcggaggacgcagagaatgtagcggttcagcacctgcccccgcggctggaagtagcagccaccgactaccgtcggcggcgacaccggctgtacggtgaagaaccaccggaacagccggagagatgggcgcaccccaataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggtgtcgggcgtccctcgcccagcgcgaccacctcccggccggtggcggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaaccgcatttataacaggttggacgagcgcgccacgccgcatttaatgcgacgcagcgcacgcttatccggtccgtgaccagtcgcggtgtgtgaccggtcacagaccggtcagatcacgggttaggtggcaacaggcggcctgtcacacgcctcgccccgtcccgtcggaatgatgagagcttcctggctctcgtccctagccggagccggcgtgctaactcctggagttggtatgttagtcccggtcagaaccattccaggcttcagcgcaagtatggcaaggaagtcgctggccattaaatgaaggttgaaatgggcgtccaccggaaaagcgggcgagcgggcaggaggcgtgtgctctgcttgtcagaggtcacttccggctgtagactagccctcattgtaaaaagcatgtttcctttcttaggcagctggaggcccttgtggtgacccctgaccagataaaaagggtgcccaggcctaagagggggggactctggagagaaaagagaaaagaaaaaaagaaaggggactctggagggaggagaaaaaaggggaatgggtgctagaccctgaactctggctcgctctccagctctctgtattccttcacgcacagatccaccagaacacaggagtagggtgttacgcttcccagcggcccgaacctgtctacgtcgcccgtgtcttgtgcacttcctctctcgcggacgttcctcagatcgagggcgaagaacctcacttagcgcccccggccgaaccggcaaaggggggcctgcgcggtctcccggtgaggacccccatgctccgtcagcaggtgataaacctcgatgttgggaggaaatctagactaaagtgaggagaattatgtatccatacaaggatgggttatgaacttcatcaaaatacccgagagtcaacccaaaatcctgagaaataggtagagaaggtcaggggggaagatgcgcaaagagccaggccagatgggcctagctgtaacgccccgattttcgttgggattaaaaatcattaaataatgtattttccagaaattaaataaaagttaaagcaatttaatcaagtgaaatattgagggaattaaaaatttcctttaaaaatcattgggcgagaatattttgtaatattctttgtgccctaaatattctctgaaattttgccgtgaattttcggagctcaagaagtaattataataatacaaagttcatttaatcaatttaaataaaaagaaaataaaataatcttccccttcctcccttttgggctcggcccaaattctttcccccttcacctccggcccggccgccctcctccctcctttgggccgccggcccagctcctcccctccctctccctcaagtcctcttttcctcccctaaccggccccctcttgctttggccgacaggtgggacccacggcccctcctcctccttcctctggctagccggctgcaaccgccatggccgcccgagccgccccacgtcaccgctttccccgcccacctcctccaccctgcaccactcctgcccgaccgtgggacctcgtcacccacgaccccgctcccctcccccactccgtcccgcgaaaaaccgccgccaccacccccaagacgccgccccactccccctcgaaatccgccgctccccggccctctcctcgcccccttgagctgtaaaatcaatcctcgtggcctcctcttcctttttccccgttttcccgagtcccccacgccctctaccgagctctccacgtcgatccccatcgccgccgctcgccggcgatctccagccgcgcgccgccgctgctcccgccgtcgccgcgcctcatcgcgtgtgccatcagcttcgccatcccgcgccgcacgccggcctccactcggtttccttcaaccgccatcggaaccacctccccaccatgtaacctctctccgccgcttgccgccgaactccggccgcctctcctcgccacgctagccaccgccaagccgcaccaccgccagtgtcggcttcgccgctccaagcagagcaccggccactgcctcgttccaccaatccgtggccgagtcatcacctccaccacccacccaagccgttaccatcctccgccactccggtcgtcgcctccggccacacctcactgctctcagccaccccgcggccgccattagctttaccaccgcgagggcaagctcggccgcccatccatttttcccctccaccaccagaaccaccttcctgccataccaccctaccggccgcctttttccgcctccggtcgccgttcggcttcaccctggctgccgccgcaacgcatcgccggcttcgccgcgtcccgctcttccccgtccgccgcccgatcgccgccttccgccgccgggagccccttctcattgtcgacctgtggagcgccgccgcctccctccgccggctgctctcgccgtcgccgtgcccctcggtgagctccgccacctccctctccctcactgcctccgtttcctctcgccgcttcccgcgctgcgcgccgctgctccctgtgccgcccgccccccgccgttgctggtgactgcgcgccgccgccctctgtggtcggtcgggccagccccggctgtgcccgtgcccggccaccgctctcctcagccgcccgatcggcttgggccgatctgggccgtccatcccgtggacgggcggtggaccgcccttgtggtcccggtccatggtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtgatggagcggggcgggccctgcgacggcctctgtcgcttccggattcacctaggcacgagaggggattgcccgctgccttgcgaggagtgggggtgaaacctgaggtgtggtgtgcttggctagagagggttatgcgaaggatcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaatgaatcgactcaatgcactgtagttcaggtgggttggttgggcctgttcatcgtggtgtagcgttgatcagtggagatttaatattaccttaattactcaacagttttagtattttgctcaataaaatgttttacaactgcctttatgcaaatagccacaaaccgtccttgtgtccccttgcacgtctgcatcgttggtgtggcttgctgagtacggtggttgtactcagtcttgctattattcccccttttcagaagtgtagtgcttctgagctgaagacgaggttagaagaccaaggctcagaccccagtcgagttttgcctgtggagtggagctgaagccccgctaggatcgcctttttccactgctgctgcttttgtttcggtgtgaggactaagtgcatcttctgtaagtattttacgctttatttacgtttggaactgtatattacttattgttttgtgtaccctggctggtcctggacagggatttaatacacaaaatagtctggaaatttgggctaaatttctgggcgtgacactagcccaggttcagccgaggttcggccgaaccacaatctcagccatccaggctggggtttggcgtggacggtcttgatcatctcctgatggcggttgcggggcatttccgacaattcgcattgtataaccgtcatacctacccctaaatagggtcgccaatgatcgccttggtcaattggaggctgctcaaattgacaccaactccaagttttcctcctcattggagaggtcccttgtggctgtgaacacttctcttgcaggtatcttgaatacattggagagaatgagcaaagatggtcatgatggatcggctaggcgcaaccacaatggccatgatgctaatagcagcatcgcagcaagggaagaactagagtacgctgctgacaccgagcatgatgaggaggtacttggtcgtcaacgaagacaacagtgccggtagcgccatggcatgggcgctccaccacggcgggaggcacgtgataatgatgattctttaggcaagatcaagtttaccattccttgctttgatggaaaatatgaccctgatgcatatcttacttgggagttagccattgatcagaaatttgcttgccatgattttcctgagaataaacgtgttagggttgctactagtgagttcactgattttgcatccatttagtggagtgaatttgtttgttccaatccaaataacactccccaaacctgggatgcaatgaaaagattcatgcgatctagatttgttccttcatatcatgcacgtgatttgttgcataaattgcaacaacttagacaagaaaacaaatctgtagaagagtattatcaagctttgcaaacaggaatgctttgctgtggattggtggaaaatgatgatgctggtatggatagattcatgggtgggctgaaccgagaaattcaggacattctagcctacaaagaatataattcaatatatcgtttgtttcatcttgcttgtaaagctgaaatggaagtgcagggacgaagagctggcttcaggactaacatttctgcaggtcgtgctagctcttggaccccttccaacgctgctgcaccgtcaactcgagcagcagcaccatcgtcctcaagcaacaagttgcgtccctctacaacaaactctacaccatgcccgagtgaacccacaagaggggttgctgctacatcttccaagagctcatcatcagtggcattatcaggaaggacaagagatattcagtgcctacgctgcaagggctttggtcacgtgcgcaaggactggccaagcactcgtgtaatgatcgtgagagctgatggtgggtactcctccgctagtgatttagatgaagaaacctatgctttgcttgcaactaacaatgcaggggaaggcgacgcgccccaccaagatgaggaacacattggggccgaggctgcagaggactatgagagcctcgtggtgcagcgagtgctaagcgcataaatggaaggggctgaacagaatcagcgccacaccttgtttcaaaccaagtgtgtgatcaaggaacgctcttgtcgcatgatcatagatggatgaagctgcaataatttagtgctgaaatggtgaagaaacttgcattgagcacacagccacatccgcagccctactatattcaatggcttaatagcagcggcaaggtaaaggtaacacgattggtaagagtacattttgccattggttcttatcatgattcaatcaactatgatgttgtgtctatgcaagcttgttctatgttattacgtaggccatggcagtttgataaagattccttacactttggcaaatccaatcaatactcctttgtgcataatggaaaaaaacttgtgttacatcctatgtctctttaagttattttaaagaatgaacttgctagagctagcaaacaaaaaaacaggagcatactagcatcatattgtggctaatgaacttgagaagcataagaagaaatccaccaactctattcaaaataataaaaatgagattaagctgaagggatcttgtttcattgaaacaaaatcagatttggatgaagttgacactgacactgttgtttgctatgctttggtttgcaaacaaactttatttccaattgaggatactcctatttctttgcctcctccggtcactaacatttcgcaggagtatgctgatgttttcgcaaaggaggttccattggggctgccaccaattcgagggattgagctccaaattgacctcattcctggggcctctttgccaaaccgtgtaccatacaggacccactcggaggaaacaaaggagattcaacgtcaagtgcaagagttactcgacaaggggtatgtgcgtgagtctcctagtccttgtgctatccccgtgcttttagttcctaagaaagatggctcatggcgcatgagtgtgaattgtagagcaattaacaacatcacaatcagatatcctcatcctatccctaggctagatgatatgcttgatgaattgagtggttcacttgtgttctctaaaattgatttgcgtagtggttaccactagattcgcatgaagttaggagataaatggaaaacagcttttaaaactaaattcggcctatatgagtggttagtcatgccctttggtatcactaatgcacccagtactttcatgagattaatgaatgaagttttacgtgctttcattggcagatttgtggtggtatattttaatgacattctcatatataacagatcaatagaggatcatcatggtcatttgcctgctatttttgatgctctacgagatgcacgtttatttggtaaccttgagaagtgcacattttgcacagatcgagtctcttttcttagctatgttatgactccgcagggaattgaagtagatcaagccaaggttgaagccatacatagctggccggttccaacaactatcacacaagtgagaagctttctaggacttgctgggttctatcgccgctttgtgaaggattttagcaccattgcagccccactacatgagcttaccaagagaaatgtgacattcacttggtctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaagacaaacctgtagcatatttcagcgagaaattgagtgggcctagtttgaattattctacttatgataaggaattgtttgctctagtgcgaacattggaaacatgacatcattatttatggcccaaagaatttgttatacactctgatcatgaatctttgaaacacattcgaagtcaagcaaaacttaaccgtaggcatgctaaatgggttgaatttattgaattttttccatatgtcatcaaacataagaagggaaaagaaaatgtcattgctgatgctttgtctagacgttacacaatgctatcccaacttgacttcaaaatttttggcttgtaaacaataaaagagcaatatgcgcacgatgatgattttaaagatgtgttgttaaattgcaaggagggaaggacttggaacaaatttgttctcaccaatgggtttgtgtttagagctaataagttatgcattccagctagctccgtgcgtatgctattattgcaggaagcacatggtggagggctgatgggaaactttggtgtgaagaagacgaaggatatccttactgatcatttcttttggcccaagatgaggagagacgtggagaggttcgttgctcactgcacaacatgccaaaaagctaagtcacgccttaaccctcatagtttgtatatgcctttgcatgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcatgagactgttcgctggcatggagtgccaaacaccatagtttctgatcacgatacaaaattccttagtcatttttggagaaccttgtgggctaagttgggaactaaacttttattttctactacatgtcgcccccaaactgatagacaaaccgaggttgtgactagaacattatctacaatgcttagggctgttttgaaaaagaatattaaaatgtgggaagaatgtttgcctcatgttgagttttcttataatcgttcacaacattctactactaagaagtgcccttttgagattgtttatggccttctgccccatactccaattgatcttttgcccctcccaacttcagagagagtgaactttgatgcaaaacagcgcgctgaattgatgttaaaactgcatgagaccactaaggagaacatagagcgcatgaatattaagtataaacttgctgggagcaaaggaaagaaacatgttacttttgaacctggtgatttggtttggttgcatttgagaaaggataggtgccatgagctgtttccttatcatcttgttcttgcttgttcttcgattgcttacaggttcaaggttgttcttggcacggcaagaacagcaacaacgtggagtcggtgtaccggttgctaaggcgcagcacccctgtggtagttgtagtcggaccgccaacgtcgtgccctcccccaaatcgaagtttatcctcctctcatcaaaagatcgggaacccccgttgctgcatcacctctaccacccctgccatacccaatttccgagctcatcaatggcgttgatggcgcccgagctcatcgacatcttgtgaccctataagtaggaccccaatcccttccttgtccatcatcgatcatcaccaaccataaccccacaaccccaaagctctgctttaccaatccatctcatcaaccatcctcgcccgccggtcgaacaccttgtgcgcgagcgacttcacaccactccatccaccctctaccctaaccaacccatagaacacctatattcaaccatgttctagcatactaaagcctaaccgaagctctgcgtcgacacctcgtcacaccgagccgagcactgccgcccctgctctgctctgttcttcgctgccgagaggtttttccggtcgcaatccgtcgtttcaacctatctcggtgagttcttccattttaaccatcgacatactccttagattccattttcgtaattggttagcactaacatcaccctcttgactgccgacgtgagctcgaccaccgccaatggaggcgcaagtcagcaagtatcttccataccttgccgaacgtcggcaagctacttaaatccttctagacacctcatagatgctctaggaaccttccctgagccatgcctaactctcaccaccccgatcaccttctcagctcatccatgtcaccgccaccctagccgctaggttactcacacaccaaattaacccctccggcgccgctcgccgtcgccggggaaccctatctacctcccctcctcggccgcaacacctttccccctttattactgccataatccctaaccctagcgccgccggccgtaaatggggaacagttggaggttgaagaagagaagagagggagagactgatcggtgggacccacacacaataccatttaacatttaatttgattttcaaactttagaagcccatatattttaaaatatagattcatttccagtgaaacttgaaccaaaattcttctaaaatcattctctatcttttgagaccacttttgctatttttatattttattttatttttacctatttttggattttatttgaatcccttttgaatttgaattttacatgtttaacccttggtcttgaggaatcttatgacacattagataatatcagtcaatctcaggacatcgagcaaggcaagttactatacacattttgatcgtttaagcctatattttacaagttatttatttataacctttctactcaatactctactttcacatgcataattcaaccatagaaacccagataatttagtattgcttattttgcttacaatctggttaaaatgttttatacttagattgggacaggacatacgaattggatgatttccggatggctagtactgtctcgatcgatataagttgtcaccaggtacttatgtcaaacgaacgggtgcgaccgcagtttctagaatggggactgacctagtcattatgttaattagcaatgtggtacctctgtatagtggctcttattgttaagtccttgagcaggaggcaactgtcacaccctgaagttcttctcccaagccaaaattgaatttataattggtctcgagaaaataccggtgtaaaagcaagagtgaaaccctaaataaattaatgcaaataataatcggaattggcatgtggaatttttcttgagctctacatgtcgaaatgtgctaacaagatttttagtggaattttcatagctctagaaataattttaaccaatcaaaaatgagcacaagcaatatttaatcccaagaaaattcatttcctcctttttctttttctttttccccttattctttttcgaatgggccgccggcccattctcttcctcctccccctccccgctgggccgaccgaaggccacgacccagctgagccggccgcccgagcccctcctctctcccggggtcaccgacaggtggggcccacctgtcgggcccgtctcccacctccagccgcgccgccgcatcccgcaaccgccgccacccctcgctcccacgtctcctaggccacgtcgcccacgtcgccgctcatgcccgccttccccgcgcccactccctctctctcccgcccgcgcccgcgctcgagacggccgggattcaatttttgaatcccgcctctctctcctccccacctctccccactccgccggcaaaatcgcggtcaccccggccacgatcgacccccgcgggcctatataaaggttccccgttccctcctctctctttttcgttttgcaaccatccgttcacgtgccctccatcgccctagcgccgtcgtcctcttttccgccgccgccgacaccgctccggccgccgctaccgtcgcaagccgctgcgccgagccgcgccgtagacgtcgtcgcgttcgccgtcgtgcgggccacctcgtccacccctctcctgtcagattccgccgccggaactcactccgcgccgtgcgccggtgagcactgccatggccgccgccttcggccggcgtcctcgccctcttccattttcctctccatctctaaccccttgcaccgtgttcgctaggtggttccggagcttgtcctgtcgccgtcatcgccctccgtcgcttgccgtcgtcaatcgccgtcggtgagacacctcctcccctctccccttcctctctctctctcccgcgccacttagccgccgcgccaccacctagccgcttagccgccactatcgccgtccgcgccgtcgcaccgccgccgctcatcacgccgccatcggtcgccgccgtctgccgccgccgccccgcgttagcgccgccgtgcgccatggccgccgggccggcttgagccgcccgagcgcgccggccgcgtgctccccgccgccatccgatctaccctcgggtagatcggggccgtcggttcggccgcccgcgtggcgtgccacatggctgccacgtgtgcgccacgtcggcgccacgtggtgcgccgcctccttccccggtccgtggacccggtccaccgtggaccgccacccgagtcactgccatgtggggcccgcatgtcggcgccgtccctcccttgttgacgtcagccctgggatatattgcgcaataaatcaattaaggatttttctgtttaaagtaaaaacacagtgaatcttctaaaattcatatctaattcatccgagcttcgtttaagcctattcaagtcgcagtaaatcaagaaaaatgcataaaatccattaaaaatgcttttgttctctgtttcagtagtcttatagcctgtttgcattgtttgctttgtatgtcgcttagattccggctctcctgacgctccggtgtactttgaaatagtcgccgaggttcctccagcagcagagcaaggcaagtcatgcttgtcacttgaacatgttgatcctatattgcaaatgctctatcgttttcctttaaaaactgcatcgttttataatgttactatgggatctttacctactgttacagccatgctatttctgtaccatgctcctttgttagcttggggatataacatgactagatattggactagggattgcttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatggcaattaaggaccggttcatgggatgccctagaagaacttatcgtacttaccacaagccattgtgggcaacggctgggcttgtagtgtagctttcctctagttgacgcatacaggcaagggtgggcatgatggagcgggacgggccctgcgacggcctctgtcgcttccggattcacctaggcacgagaggggactgcccgttgcccgctggggatgggggtgaaacctgaggtgtggtgtgcttggctagagggggttatgtgaagggtcctgtcacggcctctttccggtatgtcgtggtggcatgtcagtgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattttggtatgacttgctgagtacggtggttgtactcagccttactctattttccccaaaaccccggagtttgagtacgtgtcagatggtggcttctccgaggagtaggcttcgtccgtgccgtcgaggatgcctgtggagtggtgttcccgctgcagttcaagttaaggcttagctccatttatcttttaattttccgctgcatttatgtaagacttttataatgtttgtaagacgttgatctgtatgtcaactttatcgtttgtgtaccccggccggtcctagacgggggttttaatgcacattctgcttggaattctattcgggaatttctgggcgtgacaagttggtatcagagccaaccttgaccgtaggacaatccttttcattgcatgtgttctttgcaattggatttgttccgggaaaattgggatctgttcttgtggttcaagggaaaaatcttggtcgctcatttaatgtgagatttgtcaaattaggtcagtctagggttttagtaaaattatttgaaatttattcgacagtcagtcgggatttgatgggaggaatgcattaggtcctaactcaggaatatgggttgctaggtatttatgctcttattattattattagtatgtatctaatttctcattattttatcgctatgtaagtccgtcttatttattcgctctcatgcaaaaatgatctatttgagttttaattgacaaaattctgctctcatttgttcattttaattgagttttttttactgctttatttaaattggatttgagcatgcattgatcctacccctttgtcttctctagatggccgaccaccaacccaaccaccgcggagacggcatggatgattttgtggctgagttggctcgcatgaccttggtggtgggctaccccaacgcgccggagtactcgaccgttccgccgctcagtggcgagcttccccaccgtgttcgtctggaggttcattgctatttgggcaccagcctcgctaacatggtggttgaggcatctggaggcaccgcagatcacgcctatcaggaggcagcatacctaatgatggccaggcttcgtgatcaccacagctacatcttctgcaacacggcgtaccgtttccaccctcgccgagcaagtggcaacgatatcagcaccttccgcccgacagtcggcgagaacgacaccaccttcggccacatgtgcgccgtgatgaggggaatggacaggatgcactctgacctgcacaaggcatccaaagccttgaatgatgggaagcttgtgaggatcatagctctgaaggatgagatagcacgcctgaagaaggagaacgctcagttgaagggtctcccagcgccaggaggagtccggatccgcaccacgccccgcaagtcgacgactacacccgtacgcattcagcttgcacacagggacccacctcctcccgcagtgtcacgctatgaaaatcgcctattttaaaagcttacaagttaaacactaataacctaggaaaaatttcaacataaaattgagctagataaaatttcattaaatactttgcttgtttatctattttctagatttttctgggaattatttgagcaaggaaagtatttttaataaatgaaacatcatttcgcgaattattttaattggaaaagtttttaaaatcgtctcctaagccgttgggctgatttcagcccaacatctctctccctcgcgcgcgtgctgtgcagcccaagccggcccaagtcgagctgcccttttctttccctgttctgttctcagtccatccgaaagtctaatttgcttccctttgcactgttcattttcaacctcaggacagccgaactgagaccgagtgggctcggtttttcccctccaaatccgacctctcttgtgttttcctaaaattagttgaggggaaattatctcctccttatcctcttcctttcccctaaagtctcggagattaattttgcccggataaaccgaatcgaattcgttttcgagtttatctctccaaactaaccctcggattttccagctcaaatcctctcatttggagtccgatctctctagtccaagcctatataaagcatccccttgtcgtcctcttccgtttgcctcaagtcccaagccgagccgtcgcccgtagcgccgccgccgagtagctctagcgccgccgccgccgacgccgctccatccgcgtggcgccgccgctagcgtcgtcgccgtcgccgtccgtcgccgccaccgggttcgcacggtggaggagcaccccgtccgccccttcgcagctgccaaagaccaccggagcgccgtcgccgtcggggacccgagccgagccgtcgtcggacctcgtcgccggccgtcgttcgtcgtcgtccatcgttgttctttgcacggtgagttcgcgtcgtcgtcctcttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagtttccgacgttccggaggagagcgtttacgttgaggaaggttcagaagcgtttgcggaagcttaaggcaagtcacacagatcccaaacaaccctttgagcatgttgaacccgtttaaagctaatgttttatttcaacttatgcattattttcgaatgtcatcgggtggtgagcctttcccaattaattaatggccgaaaatgactttatttttcctatgggttataatttgattagctagaaccttatatattggtttggttcagctaaatgctatatgtataattgcttagccatgcttagaaacattagctcattaatgggatgaatcatactacattattaattatggttatatctaatggtagctcacgatggttaatcttgttatgataattaattgataattaaaagctgattaaaggtgggttgtgagcatatggttttgatggttgtgctcatgacaattaaggaccgattcgcgagctactgttgtgaaacattaatcgtgccaaccacaagccaacgtgggcaacggctttaccttttgtatagcatggttcattacggggtgccagactgtgaagcggcgagaagtccgtaggggtcgctggggagtccattgcctctggttttgagggggagattatgatccaggaatggcgcactgtggtgagttgtgttgtgtgagaggtattgtcacggttcctttccaaggtatcgtggtggtatcgaggcgcatggtaacatattgtggagctgtatcttgtgggtatagtggtacatctctggccagagtaaaactattcgaatagccgtgcccgcgattatgggtgagtttaacaatgtttttcgtgattagtatcgcactactcattaatgataatactgtgataattaatttgactcttggtttggaatggtatattcctggtatggaggtttgatctgtacaaccggggttggttgttcagatgaggttgggcctatgcaacacgggtgtgttgtatagtgtttatttaatattgcttaattactcaactgttttactattctcaaatgtttattaattgttgttgatgcaaataagctatataatgtcatcctttgttatcctatgcacttgcatatttgctgtgtggctttttaagtatgtcatatgctcattcttgcaatattcattcatcagaggaggagtacttcaatgaaggtgatgatcaggaggattaggctttgttcgggtcaagttgcttgtggagtggagtcgccatagctgtttagtcttttgtttttatttccgctgcgtagaattttattctttcgagaggaattgtccacctctgtaataattatttaatttgcgaatattaattaattgtttaatagtactctattatcaatttgttattgtgtgcctcggctgattcctggacgaggatttaacacacatgtaagcgtttggaattttggatagaaattccaggcgtgacacgtagctcctccagcacctcccgcagttcccgcagcgctcgcagctccagctccggttccggctcccgttccagtgtcagctccggcgtccgctctctccttctctccagcgtcagccgccaggggtccagccagtggcaacggaggttggttgcctgctactcccagtggcagccgcgaccacagcagcagcagttccagtagctccgagccggacagcggcaagacgtatctgccagactccaggagccgctcagagggacccggcgacgagcaggaggacgccttctactccaccaaccgcaggagccgttccgagcattaggctcgttttcccttagtttatcgactgcttagtaattgcctgttagtttgtgtgtctaggtttgttcgcttgtgggtcagtcgacggtcgacatcatgtgcctatgatgtggctgtcttaataaggattttgcttgctgttttaagtgttttaattcagatcagaacaattgcagtttaaattcctctataataaagcttagttcctgagcatctgtttttcttcttttccaccccctccgtctgctcttccttcagatggtcaacatcaggaatggcagccgcgcagccggtgagggcagcaatggcgaagagcacaccgacagtggatatcccaacagcgcctctggcaatggtccgccaccgctcccagagaacccgacgcttgcacaagtgatggcccatcagactcagatgatggcggccatgatgcagcagatgctgcagcagcaccagcagatgcaccagaggatgtagcagcaagtcgaacagtagcagcagcagtttggtccccctccccctcagtccaagctgccgaagtttctacgcgtcaggccacccaccttctctagcaccaccaaccccatggaggcgaatgattggtccatgccatagagaagaagctcaatcttctgcagtgcaatgatcagaagaaggtcacctacgccacacaccagctccagggtccctcgtcagcttggtgggacaatcacatggctacccgtccgccaggtacggaggtcacttgggcggagttctgtcgcagcttcaggaaggcacaggtgccagacggggtcgtggcacaaaagaagagagaattctaggcactccaccagggcaacagggcagtaactgagtacctccatgagttcaatcgccaagcgcgatatgcaccggaggatgtccgcactgacgcggagaagcaggagaagttcctagcaggcctggatgacgagctgaccaaccagttgatctctagggattacgctgacttcgagaagctggtagacaaggcaatccgccaggaggatcagcgcaacaaaatggacaggaagagaaaggcagcgcagttccggtccaaccaaggaagtcaccagcgaccgcgcttcactcccggacagcagggtggacctaccaccatgattgtccaccagtatcgcccgttcaactcaagtagcttccaccaggtcgccagtggcagccagaaccacccgggaggtcagcccaaccgcagtgcagctccgcgcccaccaatggccacagcacaggcagctccatcagtccaagccaagaaggagactggagtaaagccagggtcctgcttcaactgtggcgagcatggccactttgctgacaagtgcccgaagctaaggcgtgctgggccaaggtttgcccaagctcgtgtcaaccacgcgtccgcggaagaggcgcaagcagcactagaggtcgtactgggtacgtttcctgtcaactcaatttatgcaacagtacttttcgattctggtgcaacgcattcattcatttcaaagaagtttattggggaacatgggctaataagagaagagcttagtacaccaatacgggttcatacccccgggaatagttccacctcggtttaattcagcccttctgtaacaatagaaatccaaatatcaccatttctagccaacctcgtccttctcgaatccaaagacctagatgtcattcttgggatggattggctgaccaagttcaagggtatcattgattgtgcgaatcgcacggtcaccttgaccaatgagagaggggaaacagtggtgtacaagtcaccagtcgcactgaagcagggaatctccttaaatcagattgaggtggagaattcggtggtcaccgcggagaaaagttcgaggaaattggaagatatccccatagtctgcgagtattcagaggtgttccctgaggacctcactaccatgccacccaagagagagattgaattccggattgatttggcaccggggactgctccaatttacaagagaccgtacagaatggcagccaatgagctggcagaggtcaagaagcaggttgatgagcaactgcagaaagggtacattcgaccaagtacttcaccttggggtgctccggtcatttttgtggagaagaaggacaagacgaagagaatgtgcgtcgattatcgcgcactcaatgaggtcacaatcaagaacaaataccctttgccacggattgatgatctgtttgatcagctgaaaggagccaaggtgttttccaaaatagacctacgatcaggttaccaccagttgaggattcgggaagaggatattcccaagacagctttcaccactcggtatgggttgtatgagtgcacggttatgtcttttggacttaccaatgcacctgcattcttcatgaatctgatgagcaaagtgtttatggagtttcttgacaagtttgtcatggtgttcattgacgacatacttatctattcaaagtccgaagaagaacatgagcaacatctccgtctggtactcgagaagttgaaggagcaccagttatatgccaagttcagtaagtgtgacttctggttgtcggaagtcaaatttctgggtcacgtcattactgctcaaggtgtggcagtggatccatcgaatgtggagtcagttaccaagtggaccccacctaagacagtgtcacagattcggagtttccttggacgtgcgggttattaccgtcggttcattgaaaatttttccaggattgccagacctatgactcagttgcttaagaaagacgagaaattcaagtggacagccgagtgtgacaagggttttgaggagctcaagaagaaattagtgtctgctctagttctgaatttgcccgaccagacgaaagacttccaagtctattgcgacgcgtctcgtcatgggcttggatgcattctaatgagggcagagtggtcgcttatgcctcacggcagttgcgtctgcatgaaggaaactatccaacacatgacctggaattggcagcggtggttcacgccttaaaaatctggaggcattacctgattggcgatcgctgtgaagtatatacggaacacaagagtttgaaatatatcttcacccaacctgacctgaatctccgacagcgaagatggttggagttaatcaaagattatgacatgagcattcactaccatccgggcaaagccaatgtggtggcagatgcattgagcaggaagagctactgcaatgctttgtgcactgagggcatgtgtaaggaattgcagcaggagcttaaacatctcaacttgggaatcgtagaacacgggtttgtggctgctctagaggcacggcctacgctcgtggatcaagtcagagcagctcatgtaaatatcctgagatagctgaactgaaaaagaatatgagggtcggaaaagcccgggatttccacgaagatgaacatggcacaatctggttgggagaaagattgtgcgtacctgatgacaaagagctgaaagatctgatactcaccgaggctcaccagactcagtactccattcatccaggtagtaccaagatgtaccaagatctcaaagagaaattttggtgggccagtatgagaagagaaatcgctgaattcgtcgcactctgcgatgtttgtcagcgagtcaaagcagaacataagaggcccgcaggactgcttcaacctcttcagatcccggaatggaaatgggaagagattgggatggatttcatcacaggtttgcccaggacatcatctagccacgattcaatttgggtagtcatggatcgactcaccaaagttgctcatttcataccagtgcacgctacttatacaggcaaaaggttggtagagctctatctctcaagaatcatgtgtttggatggagtacccaaaaagatagtatctgatcgagggaggtagttcacctcaaaattttggcagaagttgcaagaagaattgggtacccgtttgaatttcagcacagcttaccatccgttgacagatggccagaccgagagcgtcaatcagattttggaggatatgttgcgagcctgtgcgcttgattttggaggagcttgggataaaagtctgccttatgcggagttctcctacaacaacaattaccaggctagtctgcaaatggcaccgttcgaagcgttgtatggccggaagtgccgcacacctctcttctgggatcaaacaggcaaacgtcaactgtttggaacagaagtgctaacggaagcagaggagaaagtcagaaccatcagagagaggctgagaattgcacaatctcgacagaagagctacgcagacaaccgccgaagggagctcacttttgaagcaggggattatgtgtaccttcgtgttactccgctccggggagtacaccgtttctagatgaaaggcaagttggcaccacgcttcgtgggaccatacaaaatttttgaacgaagaggagaagttgcctatcagctagaacttccatccaacatggtcggtatccatgacgtattccacgtgtcccagttaaagaagtgtttgacggtacccgaagaacaagccgattcggaacacattgacattcaagaagatctgacatatgtggagaagccagttcacatccttgagaccagtgaaaggaggactaggaacaaggtcaccaggttctgcagggttcagtggagccaccactcagaagaagaagcaacctgggaaaaggaagatgagttgaaggccgcccatccgcacctcttcaccagctcttccgaatctcggggtcgagattccgtttaagggggtaggtttgtcacaccctgaagttcttctcccaagccaaaattgaatttacaattggtctcgagaaaataccggtgtaaaagcaagagtgaaaccctaaataaattaatgcaaataataatcggaattggcatgtggagtttttcttgagttctacatgtcgaaatgtgctaacaagatttttagtggaattttcagagctctagaaataattttaaccaattaaaaatgagcacaagcaatatttaatcccaggaaaattcatttcctcctttttctttttctttttcgaatgggccgccggcccattctcttcctcctccccatccctgctaggccggccgaaggccacggcccagctaagccggccgcccgagcccctcctctctcccggggtcgccgacaggtggggcccacctatcgggcccgtctcccacctccaatcagtgccgccgcccctcgctcctacgtctcccgggccacatcgcccacgtcgctgctcgcgcccgccttccccgcgcccactccctctctctccctcccgcgcccgcactcgagacggccgggattcaatttttgaatcccacctctctctcctccccacctctccccactccgctggcgaaatcgcggtcaccccggccacgatcgacccctgtgggcctatataaaggttccccattccctcctctctttttcgttttgcaaccatccgttcccgtgccctccatagccctagcaccgtcgccctcttttccgccgccgccgccaccgctctggccgccgctagccgtctctagccgctgcaccgagccacgccgtagacgccatcgcgttcgccgtcgtgcgggccaccctatccacccctctcctgtcggattccgccgctggaacccactccgcgccgtgcgccaccgccatggccgccgccttcggccggcgtcctcgcctcttccatcttcctctccctctctaacccctttcaccgtgttcgctaggtggttcaggagctcgtcccgtcgccggcatcgccatctgtcgctcgccgtcgtcaatcgccgtcggtgagacacctcctccccttcctctctctctctctctctctctctcccgcaccgcttagccgctgcgccgccgcctagccacttagccgccgctagcgccgcccgcgctgtcgcgccgccgccgctagccgtcggtcgccgtcgtctgccaccgccgccccgcggtagcgccgccgtgcgccatggccgccgggccggcttgagccgcccgtgcgcgccgaacgtgcgctcccctccgccatctgatctaccctcgggtagatcggggccgtcggttcggccacccgcgtggcgtgccacgtggccgccacgtgtgcgccacgtcggcgccacgtcagcgccacgtggtgcgctgcctccttccgcggtccgtggacccggtccaccgcggaccgccacccgagtcactgccatgtggggcccgcatgttggcgccgcccccctttgttgacgtcagccctgggatatattgcgcaataaatcaattaaggattttttctgtttgtagtaaaaacacagtgaatcttctaaaattcatatctaattcatccgagctccgtttaagcccattcaagtctcagtaaatcaagaaaaatgcatagaatccattaaaaatgattttgttctctgtttcagtagtcttatagcatgtttgtattgtttgctttgtatgtcgcttagattccggctctcctcacgctccggtgtactttgaaatagtcgccgaggttcctccagcagcagagcgaggcaagtcatgcttgtcacttgaacatgttgatcctatattgcaaatgctctatcgttttcctttaaaaactgcatcgttttataatgttactatgggatctttacctactgttacagccatgctatttctgtaccatgctcctttgttagcttggggatataacatgactagatattggactagggattacttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatagcaattaaggaccggttcgcgggatgccctggaagaacttatcgtacttaccacaagccattgtgggcaacggctgggcttgtagtgtagctttcctctagatgacgcatccaggcaagggtgggcgtgatggagcgggacgggccctgcgacggcctctgtccttccggattcacctaggcacgagaggggactgcccgttgcccgctggggacgggggtgaaacctgaggtgtggtgtgcttggctagagggggttatgcgaagggtcctgtcacggcctcttttcggtatgtcgtggtggcatgtcagcgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctccgaggagtaggcttcgtccgtgccgtcgaggatgcctgtggagtggcgttcccgctgcagttcaagtcaaggcttagctccatttatcttttaattttccgctgcatttatgtaagacttttataatgtttgtaagacgtggatctgtatgtcaactttgtcgtttgtgtaccccggctggtcctggatgggggttttaatgcacattctgcttagaattctattcgggaatttctgggcatgacagcaactatagccacgaagggcaattttttccattaccatgtacaggtaaatggtctatgatactcgagtataattatgattataattctaaaccctgattgagatgacgtgtaatggataaggcttaactcggtgctcagtctagtcctgaataaaaggacacggatagagatggatgaagtcgttgcgacgatggatatctctgaggcaaatgaaagctacacgagctacggctcggcagtcgagatgtctaggcaaatgaaggctacacgggccggtgtccgttagtcgagatgccatggcactggactagtacgcgggtggtctcacccctatgtgtgtggcgcacccggtctaggtcctgttgctaggggctcaatcctaacctgcctgtctcgggataccggccgtaggcagggttgggtcggttcttttgttcatggctaggatgggtgaagggttattgtgggtatttcttaacgacattgctggaaatataattcccaacaatggcgcagaaatacttctggtatattatgtttacagagttcatccgcaagcgcacggatataccattatagcatttcacccaagagtattccaagggtatcgtatttattttatcctgtgggaagatcatgtagagagagcttgactaataatttatatattacttgtgataatcatattctaaacaggggttaagataatccaaggatagagtaacagacaagcatgaactactcattctcataataactcatctaagctaagtggaaagaaaagagaaaggaaatctattcctatacttctattatacatagtatacatatattctagttaactgatatactagctaataccctatatccgatgccctcttggtacttcgagaagccacccctgactgccgagttccttacgacagcccgtcatgaccattcaaccggggctaaatacggaggaataccctccccaggaaattaacttaggattatataccggcgcggaggaatacctgtactgagctgtcaccatcagcggcccacctctcatctgcaatatataacctcaaataatgatatcccgtaatctagacaccacgtctaaactaccagatactactctaatatcatcgtcatgagatagagtaattgcataagcaaacattatacccgcaccaaagcatctcccaaataagctagccgtatattcagtgtaacatgaacataatgtaaaattggcattcatatactcggaaagtgtttcaataccataaatgtataaagaagagtattctaataaaagtacaatgcttacaaaagaaaagagaagagctcttccgaaggcttccggacttgatttctactctattcctattccaccagctagatactactaaactaaacttgacagaaatgagaaagctattgcttgaggtctatgagtgaagtgagaatggcaactccttatatagcctcacaatgacggttgtgacggttggaatggtcggaaataccctccaaccgtcattgggggctaatccacaccgtccaggcgaagccttggatcggatggcgctgaggagggttcggccgaacctggggtcggcccaatccagcccaatttcggcaggcggcctcctctgttgcttctattcgctgacttgtcaattttggcccaattcttcgtatcaattctgagttcttggcctattcatacgtaagtctggttctcgacatcgtccgattgatttgtcatctatgttgatgtcgattctcctccactttattgtcattctctgcaaaaggttaatatacctaatactagtggaagtttattattctaacagatatatgcattgcaaacatcactagttctcctctattttagtaatattgacggttgaaactgatcgataacgaccgtcaacaaaaccccccaagcttgaacctttgctcgtcccgagtgaaggacgaaaggaaacaaagacttggttgttgatcatgagttgctactatgctgcatatctcaaagatataggtgcaaggtatatgtactctctctcggattaaataatctttggcacgatggcttacccttacccctgattcccacgagacactgcttctccttgtcttgggtggttgaaagacagaacagcaatttagagtaccaatcacccaatctttatttaactctcattccggaagttttcaatgattttgctaaagaaagccaagtttctcaaatgattcgctcagtctgtctaagtgtatcaatatgaattcctcaccaaatgttgcctttttgattcctactctaaggtttggtatgtggagctcggtagggatcaaacatggcatacttgcattcacatttattactaagtcaaaaacttagactaaagcagataactaaacatactcaagatcaagatcgtgcaaaatgtgtgtgtagtatatggtggaaatggtatatgaggaaagataaaagaaaaatgcttcccctttgtgcttactttcttctcccaaaatccttcttttattgattaggagagagcatagctacatatttttttttaacatcatgctcatgcttgatggagcataactttattttttttatattttttcatgaccatgcctttccctccttttctttctcttttttttttcaaaaggacttttctctttaggggaagaaagcacatgaaagcatggagaatttattttggtggtaatatggaaatggaatggaatattgcttagctcccagtgtaggagtttagcatgtgcatatatgtgggtgtatgatcttgatcatagagcatgagaagtaactacacaagtcacaagagtttgacaaagttcattggaatgacaagtaaccaaaatgtatatggtttaatcatgatagcatattttttggctctggtaggaatttatatcaaatgaggaactttcaattttatcattttgaaaaacaaaacatccggaattcaagtcaaactagtatcaggatcatagcaactcatattactatctcatatctcgcaacaacttagatttagatcagcaagtgcagcccatttacctcaggttcccggataattgttggctacttatatttaacctttgagagagcacttaccaagaacccatatatcagagatataaaacagagcaactattcatcatttcaacaaagagaactagcttgtcttacctagcatgactcaatcctatcctatctttttggtatttttctattttgcaaatttttatgttgttttcaagttttgtaagatgcaattagaaagcaaatatgcaatttggaaaaggaaatatgcaattggaaagggaaatatgcaatgtgatacaagttacctcagtggggggagagatatctccccccaagcttggctttcgctcagggtccttgatgcggattgaacccctgaaaacgaaagtacgcctgaaggtcatcgtgttgttgctgcatcatattgttgatgttggcgaactgagcatcagcagattgttgccattcttacgtttgagctatgtgttccgtgaagttgtactggatctcccctgtctgcatatcaagggtgtccattctcctagtgatttcacctaagtcccaacaagaggaactcgagcgccattcacttggagatggaggcacaccacttgatctgggaggttgattgtccccccattggatgtcatgaggcgcatgccaccggtcctcactggcacttgcccaggttgagactccaatgctatggcgtggagcttgggtccatccgggtgcatccccggttggtgcccaacctgcctcatacatctgcacgggtgtcaaggatgatgaactttctcgtttcatcattgtcatgttgcgcgtctccctgtatgttccacctgcacgaggtttttctatggtctacaggggaatggttagttcatggcagttgtacaaatgataccccgcatttggcaatgggatttcatttgtacaaccggggaaaaagtataccaaagatccatctattccatgtttcagaatatgcccttgcactagataagcctcatcaatacgcggacgagcagctgagataaaaataatttggtcgctaatgacacctagcccttttgctatccgagtaatcagagaagtgcactcaacaggagcagagaactttatactttctaaccattgtcttatcatacatttcacaggaacaattttgatctttctaaccatgatgataatcaattcatctcccctaatgggtctcatatcacctctaagaaacaaagtcatagcaatcaatttgtgcatgagtctaattgtaggattatggatatcatttgttctagatttcttgcaaattggagcaccagaaatatcttcccaaaacctatttgtctcgaacctagaaattcctttctggagatcgattttacatgaatcgtgaaaaccaagaagtgtacttaagcctttccatgtaagtgtgaactccttatggaaaaacaaaacgaaataccatattctatttctttcaaagtgcacagaaattgcaaagtaagcaaacgagaaccaggctcatctaccacagcaaatctctgccaaccaaccgctttccaaatagaacgaaattcaacatccatacctatctttttcagcagctccggtgcgtgtcagcatactcccggtcgctcagcatatagtagacttgtctctcccgatcactgacaaggtcgaggtcggtgtcgttcaggagtcgtcgcggaacttcggcatcctccatcgaaacatcagctgatgaacgagtactagactcgtcatgatgacttgatgaagagccggatcccttgaatagacgagacagtcgcctcctcattctgtacaatgaagcaagaacggactaactcgacgggggttaggaatgacaagagtttcacccgccagttagtttcaccaaagcaacttgtataaatgcaactaagtgatttgaatttgagggaaactatcaaagcttgaatgagcttgagagcaaactttggagagggaatgaaaatgtgttgaaatggggtacagtcccctctcccggccggttaacatacccgaattctaggattaagaaatttccatcaaaactagttgaaaggaaagttcttcaattttgtgaaccaaaaatttccattttaaatctaggtgaagttgatctaactcttgcgtgaataaaattttagaataaattaaaactttttcatcttcaacctaggactagatgcaactcaagtgaaagcatggatacttgcataaaacatgttttgacttgagtctttcttgtgcatttagatttttggttggcattgcatactaggactcatgagcataaataaaagataaagtttcactaatcaaacctacaaccacacttgagcaataattataaagacatgaaaatgaggttaaatagtatcactatagattaagagtagtctaaataaatttcttacaactatttagatgcatctaagatttggaaatgtccatataaagaaaagaccttgctaattatctaaaataattcgtgcaagataaaattatggaaaaattcatgtaggctctacttaatacatgcaactcactgtaattttggtataatttaataactaaatttgatacctaaaataaatcggtcaaaccagtcaaacagtaggttaattataatccttaatcggctaaaaacctaccctcaataaatgtgcattaaactgcatgaaagtgtatagggaaataatttattcaaatattaggttaattatcatgaataaatataatttttgcagaatttatcttctcttctaagcctcttaaaaattcaaactggtttccaatgagtctatcttctcctaattttttgaacaatctatccataattttttagtacaaccaaataaaatggaaactaggtacattcatctgcctccaataaaatccatgtgaactcatatgcaataaaaattaatctataaattaacaaagaagggagaagaaataaaatcaagaaaaattcctggaatttgcctgagacctgtgtcggctgtgcccacctgcttctggacccaaacttctcatcctcacctaatttgctccgacctgggcccacttgacggtgtcacaagctagctccaactctgtgcataacttttccaccaatctaaagacccacaatgaacgagagagagtgatcggctctgggcgtgcgcgacgcgtggccgagacgtggcaacgccgagccgagcctccttctcttcccagccacatcgcccatcctcactcctcactccagtgccgaccaaaccgagagaacaagctctagctgctttcctcgccttcgatctcaccgccggctgtgatgaagacgacgctcgtcctcgcctacgagtcttcgccaaccctatctcttccacgttccatactcacctcaccatacggaaaatttctccttttgatttcatcctctctcgtgcagcggatcgacgggaacgccgacgtgccctcaagagctccagagcgcgctccaaacgtcgctgtggtggcatcgtcgccgtcgccaccgatctggaccaagccgggccatgccatcgcgccatcgtcttcgcctcgtactcctctccatttcccctcaagaaccacgaagaatggtgctacgagtgtggagatcggccaccgtcttcttcacctccggttgccgtcgccattgtcgtttccgcctcctccggtgagccattgctcgattactcgcgcacacaccatctctctggcctcactaacctcatggacacatttgcacgatagttcttggtgccgattgagccgtcgccgttcacccgggaggttcttgccgtcgccaagccgttctgcaagccaccgctgccgccaagaccacggcaaccttcgctagactcatggcgagcattcttgaggctttagtgtcgcattcatgcactttattcatctagatccagcccctaaagtcacatgcaccaccacccgaaaccatctttcgctcggacccgccgccggcgctactccgatgtccactaatcgagaaaagtagaggaatggaatcgtgagagagttctcttcattttatatttttacctcaaccccaaacgagccaccaatcgcctccggtgaacctgagatcgagctcagccatggctgctctgcctctgtagaagacgaggacctcattttgagaatttaaacaactataaggtttattgtacaatctttccactcaatgacatatatatgggcctaggactgcggattgattcttaaaaactgtaagggtctttctgcatattcgcaaatcactgacagtggaccccctggagataaaatctgagactatacaagagagaaacctagaacttgtaaaatccatataaaatcaaataaagcttattttgagatgattcaaatttctttgaactcactagattatgaactttaaagttatgaaataaaaacttgcactcacagtacaaatttagcctctaaaattcatctaagataaatcatacataaagcatatacaaatttataaaatgcatacaaaatacatttcaactcattttagagcaaacttagtttctaaagatccaccaacatgttctctaaaaacaaagtgaaataaaacatatacacactttacatcaaatgcctctaaaactattacctttaaaatgactagttttagattagctgaactttagaagtttatataaaattcatctcagatcctttttgagtaaacacaagttctatagcatcatagagctatgcacttcaatgttatgtatattaatataaaaagtacgagttcatccataattctgcaatccttcgcgtgggacccacctggtcatctggcccaaagaaacagcaccatatctcgcgcacgaaaaaaaggaaactactcatacgaaaaaaaaagaacgggaaaaaaaaagaacgggaacacgatctaacctctgcaatccccacgccgccgcctcctcattccttcccgaaccgtcgcacatcgacgctccgccgctcctccatcccctcccgctccatcgcgccgccgcaacgccagattcatcgccgcctcatcggcgctgagagcgagggtatcgttgcccctcccctccccatcagtcgccgcgccaccgccccatcgatctccgcccggccgccaccaatctcgcagcgccaacagtcgccgggtccccgtcgccacgcgcagctgtcgttgaagcgagcgccgtcgcatcgatctcctccgcccctctctatcagtcgtcgtgccgtcgaagccatcttcaccgacgctggctcgattgaggcacagcccttgctgaccgacagcgtcgcccgccgctgacatcttcaccatcaccgacctcctcctcggaccatcgcacctcgtcatggttggggtcctctgtgtccgcccgttggatcaccaccaccgtgagttcggagtttgtttgtttttagggctgttcactttaatgccattttcaaccttaccaatttttggtaaagtttacaaaaaaaaaagtagctacatttattttgctgccaaattttagtaactatataagaaattctaccaaaattttggtaaattttggcaaattttggtaactatgccaaaattttgttttggcatcaaagtgaacaggccctttcctttgttttcgtctgctcaggtgaccagctcttcaaacgcttcctattgctatatctgtgacatattgattggtttgggctttaataaacaaatgcaggcaaagaaaactctggatttttctggtgcgtgtgaggattgctttggcaagagctttgtttatgaatccaaccatccttttgcttgatgagccaacaaaccatcttggtgagtcttctaaaggaaatctaagggaaatatgataactttaggaaaatatgatgactttgattattcaatttgatttaatcgacatataaaatgggatcttaatgtactgctgctccctcttgcctttgttatgagcttcttttcacatatggatctatcagtactctaagtattataaaatcagttctaatccatgtggggtattacatgggtagatatggcatgacggaagacgtggatgtggctctggcggtcgattgggtggcaacgaggatgaaccacagctgcgactgcgcccatgcacaaccacaaccaactagctaaggtacaactacaagtcctgcgagcaactaaccaccatgacgcaattccgtttgggcggtgctccatgtggctttccagtagatttgatccccaaattgatatgatgtagcatcaaatgctgtgaatacactttgtgagttttgcctttgatcaagacgaactcctgattatagcgtcctaagccccacatggtgcgtgtcggcatccctttgtcaatttctaggccaaaaattggtgaaaggtttgtcaagtggtctacttttgattggaagcgtggctacttaattacttatatcaatgttgtttatgtatgactgatgctctacagatacagtttgtgttatctaatataactattttttttcttttattttggatagatgtggaaatgaagcttagtaatttttatatttttgttctgtgaaggaaatagaaataatacatgttgtttttca

SEQ ID NO: 71884 - DNA, 49125 bp, Oryza sativa
  unsure (1)..(49125): unsure at all n locations
acttggccgcgcccctcctcgagggcaagctctgcttcgacgtcatcacgccggcggcagcggcagcgggggcggccgggaccgggggcgcgattcagatcccgtgcttcgagaaggccacggagatcaccatccgcttgcgcggccgcctcggcatccagctgccaccatccggcgtcttcgcgaggctcaccgcgctgagcttgagccactgcaggttcgacgaccagggccagcgcgatctcggggacgccgtctcgtcggaggggtgcccgtcgctacgagagctccgtatccgcgatgccgatgtggtgtccaatctagccatccgctcggagtctctccgccttgttcagctgtctcgactggaagggattcgtcagctcaccatttctgctcctgcgcttacagaactagatttgtacgctgcttattgtgggggatgccaatggttgacatctttgctccagcactggagacacttcattgggttgattttttcagttcgagttcagtccgatttgttgagaagcccaacgtccatagactctccgtctatggcatggtgtatggacgtcgaaatactccaggctctctgcaactcgtgcagcattttacagaagcccgcgatgttcatctatctcttgtctatccctctgtgagtgcaccttctccctcttgttgcattacattattattatgatgaagctaatgtacttacaatgtttttgtagctcataaccatttactagtatcttagcataggctcatgcccatttaaaagataaaagtaagataatatttatgggactcctaatcagatgcgaaatatgtaactaggggagatccaaagagtccctatggcatgtagatttggacgtaagtgattatgtaatgcagaggcacattattaaagcaattttccttaggggttgttaggtacttaggttaatccccatgaggaaagcattggagcggattaattccacatctcaatagttggaattaatcccccccaattccccttcaatccctttggaagagggattaaccgaacaaggccttgaagtgtttacattgttttgtccaagccataaagttggaggcttctggaagtttttcctctgtagcattatatttttctctgatacatttctcaatgtcatcacttccttaatccttgtgtaaagtcaaaatgcacatattaagtaattatattttgtgaatttctgttaattttcagatcatggatatgtcctgtgagctcctggtgcaagcagtgaaaaagctccctgccgttgaaatcctatctctgcggttattaacaataggacatacctttggaccttgtgtttaccatttgcttaagatgtctactggtataagggagctgaagctgaagttagaagatcacattgcggtaatgtatacctcttcaatgtaatcaaataccatggtctctgtgaaagtggtagaagtatttgcaatttaatgcacctcagcttgatctttttactatgagtggtactgtggtagcacttgatgtgtcagtcccagtaccgatctgtccctccatggtttatctattaaaactacaagtctttcccctcttcatactacgatctaaaagtttgatccaagtgttgccatgctgctttggttttcaatgataaaatagaaatgattggaatgtcgctgcaaatgttcagttgctggtgattgatatgggtatgttgtggtcgtagtagattcatgtcaatgagacttccaacgaaccatgccaaatgatcaattgaaattccgacaaaaaatattgtaattgtagtcaaagtgtctgctacattttccaattttcttttctttccccctttctccacacatcacatctggaggtgattagatctaaaagatattgctcttatatgaataaaagcttttaatgagaatgatcattttcatttccctatattttcctgacttccttttatctgtgtcctttcgtaatattcttaaaatcaatttcttacatgcttttcatttcaggatggagaagttccttgctcatctggctgcgtttgttacgagccccaggcctggaaaaagaataatatcagcttgaattttctccagaaagttgaaatcaacaatttgagtggagcagagcgtcaaatatattttgtcaaacgactgttgagatggacgatgccagagctcaagacgattactctaagttttgatcctttggttactgtcagcgagaaggtgtctaggaagctacttagcttctctaccccagggatttgcatggaaatttacttgcaccgcaatggaactagggtaaagtatagtgcagcgaactagacctagaggtgattaactgacgatgaaatggagcacagtaatcactgaaaccaggcaaattcgggccttcctttcagatcaactagggttaaggatgtccgtctgtcatgatacaggattgtcgtatacttggttatggttgattgcacgactcacaacttgcgccttaatgtgtgtttacatgctctgaggaaagttttcatcctgctggtgaaaattgtctgatcgaaagtttgttccatttaaatgtgaatgctgcctgaccgaaaggttcaaatatctagtttccaatctctaattttctctcatagcaaggtaagtattgcttgtgctgtatctgtgttttctttgcagaagcatatgacttgttcattctgctccaggcactagctagttcactgttcaatactgctgtcggaggattatatcagttatcatagtgtgaagagctcgtccacctgggttttgaacacagtcgatgtctgattgttccaactccatatatgcatacaccatcaatatagcatactgtcatatcgatgtgtttgtgtttgttatcagataacttccatgtactcatcatctatatgacactattatgtgtttcagtttgaagatagacgtgaatgatgtgatgacaagggccatcatctttgttttcacatcatgccgttgtcggcttgtggtttcagcctggtgacccgccttcaattctcctatacgctgaatttattgttaacttgttacagagttccttcttggttgtcccatgctttttatacaacctttgttccaaaatatagcaacctaggatgggataggttctgtccggatttgttgtaatgtagtgtcgcatgcatctggttcaggttcaggtgatattatggaatggatagagtatgtgagtttgattatgcatttttgtgcagtagactgtgggagagtcatcgccgtcttcatcgccacagatggatctcctccagtgttctgtctgctgctttccttctcgacgatgttcacccatcagagcaccaacatggtgatatatacagtgttgttcgagatcgattaagatgtagacgaagttaggcgcgaaaagtgaaaaaggcattagagtatgattaatctatctatctattatctatctatcttctatctatctattatatactaaaagtccattaatctatctataaacgctcctaagccgtcatgtggcgctcctacaagcactcctaagttgccacgtggcattttataatctcaccgtcgattttcatttaaattagtggacccgttattttagaccgttcgatcagatctatttaaaatttaaatatttatgcttcccgtctataaacagaatccgtttacttaaaaaagaatacgcatatcgaaaagcgtacatggaaaaaagtatacctttacgtactgttcatttttgggaaaaagaacaacacgtacgtatcatttaccggaataacataccatggaaaagacgtttacccaactgttcatttgaaaaacaggacgtacgtacggtaaaaaatgaaaaatatatgtacatgctagaactgtcgtggaaaaatagacgatcattttaaaggattttctatactaacaaaattaaatttattagtccacaaatatggtcacatggcacttctacgaacacttttatacttttataccgtcatatggtactatgtaatcttaccatcgattttcatttaaattgatagacccattatgaaccataggtgatgaaaacaaactagacgctaaagtatagatctttatcaaaacataaacaatgatacaatactctgaaaattctcacggtcatatatatatatttttcaatgatcaaagtattgtatttatactgtataaaaatttaaaaatttaagtagtactgattaacactataaataaattgtgtctacacaaaaacgtcaaaaattctatttttatgaaaagaattattttttatcgcatccatattctctttctttcctgaaaggcatcgtgcagttaacataagtataggagagatatacacatggttgagttgaggcagaccaactagaggccaccgttgataatagtactcaacttcctacttactaatgaaatcatctttgagggtgctgatagtgaaataggagttatatgatccacgctggctttgagaggcatgagtacgccgctatgaaatccatgtttgaaggcaacagaaaaataaatccttggtagctctagcggggatattcatgtctaatttttaacagtattatctttttaacgtagtatttttagaatattcatttatatatttagaaataagagttttgacataaatatttaggtatgtatgtagtggagattaacgttttacgtactaacaatgcattaattatgtattaggcttattttggtgatacagttgtaattccattattaaaaagacatctagcaacaatgataattagtaattttgacaataggtaattttacgtgtaatctaaaaaaagtgatttttatttgaatataagaaacattcttatcgtttattaaagtctacggtctatttcacgacatataatattttagttataatgcgaaatctataatttcttatatgcatatagtgatatacgacttaattctattaacattatttctatcaacaataaataaggtgtccgcgcatatgcgcgggcttcctttctagttatatactaaaagttcattaaacttcctataaacgctcctaaaccaccaagtggcaccctataaacactctcaagtcaccaagtggcaccttaataaatgagagaaatctgaccatctatttttacttaaattggtggacctattattctggatggttagatctattttgtaaataaaaaaaaaaaaggaaccaacaggcggaacaaacgggggagccctaatgggcgatcagtcgcgctccatgcgccccgcgcgatcagttctgacccctctagtctcttctctctactactagtgcggcgggacagcgtgtcgcttggagcgcccgcgttttccttttttttcggtttgtcttgaagcgtccgcgttttccgtttcttttttgtctttttcagtttcttttttttatggttttttctgtgtttttcttccgtaccttccgttctgtttttttctttccatatctttttctgtttttaatacttatgtatgcaaactttatatacgtacaaaatataaattttatatacatgtatttttaggtttttatatgtacgtataccaattttgtatacatgtatataaagtttgtatacacacatataaagtttgtatatgtgtattattttaggtttttatacctacgtataccaattttgtatacgcgtatataaagtttatatacacatttacaaaatttatatacatgtatttttttatatttttatacgtaggtacaaatacaaactttgtatacgcgtatacaaaccttgcatcccgtacgtacacatatataaactttgtatacatgtatgcaaagtttgtatacgtgtatacaaagtttgcatacgcttatacaaactttgtatatgtacatattaaaaaccgagagaaaaaacacaaataaaaatgaaaatacaaaacttagtatacgtacgaatataaactttgcatgcgtacatctttaaaagaaccgaaaaaaagaagagaaaaaaaaagaaaaaaaaaccaaacagaaagataaccggaaaaaaaaagaaaagaaaccgaacaaaaccgaaaaaaaccaaaagagaacgaaaaaagggaagagaaacggaaaaaaaaaaatcccgcgtgggtgccgtccgctgccccctccgcgcgcgacacgtgtccagtcgcgcgggggagggcgcgcgtgactggtcgcccattagctttttcggaacaaacatacgagcgtacgtatgtactgtgtctgtacgtacttcctttatgttgttactttgctattttctatttgatgagaaactaaaattaaaattacttttacaggaaaaaaaatcacaaaagacatactattagatctagcagttctccctcctaggtctagcagttctccctccgtcgctttaaagattctacgaaggcttctaaatcactacatgatgctattaaattagtgaaagtactaaaaatcttaaaaaatataaagaaattgatcattggtttgtacttaaattaatggattagattttttaatagaaaaatcccaaacctctctccctccttgattttttttaaaaaagactattatatattaaaagttcattaaacatcctacacatactactaagccgctaagtggcaccatacaaacgctcctaggtttctaagtggcactctaatccgaccatcgaattttatttaaatcggtggatccattattttattttagaaggttagatttttttttaaaaaaaagcacacatccgaaacctccccatcacgtacgtatcaacgagctatattcatgaggaattaaaatcaaaattatttttacattaaaaaaccatcattaaaaaatacctccacctattaggtctagcaactctcgctctgtcactctaaacattctatgaatgtttctaagctgtaacgtggtgctattaaattaaagagaaaatcttaaaaaaaacaaaggattaggttattgatttgttagtttttcaataagaaaaaacccaaacctctcaacctccttccccaccgccgtgtgatgttaaaatccattaaacatcttataagctgctatatgatgttcttaaattagagaaaaatcttagaaattttggaaaaaaaaaatccaaccatcggatttgacataaatcgatggacacattattttaggtcattagatccttttttaaagaacaccctaaacctcctttcctccctccgtctttgcggcatatggtattaaaaagtctattacacatcttataaatactcttaagatgttacatcgttctcttaaattagagaaaatcctgatacaataaaacaaaaaaacatccgattatcagtttcgacataaacatcggacgcattattttaggtttttagattaatcatttagaaaaacattccaaacctccctccctccctgctcgtgtatagcgtgccctattcttttatctctgttttttatctccttaacaattaaaattgaaattatctatatgggaaaaaaacacaaatggacctccatctattacttatatcccgttaagcatctaacgactttctaccaacttaattaatttcttaacatgcatatgagggctacatacctatacaaattgaccttgatacttttaaaatgatctttttaggagataaataaatatttttaagaaagatgatcatagcgtctgaattacacatatgatctatgaagtcactaatcatagcatgtattcatctagcaatatatagacaacatgttaaaaataaaggtttggttggttgaacatcataccgataagcatgtgggttgcacctaggaatcttaacagtggaacaaccttgcagtggccttagcaataaaacaagtaagttccatataggaattaaagaccatgtccattttttttattttttttttgttaaacttgctacagtacatagtacattgtaaagtcttgacatagaacaatctagaaacatttatttgttatgtgacagtccactttagtgatgatttgctaaatacactatgaccattacttcaagatttcaagagaaaatttagaacgtatgcctttaccccctgccaggttatatgcacttatatttttgtcccaaattgtaaatatcaaatcatttcaaggatgattcatagaatgaaaatatccaaaataaaaaaaataaaaatggacatgaaataaattgaaaattgaacaaatgttgttggatttaaaacccatacttattaaaaaaattcaaacattttacaagcactgttagaatgaaaatatacataaaattttaaaataaaataaaaatgatattattggattgcttttggggttgtaagatattcttctggcgagttaagataccctaaattttctcataggaaccacatctattgtttcgacaaaatattttatcatcaattcaactatgatctcaagtaattttattttagaatttatttgttgcaaggataactataaaataaccggcgttcaaagcacaaaaaataagtttaattttagtttagaacataatacaagatattttaataaaaaaccacccgcacaaaaatatttataataaaatttcactcgcattatataagaaggtgctcgcgcatgtgcgtgggctaactttctagttgaattttaattattacaaacttcaaaatatatttctctgatattttaaagggttaattggatcatgctatcgtaaatttacctatctatctatctatcaatgatatactaaaagtccattaaacgtcctataaacgctctcaagccaccacgtgtatctttacaaacgctcctaagttatcacgtggcgttttaataaatttttggaatatctaataattcctaaaaaggaaaactttaaatacggtggatccacttttaacccgtatcatgtacgtgcacccgtgcatgtatgtacgccatatatccttccctcctcctatcatactatattatatactccctccgtttcaagtttcaaattttaagacgttttcactttcgtcaaagtcaaactatttcaggtatgactcagtttaaagataaatatagtactctctctatcccaaaatatacatatttttttactccgatatggtccccgagatactactttgaccaacaatatctataaaagtaaaatattttaaataaaaaatgttgcatattatgatagtttgtttagtgaaaaatctaataacatcaattttatatgattgatattttttttattttttgctattaatagtcaaagttaaaaatgtttgacttgccattattgaaaaaatgcttatattttggtatggagggagtaatatttataatactaaattagtttcatcaaatcaataattgaatatattttgtctcgggttgaaaatgttactactttttccataaagtttatcaaaattaaagcagtttgactttgaccaaagtcaaaacgtcttataacctgaaacggagggagtagaaaatacataacacatcattagattatttaccacaaaatttataattcaagacccaaactaaatatatttagtaagtaaaagaaataaaacacatttatagggaaaatcatatatatatatatatatatatatatattttaacgatctatttaacaacacatatattttaagagaacaatatgcaataataaatagttttaattagaaaatagatatttaataagtacattactttgggtcactactattatgtttgtaaatatatagataacttaagttggtgaaaccattggatttatcagcttcaacgccacctccagaaatcgacctgagcgatcgatcattcaagaaatagattagacacaataatccttatattagtagttccaaatttgatttttggggttgggtagtgacagctcacgtcgatcagctgtgtcacgtcagaatttcagatatatgtgtagtggaatgtttctgtttaattattagtatttgtttttactgtgatgcgattttgtatctccaaattattttcacaggccacggcgatcacaatccgcttcgcctgccttactatctggctgcctcccttcggtgtcttcgcgaagctatctgtgctgtgcttgacgacagccaatgtgatcttggtgacatcgtctcttcggaaaactggagaaaaaaaaatcactatagcaacgcgttacaaaacttccctaggagtagctaaacatccagggaaagcgactacatatgcagccctctgatgacaaaactcccctagaagcaatcttcgaaatgtcatcttccacttaatgaaatgaagcacatgtctctttgcgttttcgaaaaaaaaatagttttgaatagaatcatgcatgaggaaaaaaagtaatgttatatgtaagtttagaaatgaggtgtgtgccaaacaaaatagcgactaaaatacaacaagtagcttttaatttcactaattcagaagcattacaacaataacaagtactccctccgtttcataatgtaagtcattttagtatttttcatattcatattgatgactatctacattcattaacatcaatatgaatatggaaaatgttagaatgacttacattgtgaaacggaggaagtatatctaaactcataacaaatgagtggaatgcatgagaaccaggagccaacttgcctagctcctcttacaaaaagctcatttttaaatcacagacatatttatacataaagaaaacatacatatgcaagcaaaatatgataagagctatttgatcttacctcctaatagaaaaatcagtagactagtactacatagcacgttttgaagactcacatttgactcgatcaaaagcgtggatataaattttcatcgtaaacatgcatacgcgcacgtgaggctttcatcggacggcttccgcaggtgtcgcgccataagacaaaatcaaaatcgctctcaacttagattttccgttaagaaaaagacatgtatcatataccaaggaaatcttatacacaaatcttatacacggaatagagtgatctccggactccggttagaactgcctcacggtaccagtacactatttagtaatattttttttaattggattcatgccattataaatttgtatgtttggaaaaatactattactatttacaaaattggaatcataccattacaatttaacatctcttcgagatgtgccattgcttacccattcaccatactttctaaatttttctgaccaaattatcctttaaggcccctttgaatcacaggaatgaaaaaacggaggaatagaaaaaatataggattgtaaaaacagaggattgcaaaacacaggaaaaacatgggaatgaccgtttgattgagccgcaggaaaaacacaagaatttgaggagagggaaagactcaaagaattcttatcatgaggtagaacctcatgttaaatttcctctaaaatttacatgggaaaacgcatttcataggaatttcataagattccataggattcattcctttgattcaaagggctatataaaaaaaattcctatagaaataaaatcctttaaaattcctatgaatttctttggaatcaaagggccttatcttcttcctccttcccgtttctctcttttctctcttcctccatcccgccgccgcgcacgatgcaaccgaagcaagcagctgtgcgtgcgccgaagctgctcgtcatccccggccaccgcgtgcgcggaatctatgcagctacgcgcctcctgccagagccgctcgtcgtccccggccgccgcgtgcgcctactatggtccttgcgtgtagttctcttctcgttccttttttcgtgcagcctgccctacacgcttaaaaggtggcacatgattataggctctgtgaaagaacacgaattactagtagtggtttgcaatcatgtttggtagtgcgcatttttgaatctgcctaattcagctctttagttttttttagataactaagtgaactaatttcttggagaaactgaaaagttggaagaaagaaggttgatccatggctcgtcgtccctggctgccgaagccgtgtagctgctcgtcttccccggccgccgcgtgcgccgaagccgtgcagctacccggctcctgccggagccactggtcctccctagcagccgaagccgtgcaatcgctcgtcgtcccctgccgctgcgtgcaccgaagctgtacgtgcagctgcgcgcctcccaccggtgctgctcatcgtccctggccgaaagatgaagagagaaaagggaacaaagaagggaataaaggaagaagatgagggcaatttggtcagaaaaatttagaaatatcagtgaaagggtaagcagtggtacatctcgaagacatgttaaattgtaaggaaaacgcttcgtatcgagtgtccgggagcgaataaaatattggacgaaaaacgtttggtgggacccgccattgactcaacccattcttcgtcacccacgtcaatcttatcctctcacagacattccctcatctctcccctctatctctatatgctctctctctcccctctctttcactacagcggagatggcgcgatgagctccatctcgtcgtcaacagcgacgagctccatctcgacggcgcgacgagttccagctcgtccttgacggcggcgacgagctccatctcatcctcgacggcgcgaagtgctccatcccgaatacgcgacgagctctatcttggttcctcgaggacatggccctcgacatagtcacatagatgctgaagaagaggttcctgccctggcgagccttgaccacctcgccgaggtggtcgccgttccaagcatgcggaggcgacgcgatagcgatggcaatggcgacggcgctagacatggccaccgtcgaggacctgatgcgaatgcaactggtcttagccaagtttgtccatctcgtgccgttgctcgtctaggggtggttggagttgaagaagaagacagatgtgggtttagcttatgttgcactttgttgtattaaggtgtttcattttattttgattcgaattcaatgttacatatgttgattcttcatgttgcaatcgatatgtttcgattgcatttggttgaaacactttcgtcaaagcgatgaaacatttttcttctcatttgatgaaacatctaaaaatgcgtgaaatttttttagtaatgtttgagctttttttttattttttgttgcactttattatattaaggtgtttcattccattttaatttgatgttgcttaaattgatttcatggtgtggcaatccgtattgttgaatatttcatttggttgaaacaattttgctcaagtgctgaaacatttttctctagcagcgaaacatctggaacattttcattgaaacaatttttactgagggatgaaacatgtgaaacatttctcaatagtacggtgcaacaccgtccgatgatttgcatcagatcggatgtccgatccttagcagcctctaaattgtaatgacatgtgtcagggttacggataaggtataccctctatccttggatgtacgttgactcggagattaactgacccgcggtatataagggacccctgggcaggacctaagacatcgaatatcaccgctaacacatccaccatagcctacggagtcggagcctgcaggagtcaagtcgccgggagatctagtcggaccaactcgactacggtctcgtcggtatcatcgagttttgctatacactttgtaatctgtggttttcatcatataatcctataccaactggattagagctattacataccaaggagcctgaactagtacaatgcttgtcttttgcttgcttaatgtcgtattacgtagatcctcgtaccaacggatcctaataccctctatatccggtctacgggtatccaccgtcgacaacatgcttccaattttataaataataatgacatttttctaaacatgtaaatttataatggcatgatccaatgaacatttttttttccgaattaaacagagagaggatggggaaaaaagacaattagggagtcacaccaaattggaaaaccgcattcctaaaaccctacccgacgaaattgcaatggcggacggcggcggcggggccggcgacctcctgagcgcgctccccgacgacgtcctccacctcatcctcctccgcctccgctccgccgccgccgcggcgcgcaccagcgtcctcgcccgccgctggcgcagcctctggaccaccctcccggagctacggttccccgccgtcaccgacctcgcccgcgtcaccgccgcgctcctctcccacgacgccccgctcctccaccgtctcgagctctgcagccacgaccccgccccgcacgaggtcgccgccgtcctccacttggccgcgcgcagcttagcaggcaagctcctcctcgacatcgtgatgaggaagaagagaaatccggtggcggcggcggcggccgggattggggccgcgtttcacatcccctgcttccggaaggccacggagatcagcatccgcttcgcctaccttaccatccggctgcctcccttcggtgtcttcgcgaagctgtccgtgctgcgcttgacccgcttccggcttgacgacagccagtgtgatcatctcggcgacatcgtctcctccgagcggtgcccgtcgctgcaagcgctcactctctgcaattctcaaggcttgtcaaatcagccatccgctccaagactctcctcaccgttggcctctttgagctggaagaactgcagcagctcacgatttctgctcccatgcttagaacactgcatctggtccattgcttagacaagagggcggtaagagccgctgacatctctgctgcggcgttggagaaacttgggtggattggtctgtgcgattggaactcggtccacttcaatgtgatacaacacctcaagagactcgacaccttgaacctttcggtgtatggaccgccgaatcttgtcgattcttgatacccgggctctatgtcactcctccagcatttcaaagcagtctcaaatgtcgacctctatctcatttatccatctgtgagtacaccttctctcttgttgctgaactacattatcgaaacgttgaacgaaatgtcgtaatactctctttgtagttccccagcagccactgctagtatgccggcataggcacacaacattttaaaagaggattttgaaattgttgatataacccatggtccagatatcatttgtccgagtccgtgttttagtatatgtttcacattagcatctaaataagtgtcctaatcaaacgtgaatatataagttgggaggacatgtatgcactctggtatgtgtatttgcacatgattggttagataatggagaaattgagggcattcctggatcaatttccctttaaaagtgttcccattggatttctcaagccatacatatggaactttctggatgttctttatctgaagctgtatatacctcgtacatttctcaatctcctcacctccttagtcctgtgcaatgtcaaaatacacatattaattaagggatggaatggtgtacttactacaataactatattaatgaatctacaacttctgaccattgatcaagatcttcagtttccatttggtcctgttttacacattgttatgtaagacattgtatgaatctctgttaatttgcagagcatggttgactgtgagttcttgatggaggacatgaatactctccctgccattgagatcttatctctgaggtcaataacagcaggccatgcctttggaccttgtgtattccaattgcttaggacgtctactggtgtaagagagttgcacctggacttggatcatcaccttaaggtaatgcatacttattcaatgtgattaaatactttggttgctgtcaaaagtgatagaagtatttcttcttttacgcactcagcttgttcctctaactgtacacagtggtacttgatgtgtcggtctcgatactgatatgcccctccatggtgtatctattacaactaatggtctttccatattcagagtttcagactatagtgcctttgattttcctgtcagatcaactccttgcatccgattgttacatatggcacatgggatgtgaaaaattgcaatggtgatgagtgcatctctctctcatccttgtacccaccaaagagagtagtgctgctttggatttctgtgatatatgattgaaatatagctgccgatgttacttacttactggtgattgatatggatttgttagccatatattcaggttggtgacttagaagcaaaccacgccatacgataaattgaaatcttaacagtaaatattgtaattgtggtcggtgtatctgtgtaatgttttttacttcttttttgtatttctccctttctctacatgtcacagtcacttctctggaggggatagatttaaatcatatgccactcaatattatgaaaccaatgttttcagggagaagtttcttgctcatctggctgcatctgttacaagccgtcggactgggagagtatggatatctgcttgaattttctccagaaagttgaaatcaacaatttgagtggagcagagtatgaaatatgttttgtgaagcgactgttgacatgggcgccagtgctcaagatgattacagtaatgtttggtccttcagtaactgtcagcgaggaggtgtgccaggagctgcttagcttctctaggaggtgtagtccagggatttgcatggaaatttacttgcacggcaacagagccaaggttatgtatagagcagtgaacctgaagagacctagagatgattaactgacaatgaaatggcgacctggagcctagtatattcagtcaaaggagcactgtaattgggcaattttcaagcccgcctctgagatcaatctgttgtaaggatgtttgtctctcgtgatatagggattaattatgtatttgagcatggttcaatgcactctcaacttgtttccgaaatcatttttgtgtgcaggttttcaatctgctgtgaaaaatgtccgaccgaaatttgtctgactgaaaggttctatattatatattacagttttcgatctctacttatctgccgtagaatggtaagtacagcttatgtggtaataatatctgtgtttcgtttcagaagcaagcatatggatttgttcattctgttcctccatgtacccacgtgtgacaggtctgtaggacggttggcgattgttcaatattgctgtcgcaattgggtcatcgtttgtgaacaccgttgacatcttgttgtcccaactccatctatgtactcatcaccgttgacatcaccatttgccgtaaccatttgctttatttcccactgggacgtgcttatgtgtttttttccttattatagcttctaatactccctccgtttcatattataagattttctagcatagattcattaacatctatataaatatgggcaatgctagaaagtcttataatatgaaatggagaaagttagttataatcatgtgttttttcttattatagcttccaatagttataatcttgtaatttttttctactattttaatatacaagctagcactgtcttatgtgttcgcttaaagaaaaatataggtgatatgccaatgaatgagaggtgcattttgcatgagttgagccaaactcggagtggcaacatgccgccaaccgaacaagccgttgccggttgatgacttgattctaatggtcttggttaactggctggatgttgacgtggccatatgagtttttttaaaaaaaatgtttgaatagttgcatcgtttgaggatacaaaaggaattaattaaatattataaagttaaaaattgatttaaaataattttcttataaattcatatatagacttttttttgcaaaaaaccagccgtaccgtttagagtaagaaagcatgcgcatttcttcgaacatcccatcataaaataacacaacctatgtgtgaatacgcaactctggaatataaatcacatcatatcttcctatatagttggtatccactaaggcgtatttactcctataaagtaagaaatgcaagaagccacatcatcaacaattttaagtcatcagatcacattagtacaaagttaacaaccattggatcaagaagctacttattcattcaattcaatcatttattagttatccaatcacctccctttgctccacctcatagtcacagatagcattgttatcatatatacctatacaaatcatccccactaataggaattctctgagttttggtgcttccacgtcacctttttttcttccaaccattggatcaaaatcaaacgtccaacgatatttccagtcgatttgcttactgggccaaaaagaacagatagcccaagcccaacacagcaatgagttcttcactgttaatccgcacaccgcagcatttgcatcacctcctcccacggcgctgcatctttccctctcccacgctgcgcaacgcgcgaggtcgccccccccctcagctgcatcgcctcccctgtccccagcgctgcaccggagcctgcaacgcccatctctccccctcccgcgtcaagccgagcgcgcctaccaccagctgctttgcagcctgtttgcctccttggcgtgttaggactaaggaggaacggaaccgtcgacgcccatgaagagcagacttcatggctatcaaaactcccgcagctttcaaaccacctcccagcttttaactgtcgaccaccgcatggactcctgcagctgcatggaagccaatcatccggttcgcctcctttgccccaaactgttccccctcccccccctcccagtcttccaagaagaaaatcaagatctttaattcagccggctatatattggtcgactacggttgcttggatggagatggataccatgagcatttgtgttcttgcttcctcgcttgagtatgatcaagactgataagcgctcaggctgtttactccccaaacagctgaaccgagtgaatcaattctgaggtaaatttctccgagcaaggttttcccctgtttgatgaaatgcttatttacacacatcatatatttcaagtagacaggtagcactagaatcacgattcacttttgagtttccatctttttgatcttgagcaaaaaacctttgaaatgggcaacgatggagccgcagaaccacattaaggtgtttgtttcactgtcatgttctttgtatgcaatatgcacatctctatatgcttcatagttatttgacacatagatgctccgcatcaacgcggcggggtatgatctagtaccatgttttccaagtacaactcaaattattgtttaagatgtgtgttttgttttattatgcatgattagatagcatataattattacgtattgttacctaaatcaattttcagaaaaagcttgaatgaagcagagagatgcaaattgtctaaccacaacgatacccatattgcgcatgaaaataatattcatatattataacaagagtaaattgcataggcggtccttgaatttgtaagcaggtttcatctaggtccacgaacttataaattgtgtatcgaggtccctaaacttgatttattgtatcattccggtccaaagtctcatttgcccatggtcttgcctacgtggcatgacatgtagacaatgacatggcacattattattattattattattattattattattattattattattattattattattattattattattattattattattattattattattattattattattattattattatttctttttttctctcttcttcctctttcatttatgtcttcttcggcctcttcgacgcgggggagctcgaggtgactctagtggaggaagaagataaaagaataggaggaaaaagaaaaggggaaaggaaaaaaatgccacgtggcatgccacgtacacaagaccacggtcaaacgacactttggaccggaatgatacaataaaccaagtttagagacctcgatgtgcgctttgcaagttcgtggacctaaatgaaacctcataacaagtttaaggaccgctagtgcattttactcttataacaatatacaacgaatacagaatgacgcttggaaaaataaaatatgaattgtattgtagtaacataaggtatatataaagccacattatcatatattttgtagagatagagttgcatctaaccatttaaaactacgattttgtttgacgataaaactacataacccgtggcaagacgcggggtgccaactagttaataagatgattgggtcatgttgattttgtttcacgatagattttagggctggtttgcatgaactaaataattgttacaccgaagtgttttacatgttgttacacttactaaaaacaccccactgcacattcttacactacatgatgtaatctatactttctatatagtggtacccactaacaattattataagctaaagctcaacatgcaagcatgccacatcatcacccactactaattactattctaactcatttaaaatcccatgcaagcatgccacatcttcactagcaataactattctagcctattttaaattccatgcaagcatgacacaccatctacaatattagtatattatagagatcaacaggtatgtgtcaaatcatcttcctcacattattttctcaacatttctactttcatcattttgacaatatttaatatatactcatccatgaattccgcagcaaagcgcagggtatcacctagtttgctctatacttgtactccgatatacttttataaatgtgtttttattggatatttgagtcaaaaattttgactcctgagtagaaggtttgagatatttgagttgaaagttggactcttggcttgaaagtctaggagatttgggttgaaattttgattcatgaatggaaagtttaggagattttgggttgaaagttttaatttcatgatttgaaagtttcttttttttcatgatttgaataggaggcatttttcacataaaacatataacaatgctagtaactttcacatttttaattagtggtaatatatgaaagactgaaagagtactcatgcaccatcaattttgtcttcttttctatcttggtaggttaaacttctctatatcattagtcaaactaaacttattatcactagcatatttgagagcacgaaaggacatttagaataaaattccttagtctaaaaataaatttccaccgtcttaccgagaagtttttatcccttcaataccgatatctatccaccaccgctacttgcgagaaattgattcagacctacgatgtaatacggagtgctaacgtgtattctcttaagcacaacaggtatcgttgaggcccaaacatcaatacataaccttagagcgacgtattagcaaaataacaataatttgtgtgtaaaattatggtacacacatacatacatacatacatatatacatatatatatatacatatatatatatatatatatatgtatatatatacatacatacatatatacatagggctccatggtgcccaggcaccattgatatctaccgtaggattaggtactgatcgagctgatcttggcatggagttttgattaacgggttcacccgttaagtataatcggtttggaaagtgacaacatttgcatgcatgcaaaatatttcggaagatcaattgtgtgtatttaatacctttccaggcatgcttttcgggtgaaaattgatttctatacatttgtcaacagaaatcatgggtctgcggtttatatgataataatggtatgagttggtatggaaatataatccgaaaatctccaatctaagtatatgcagatctggaagctaagtatatgagaaaacggaaaggaggtatttagtacttggaaataggaagctatgtaatagctatgcatggaatgtaataggtacacattaattgtgtatatggtaatataaatagaaatatgtgcaagtccaactatattcaaataaggaatctaagtatatataaattttgtatctaagtatatgctacggtatattgccatattttgaataaaaaacttgcccatatgtcgccgagtttgctttgcgactccgtgatcttttttccatatacctatctaaactgtttataaatcaaacataacttttaagtacaaaattttaaatctcgtgatagaaatatactgttaagttcagttattttttccgtatgtacctagctaaattggtgagtacaaagttttaaattgcatgaaagaaattaacttgtaccgtgttaagttcagttatatttttccatatgtacagtatgcagaaaaatatatatggaaattaacttgtacaacgggaatatcgctcgcgaattaacttggcatctaataaagataaaatcacatgcctggttacgctggcacgggaatatacgctagaattggttgattaattttttatatgtgtaagtatagtttacgggaaaaataaccaaattaattacacaccatactcccttgcctgcgtacgggagacataaatatgtacttatattcacatcatatataatacctatgttcatgcacatccacaactcatacgtctgcacttgtttgtacacgaatgcatgagttataccaattaagtactgccttttcatacattaaaaacccaacgtacgtacacgcctgacagatacacatataccgcgtaccggtcgtgcacgtacatataccatgtgtgataagcaccggtcgagattgctcatgacatgtaatgaagatatttaaaaaatctgttttaatatatctggttattttcttcaaaaaaaaatccagttatgttaggttgggaatatgcatagtttttgttttgaataaaatggtacatacacacttgcaaaaatcacgaccacaagtcatacctacatgccttttcttataataaaaacagaatattcacacctgccacgtacgtacacaaataccgcgtacccagcgtacacacatataacacatatatatatgtcctgtaaactaaataattatatttaaaactgattgatcactctagaaaatggtcagtaaccaatatttattttttggaaaatacacaatgttcagtcgtgacattagtgcatacttaacttttggaaagaatagccaaagtacatattggccgagaacacacaaccatgaaaaagaaaaccaggtgacatatgcaccatcttagaatttgatacaattaaccttacacgtcaggtatgggcacaaattaaaaaatataaatttgtatgggagtacctatacatctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttatagtgtaagttttataaattacactgtaacttacaagaaaatgcactgtaaatttgagtgagaaaatcgagtgagagataagaaaaaatctttcgagtgagatatagcaaaatcgaatttgtatctatgtcaaagcattattactcatgtagtctgactgaaaagcaacaattaattcgaataattcttgcatcatgcaacagaagttatttcatacaatagaggtttaaaaaagtatcttgcttcattccgaaacagcactgttgtattgcttcataagttgttggacgacatctgggagtgtagccgcattagtcttcattgccattatatccatcacatgcctgctctgatattgtcaatggatacctaagattcataaaataagtaattttgttagtagaataacaagttggcgcgagaaggtaaaattgtacttgaaaccaaattgaaagagcccaacatgtaatatgtaattaaaaataattaccggattaagtcctcccacacaccagaattcattcgagttcttcgtatacatcagagttgtgtatatatccgttaggcaccaaaaaaacgtaaaggtatattctaagtaaattcaattcaagtgtgtattaatttatacccgggtataaattaatacacacttgaattgaatttatttagaatatacatcggaggaacatttttgcaattgttcacttgtcaaaattaaacaattttgctcttgggtaccagctggcgattcaacatgggtttggttagtaaaatactgtggaaaaaaaagggaaaatcatatacatacgcacgggagtactgcatgtcaacttaaactatacgaacgataaattctgggatctagacttttcacatacctacggttagtgccaaacctcacggatgacgggcagcgatggcgaggaggcacgccgcacgcggacgtcctgcgctgtaacgaaggttgcggaggtctgtctgccaacaagaacctcatggacgaacgccgtccgtgtaacgaaactcatggacaaccagcggcagcgacgaagaagcttgtggccgtccggcttcgttacggcgtggtgacgagaatgtcgtcggcnngagagctcgcgcggaaggaccagcagcaacgacgaaagagctcgcggacaatggtgtaccagtgtggccaagaaaaccgtgaacatgaaaaatggaatactatcactgggcatatgtatctgcatagaaaatggaaggataataatagcaattagcgggcatgaattaatattgcaaacaaaatcatgagtatatgcatgtgaatcatgagtcttattgggttaaacccgctaatagattataataccgtgttttgagtatgcacggatcttaaagcaagcgaacggtggatggcattggagtatgggcaccatggagcccctaacaaatttactacatacatatacatacatatatatatatatatatatacatatatatatacatatatatatatatacatatatatatatatatacgtatatacatatatatatatatatatacatacatacatacatacatatatacatatatacatatatatacatacatacatatatatatatacatatatatatatatggtaagactattctacacgaatagcggccaaacctatctcccacattagtcaaagcgcttccacgtcggttaaatctcgggtcaaacccacctgtggcttcttccatcacccaccctttctcagctctcgtctcacagatacggtgcagtaatgtgacggtcattgtgtagtaacgccgcagtttacgtgtgaaagtgcattaatccccctagtgggttttggtgattaatgacaaatgtggttaagggactaatgagttcattgaatgactttcaggtgcattagtccaaggtgtggaagatggatgcttggagaccccccaaaagtacaaaatcaaagcggaccggaactcgagaagtgcataggatagtttattttttgaaatcgagtttttaggaaaaaccgtactattaagaggggttccaggtgatgctctgagatatgtcaagtgctcttagtgtgaaccaagtgtcaagtttccctaggagtcatttttgcaaatactccatctgtccaaaagtgcaagtccagaacttcctgtcttccaggtccaaaagttccggtcttgtgaaaaagtttttcctaagtgtagtccggaagttcctgtcttccaggtccggaacttcctgtctagtttccagttcaaaattgtgagtaacggctagatgacgtcacctagccgttatacatatacagctcgtttccagctcattctttggctattccacttttacttttcgaacctagagttgttgctagcctctcccaagtgttttttttttgccttctccactcaatctagagcctaattcttgtgagaaagagagattgagagggagagaagaagatttggagatgtgtgaagactaggatcttgggtgagcacttggaatatctcgtgggctgcatctcggttcttattactcttggagatgatctcctagacagttaggtgtcgcccgtgagaatccgttgcatattgtggatgtcccgggtaagtttgtgaaggatctcctctcctccgaaagggaacgagttaagttaatgaagttcttgtgctaagattctagaggttttccaagtagagtaacctatacttgtggcagatttctagaagtaggttgagttggatcttggtggtcactcaattctagaaatttgcctaggagtgtttagggttgaaggctatggatttcctctagggtttttgcacaaatgaggcaaggggttaatcgagacccagctctttggagctcctcaacagagagtaggatcgcaagatccgaatttcgggaaaaaatcgcccttgtctatttctgtgatgtttctgtggatgattctgtgatctatcctctacttagaatacctgtgctctttcttgtgaagattggcttagtctcctgtttcgaaatttgaatttcatctctgttctgttacccggaagttcctgtcctagaacattggaagttccgggcctggaaggccggaagttccggagttccttaccaggaagttccgggtctgtttaaattttaccgctgcgatttgtttttaagttttcagggacagcctattcaccccccctctaggctcatcagcgcgttcaacgtgcagtaacaacactaaaatatagttcaaatatagtcacgacggatctacttttgacaagtactttttttctagcatcatagtgcaaatgatttcaaaaaataatgcatattttgcgagatattgctcttcaaaggttagcattttgaagtttaatcctccatatgtagtaacactatagcattactattactaccatttgttccgtgttactacgagagtgcagtaactactacaacttttacagtaacagtgtgttactgcaattgcttggtaatgttaccacaataacgtaataacaaccaataaattttacatagagaaaaaaatagttttctttatgatgaggaggacatgtgagagacgaggggtggtcagtgtttgctcgaatcgggaatattaggagtgtaattggaggccaagaaccgccaccaattttgctcaaactagtcaaagtgaatccatgatgactaatctcgttcaaactcctaagcggatgcaacattcatattgtgaaaattgtgcagtaacgttagtgcccgtgtacattaacaatatatgtgttttgcagtaaccgatcgttttactgcaattccatgatgatgttactaagaaattgtaacggaattgatttgcttctttcatggaggtagaaataatctaccttgttttttgtttgaatagcttactaaacaatatatgatagcatattagaatgaaaatgatactatacaaattgtccaatcttggtcaaaccctcaagcggatgctacatttatctagttagaattgtgtagtaatatagtgctaaatagcagtaataacttgtgttttgtgtattaaccgagcatgttactttaattccgtgatgatggttactacgaaattgtaccatgtatcttacacgtgctaaaattaatttactatatgtttttgtttgaacaatgtattgaatggtacggatgagggaggagagtgcagataaggcgggtgaggagagatgcgtgacatggcagagaaaggatgtgttttcacatgataggataaagcctcacgtgctaactgtatacttgttactgcacaaaagtataagtgttactgcatgataggtgtatgttaccacttccaactagctatgttactgcacgataattgtagttttactatgtcatttttacgagatgaagatcgaataggtgggccattggtaaagtctgtaggtggctttgagcgaggtctgattgatgtatgagtgttttgaacaattttatacatttggtaaaaccatgttactgcatgtatatgcccttgttactgtaaattatacattctgttactgcatgtggagggctaaagttcaaaatattctttgaaaagcaatatcttataagatatatattatttttgaaaaccgtttccaccatgatgctatagtgttactgcatatggagggtttccacactatgttactatgaaacttataatcgttacagtaacgacatgatgtgattacagtaacacaaaacagttagtagtaacacttttgatatagtattactgcttgtggagagttaagtttttaaaacatatctttgaagggtaatatctctcacatcatatactacttttaaaaaccgtttgcaccatgatgttcgaaaaaaagtgcttatcaaaagtagatccatcatgactatattatgactaaattttaattttgttactgcaagtaaaacacggtgttactgcacgatgaacaagacattactacgtcgttccgagacgagagctaagaagagagggggtggtgggaaaagtcaccggtgggtttgaccgacgtggggaacctttgaccagcctttaactgaggtgggaggtgggttttggacccttggggggagaggaggtgggttggagggaggggggtatagaacaactattttataccttgggtgtagaatagttttttctatatatatatatatatatatatatatatatatatatagttagcgatttaaaaatcaatacttgaaaaataaacattgataaaaaacttcaaatcaacttcaaaattaaaatttaaaatttaaaatttgactatggctgatttctatataaaaccagaccatatgtgcaatatagtgcatcggaagctaatcctttaacttatctgcacatataaggtctgtttggagagcttaagattctgataaacaactgattagtagccagctttcttaaaaatttggaaaagctggatttttctacttctggcttctaattcattctggattctatactataactcgtgagaatcatcaatcaataactcccctaaccatcccctttttctccgtttttttaatttttttctggctacctcggtgattaacacgtcgccgttttgcgattacggctcctcgagagcgcgtttgcgaccgggaaaacgcggtttaccggtaatttcactgttaatctcacgtttgaggatgcccgcgtggcggtttcctccaccgctggtgtccggtttgcgatctggttattttgcaaaaaaatccttgtctatgtataaaattttaaactaaccctcgtactacctgacagcctgttgtacttttcacaaaaaaccccttaaccttcagagaaatacaatgcaaagaagagaaaaatctgattttaggggtagctctgtaaaaataacaaatacaagggttttattgaaagataaccacgcctacggcctaccccccacaccccgagccctaacccaatcgtttcccgttccccacttcctccccactgcgccccgcgccgccgccggcctggggctgccgcccggccgccgtcgtcgccgtggtgcggcctccccctgtcgccgccttcgtcctccgcctccccacccccctccctcgccacgccgtggcgtgagccctctctccgtcgccgccgtcattgaccgccttcctccgtcctcgccacgtccccctaagcaccaccaccacggcccttccctcaaatccgcctccgtcgccgacccatccgcgccgccgctcgccctcccgcacctcctcctccccagtgatgtctcctgcctccatccccacctcgtgcaaatcgggggaggtggacttcggcgtggaggaggtcggcggcgtggaggagttagcgaacctcgagtcagcacggaggcgaagcggagtttgtcggtggcggcggctgcagtacgaggccacgtcggcgtcgttcctgccgatgggtggtcgattcgacgagcgtgctgctaggtacgcagccccttcgtctttcttcttccctgcgacccgccttttttcctttcagcatcgggtcagcaacgtacccccccccccacgccgcccctctcctccgaccttccccatgcgtcggcagccgcctgccctcgcctccgccagtcctgttgttgccgctccactcccctcctcatggtcggacgggttcgttccgtgtggcggtcgccggcgggggccatgatttggtggagttgagtcgattcggtggatttggggagtagtgtttcttcctcggtttagtctcttctttccctcacaagttgtggctgtttctttgggtttcttctcctatgggtttccttccgctgtgtttgctgactggaggaggagctgaggatgctcggcgggatctgcgcagcggtggtcggggatggcgaggaggagaagcagctctgtcctatctgcctcgacggcatggaggccgggcacgccgtgcggcgtgcgcgtcctccccggatgtagctgcgccttccatcacgactgcgtccaccggtggcacaccatctcgccgcgctgcctcgtctgcaacgggtgggttatgccgccgttgccaccgcccgccaagcctgctctggattcttgagatggcagcgttgccgccctaccgatcatggctcagttcttggttcttgacgagttcttgatgaattctcggcgattgtcatcgtcggtttctaggctctggacagcggttcttgccaatttcttgttggctatcttgttctcttaagtatgctgccttttagaacttgtgctttctggtcatggacttctataagatgattgatttgtatggacaggtgagttgttctataaatctgacatagtttcagtggatttggccaccgctgacgatagccaccgacagctcgggttctctctgctatcaatgcttcttatttggtatgaattctgaaagctcatttggcgtgttatctgcatgagagtttatgatgacatgtttttttgttcagaccagtgcttctgtttacagatttgttggtctacatattagtaaattcagatgagctgatgaatcagggaattcaggtaagatcatgacttccagcaatttggtactatacaacaaagttttgtcctattgtcctctttaatatgtatttcaataatgctgagtttattttctaatttgtcaaccatagcgagagatatcagtaaactgatttcgcaattgtttttgtcgaactgctgctgttaataagagttctggagtaatatatatttataggtacacaggatggttaagtaaatgtacttatttagattgctatgcctaacatccttagtttatttgatgatgctacatccttcttcaactttaaggtctgctatgcatctttgtattttgaaatcatgggccattgaaaatgtagcactagcaattactttgtctcttgtccagtaccttttctagatttctattctgtacttatttgggatgatttttttgttacttggaccaactagactctagagcgctgtgtgtgtcttttgatcaatgctgaacagtgcttataaaataagtgttgtaaacacagtgctgctttgatcatgtatttgagcctaacaatctctagatgcaccatgcaaaagtagttttttgttttgcccttatagctgttagacataagaatttccttactgttcgactaaaaagttctctttctacttcgataaaagaaaaacttgatgtgaccaggcaaacatgtcatcagtgcttcatataatagttgattctatgaatttttttttagtttcaggtataaaaacgacttggacttctatttcatggagtcatggttaggaataaggaatattctatgaatattccttattcccaaatttgaggactctagcatggacatcctaggagttcctacactggtgggtcgttctcaagaattcttcaagccgagttgtttctttctcttttttttcatctgatctttatctcacatggaaccatttatttccaggatattaactacgtcattcagatcccacagtaagctaattacgcccaacgatctaacacaattcctttctcagctaattatgcactcttttgtcaggaagagctgcattcctggttctgctgtaactgagggttgatctgcctgatgttgatgtgctgttcagctgttgctgttatgaagtgggaatctctattaccaaatgatacctttcttattgttgcctcctctgatggcgcatttgagaaaatgactatgcaggatgtctgtgatctgatgttgtacgtgaaacttggtgttaagcaagaattaggatcctttgcagtaacacaacagaatttggcggattatgtagttgacctttttttatagatagggacaacggacaatgtagcagctgtgattgttccattgggatctcattatagctctaaagttacactaaaagattggtacatatgcttgaagaaaatttcaggacatatatttcaccattacaaaccattccaaaggacatctatttcaccattacaaaccattccaaacaacggaagtcaggtaggtttaatgtacaaaaactcaaaaagttcttttttatcgcaatcaattggcaagttggcaatttgtagtcatgaccacttgggcaatttttacattatgttttgtttataagattgagcttttcattagttttgagaaataataaattactccaataatttgctattgtattacactatctatttatttcaatacatttttaaaattgaagcttattttgtttacatagtcatccgctacgtgtttagagtttgttttgattaagctgttaagcatacttgcgtgcgcagctgtgcgcggcgtggcgcccccttatacttctagtctaaatcaaaagttgaattgtttggggagcttaactctcccacacacacgaccatagttgtgagtggctcaattggatattctttcctagcgcgtccgtaagtccgttgatctcctcctaaatgcaaatgtgataaaaaaaataatttggcattgggaagtccaaacgtcaaatatccacaggccacaggggtgcatccttctaggcttccattccattccattctttaattccccccaattttatcccccacacactccactccactccactccactcttttcgctcgcgtcgcttcccaaaccctctctctcctcaaaaccctagcgtcgcccgcttcgcctgagctccggcgatggacggcggcgaccgcctcagcgcgctccccaacgacgtcctccacctcatcctcctccgcctccgctccgccgaggccgccgcgcgcaccagcgtcctggcccgccgctggcgccacgtctgggccaccctcccggagctccggttcaggatggacgtcagcctcgccgcccacgcggccccggccctccgccgcctcgaggtctccaccgacgcggacgacccggcggcgtcgacggccgcgctccggctcgccgcgccgcgcgtcgccggcgaactcagcttctgcatctggccgcggtgggacgacgcgccggaggaggatgacgggccggcgccggtgaggcgccccggcgtcgtcaagctcccctgcttcgagaaggccaccgagctctggctaatcctcggcctcctcggcgtctcgctgcccaaatccggcgtgttcgcgcagctcaccgcgctcgccttccgcgacgtccgcttcaccggccgctgcgatctcggcgccgtcgtctcctcgaagaggtgccccgtcctgcaaaagctccaagtccacgactcccaggatctgtataacctgaccatcttctcggagtccctcctccacatcgagctgagcgacctccatggcgggatggggcggctcatgatcgtggcgccgctgcttcgggttcttgatgtgcgccattgcttctactggaggacgtacaggtcccattcccttgttcgggatcaaccatatgccgcggtcttcacgcccgcgctggaggatctcatctgggttgatgcgtatgatcctaccacggtccaatttggcggcgttaaacgcctccggaagctggttacccaattacagtgtatggactctctcgctgcactgatcacatgaattcagtaatgctcttgcggcgatttgagacggtatccattcttcagctagaacttgactatccagaggtaactgcacattttccctaaatctggcatgaatgtcattgaataaaacatagagattgaaatatttgtttggtagactctagtcatagtgtgcatggacttcattcagatatataccttcataagtattgacacagctgccctggtgaaatgtgttagatatttatcttttatgtattgaaacaattgcccttggtgatgtgaaaaatagcattttggaggtcctggatctgctatcgcactggtactgaacatatgagatactgaggaacggtattgatcaaccagatttagccaaagaagactagaatttgagtagtctgtcccacaaacaggaagtgggctcagttttggttctatgcatgaatggtggaatatagagtaagacactgcagatatttgatgctgttctgcctatgtaaaactcccatttgtcttgctgtgctcaagtcttgtagctgtcagcttcttgaggctcttctctaaattatcatcattgggactcgcatgtttattaaccatgtttcaattgttagcttgaaaaatccagttttctatcagttgcatttacgaagtattatagtttgtacatttcactatgcatggtaaaaattaaaattaaaattatagtttgacgcccataatctgatattaccttttagtagataatccctccagtcttgaatatttgacattccaaacatacatttggccaaacttttgaaagtttcaccttttgtcttttcccgtgtttacaagaccatgttgattatccaaatgacaagatatgcagtaggcttgtatgaagaccctgatagaagatcttaactaattaaaagattagtatttttccaatcgtcaccaaaattagtattagtatttttcgtccgtatgtgcaatttttttcactcgtccgtgtacgatctcctcccaaaattttggttcattagtacacgcgagatcgagagaccgcatcgctcccgtcccgtacgcgcgtagaagcccagaactaatgcacggaaacgaaagaaactgaatcacaaatccaacaacaataaagcaaaaccatcccaaaaattaaatcaccggggccaaaaaaaaaggaaaaaactgcaaaaaaaaaaaaaatcaagcattggccggctcggcgaggcaatggggaggaggagacgaccatcggcggctcggacgcagcccagtgcgcacggtccaccccctcaccacgcacctccaaatccatggacccgcgtgagcgtgtgggcgaagagatgacggatccatgcgggaagggaagaggtcgctggatccacccctcccatcgccgccaacggcggatccgcgcgagaggagggtggagagatgacgggatctgtgcgggaggggaagaggtcgccggatccgcccctcctgtcgccgccgacggctgatccgcgcgagagggagacgaagagacgacgggatccaggcgtcggtggtggatccgcacgagcagcatcaacggcttggaaccgttgcatgaggaggccttgccgttgcccccagtcagccactgcgcttcttcatcttctcgctgtcgcgcttctccatcttttgccgcatcaaggagaggaggcgccgctggccgctgctgcagccggtaggcggaaggaggcgccgctactacagggaggaggcacaagggctgagtatgggaggatgtgagggcgcacgctggtggaggcgctggatgcctggatgacggcgtgcgatgtgaatggggaacgaccgaacgagtgagaagggagagagacacagagactgggatagaggagcctagagctctttgagcagaagacctcttggagctggcaacctcctcggtaatgaggtacgagcttcagttttttcattaaaaaaaaactacgaccggtcaaagttcctttctttattgtgctattgattttcgctgaaaaaaagtttttttagatacacgtaagagtacttcacaactaatgatgatttttctttattacttatattgttgacatcaaaatcacttgaagtttcagtaaatacaaaatatttgtttgagacaaaaaaatatcgattgaaaaaaaaagtttccacgagataagccaaattagagtattcgcgctatcatccacatgtcacatgacctgtctccacgtgagtccacgtataattttgagttgacagatcgagaaagcatgcatgaccactagagactatgagtaaatatgcaaaactattttcgatccgcgacactgctacatgatatattttcttggacgccacccacttttgtttacatgcggtccgtaagtagaaccgcatggaaaaatagggggacaggcgccgggctgtcgcccgtgggcgacttaagccaaccgcacccgaattttcacctgcacgggcccaccgcttttaaccgcgcccgcacacatctccccctccgcccgctcctctcctcccacctccctctcccactccactcctctcctctcctcccactctcctcttttcccctctcccggccggccggcggtgcgacagcatgcggcggcgcgcggcccctccctcaactgcgggtgggaagaagggcagcgagagcatgcggcagcgggcgaccacggcggcccctcccctctctccccttgcggatccggcggagggggcggcggatccggcggcacgcaccccctcccctcctcccccttgcagatccggcggaggggggcggcggatccggcagcgcgcaacccctcccctccctccccttgcagatctggcggaggggaggcatgggtgcccagcggagcggcggcatgcgtcagcggccggtgtggaggtgaggcgatggcgtcggcgaccggcggatctatctctccccctcctctctttgttatttgtgattctttgttatttgtgagatgcgttcttggagttcatttgttgctgtgagatgtgttcttgtgatgtgagagttcatttgttgatgtgagatgtgttcttgtgatgtgaaatcattgtgtgtcgatgtgcgactacagatccggcgccggcgaccagaagggaggttgtcctctgcatcggctacgacgatgatgacctcgccctcgtcgacgtcacctaccccaagcgtgacgtggacaacatgcagtggttccgggaaatcacactgctataccgtggccaccgccactccgcaccctttgtcctcggcctcatcgtgctctgtggccatgcgccgcccaacaactggtgcccatgggggcgagaagggcgtgcgcggccatcctcgggaccccggcaccctgatccgctacgtcgcgatctacatcggcggctcccatgccttgtgtaccagcccgactgcaaccagtccaagtacaccgtcagcgtgcttcctttccatgaggacggcggaaggatggcgcggcttgcagtggctcgcaacaaactaggcttggcttggctcagctcagttagggaaacaagctaaaacttgagctcgcctcggctcgttttctggctcgagccagctcgagctgtcttgcaagccttcctgttgaaacacctcttcatatatattttgtaattattaaaaaatcaagaataaatcatttaacatgtaaaatttaaataagtttatatattcaattcttcaaaatcttaatgataaatttcaatttgacaaataataacgccacaaaaagtaaaataatcgatataaacacatgatggcctaggctcgcaagccaaagcaagcggctcgcgagctagctcggctcatttcagcaatgagctgaaaaggaggcttgggcttggcttatttggcttacgtgctgagccaagccaaccaagctcgagccaagcccgagttgagctcacgagcctgagctttttttccacccctgcactaacaaatatccaacttttacatcccaaaaagttactcgtgtagtgtcccacagctaattaaaaccgtgaagtcacgatgtcctgtagcaaaatttgcctatttggttttgttacacagaggatgagttaatttctccatatcttcacaattttcagctcatgttttatgaagggggcaatatatttcaactccacacattttcttcacatatcaacgcacgggtatattcctatagttctctcatttttttaaggcttatctgcttagaaatatatatcccgcaaatataaagaagattaattgtcaagaacaacgcgactttgatcaaacttcaaccacccactatcatctgttatccgtgcaacgcacgggcattaagctatagtaataaatttgtcaactgtaacaaaacaacttatttttaattcaaggtggtactgtttttcatattgtttattgtggctccttatttgtgaatgtgcagatgggccgcagtcagtatttgatggaagccataaccatgctgccagcaattgaggtcatgtccctggagttgtcaaaaagagggcacgcttttgggcagtgtgttttccatttgctcaggatgtccactggtataagaaagctgaagcttgcattacgtggaggcctcaaggtaagtacatactttttaatattgtactttggttgtggggaattgatggaagtattttaacttttgcatgatggcttgatcttctaatggtcaggactctgaggagaggatcagtgttttgtctacctggttccagggacaccaggtaaaattttcaatctacactattagctgataactagtattgctctgtcatatgtattgctaatacatgtatagcacgcccagtaattcctgtacttgaatagccactgctaatggtgatatgagttttgactatttgaggtgatactttgctatgtaatttatgtagaagaggtaaatgctaaaggatccaaacatatttttgctcaatttgatgtgtatttccaaaattgtgaagtgttgtagttctttttgggtgcctggtaactgttaatgttagactttactgactgaacattgttcaggaactattaacgaatgatcttcatgttgatgaagatggtgcttagttagcgatctggataaatataactttaggcatgaatgtgatgtagtatgatgaggggaatgctcaaagaatcatgaatacagtctatctctctttgtttaagacaaacgaattgattgtcaagtgcatcccttttgcagtttttggatttgtttgatttcatttataaactgtacagggtactgttattttctatgaatggaagtcttgtcgcctcaattgttttgcctcaaaccacgtctctcattctattgttcttgtacaatagctgtaccatactttcggctggtttgactgtctaattactattctttcacctatactccaggcagatgctcgttgttctgcaagttgcatctgtaatcggccacaagcctggaaaacagaggacctcttcttggattctctccaggaagtggaaatcagtggattcagaggatcagagcatgaattggccttcttgaagcgacgttttggatgggcagcaattctgaagacattcaccatgcatcttcatcttgatcttactgtcagcgatgatttatgcaaggagcttcttagcctcgctacccctgagaccgatgtgaagatctacttctatcgtgatgatgatgttcacgctaggccagcttgggtgttgtatacaccagaagagtaaggcaccaatcggttgaagcctggtactaagtacttaattatgcagggtatgctatgaattaccatgaaactggatcttatattttgatgacactggatgttctgttatgatcgggattaattcccatactttgccctgcaaggttggcatgaagagatgctggtttacctcttctcatgttgtgatttgctgctttgcgctctaattgccatttgcaagatgatgtctgagatgactttgtagcatggatatgaactaggtacctgaatgctaaacttgtttaccgactagagaaattgcaacatatatacatcgaattttggatgctctacacggtgaactatgagctgggtactagtaccacacaagtaatatgattttgcaacaaaatgcagatgctccataaaagtaaatacgtttatgtacctttttacgacaaaagtacacattgaaaacttcccgagtagaaatttgaatctttcagttcaatgacttccacatttaaattgaagagactatcaatcaatcgcccggactattttcacatgcaacttgaaaagtttcaagtgtacgtatagttagttactagcttcaaataatatatagccaatttaacaatttattcatataatagttaccaataaatatataataaacaacgaatagctgatctcgcatctcataacacataaaattttgaagttcatgctggctataaatctgtagccttattttctcctctcttctctcgtctcatgtgtttattactaccttataaacaccgctttcctcgtctcttctcccatctcctgtgtttataactaccttataaacacttttttctttactgtaatcaggagtcaggacatagacacttgaattaaatttgaaaatatattattcatttgttttttctcatcaatattcggtacgcaaatatttttggtagaattatagcgtcgatctcatacaattgcgcgaaaataacatggtctcgagcggggacggtgcaagacaggtctaccagcgagcgaaaccgaacatgctggtcgattcaaattaattaattaccaggattagcgagtgattaattatttattaacagctaactagggtaattaatcactaattattactaattaatctctaattatataattaatcactaattattaactaatcgctaattagggtaattaataattaaataagtggcaccgttggacaagacgttaggttttgctgttccattctgcgtgaccgcgcaagaccgaggtgctaacggtcgtgctgttccattctgcgagaccatgcaagaccgaggtacaacggttgtgcgagatcgaatgcatatttataaaaaaattacatcttaaatatttctaagaaaaaagcaaataaacaatatattttcaaatttaattccacgatggcaaaaatgataattagcgatcaactacacgctcaactcagattttctgttgaactaatacgccattaaattggtctaaagtttattcgtacgtaaaatttgtaggtacaaagtttttatacgtacagattatttatctataatgtttcacgtattattttttatatataaagtctacgtataaattctgtttttgccttgactaaaatactactcataatttattaggcctaagattaaacctagagaagtgctaagagctgagggtcagacgctcggcggtgtatgggctggggtgggatgcgatcgtgcggctcctaacgatagatcgatcgcttattagcaatctcccactatggggcaatttggcaataaaaaatacggggtgtagtgaaagtggacatgcggtagtgtggcgggaatcatgccgattgactgcactgtgcattatcgttgcctactccctgagcaacactaactcagtgtcgctgaacctccatgcgagagcggcttgcctcttgacaactctgtaagagagggactagctacatgaagagattcgaacgggttgcaagagtggttgttcgttgggtgacattagcccatggagccatgggacaccagcacgctcttgccttatgtctttggcaatgtccttagccacggagttctcgttgcctcttcctgcggcaccaactcagtgtgaacatccctcgaggcggcaccgccggcatacactcgtgtcgccttcgctactagcgaaatcgagtatatcttcacgatttcttttcgaagatgacatatgtttgcacgatgtcatggaggtcgctcacctcgccgccgctggggtctccgtcctcgagctcgcccgcgtggcgatgccctcccctagtccccttctcctgcgtcgccgccgacgtcgacgccctccttcttctctcgtctctaggcctctccaaccccgagctcgcacgtgcggaacgccctcccttctcccacgtcatcgtcgtcgtcgccgctgccctcctcctctcccgcctcgcccaccctgtcggccagcctacaggaagagaagagtgagagagaggaggaaccgaggaagggaaagaagaggggaagagagggtgatgacatgtcaccaaacatgtcatggaccccacgctgactcagctgccacgttggatgaaaccggggtcaaaatcacctgaggacccaaaatgacccggttttgtaaattgagggatgacatatatcttgttttacggttgggggatgattttgtaattcgatgataaggtgagggacctgtgatgtacttttggctactactctaaataagctggcccaaataggaaaagatcgcgtcggccggtggagaagcgaagcccaaacgaacgcgaggcgcctccgatgtacacgtggcgcctcctccgcccctacaggtggcaagctcaaagcccgaacccgaccactccactgctctgatgctctctctctctctctcttcacgcttcccacgcgcgacacgaggttggagacgcgtcccgtgacgtcatcgtcgtccccgactccggcgagccccgcacccatggcggcggcggccgcgaggggcgccgccgcggcccgctccccgctcgtcctccaccgccacccccaccccgcgcaccaccgccgcctccgcctcctccccctggtcagtcactccgcccccgtctcatttcctcctcgatctctagctccctcctcttgggagtaggcgggattgggagctacctacctcgtgcttgattgaggtggtaattcggtcaactactgattggggttgcaggtggcgggcggcgggggaggctcgcccccgcgtgtggggaggaggatcagggccagccgggagaaggggcggcgggtcgggattagggttttcgcgaggtacagccaggcccaggacttctccactcgcctccaaggtaatcgattggttgatttctttccccatctctgtataattcgatttggtacttggttcaaagccactgtttaggcccagcttagttgaacatttgaacaagcgactgtttctcattaggcaggatacgggtgatgatgtaatatgaagcgagaatttccggtgtggattttcacgagtcgtgagtttgttttctgttcatcgcagtagcatagagaatgttatgtattttgggattcgggtgggtaaaatgtgtgtctcttcagattaatgtactccttattaacattcctcacaaaaataagtagttatgaacaatcttgggatagctagatcacagatgcattgaatattaagtttgtttgttcttcgcaaaatcatcccatgtctttgatttcgttcaaatgcagatagagctggcgaattgcctaagttggttgaggaccttctacagacatcaattagcacagggccacgaggtgcttttaggtttgcccaagggatccaagctgtccttggggttggtggggagtggctaaatgacttctcaaaggttatttcttgtttgtgttattcatctattttgtctaaaaacttgatcttagaatttctgagaactgaaacaatggaagcagctgtagactgaactactaatgaactactgatgtgttgagttggctgaggttgtatgggagaatattggggatttagggctagtctagatgtggatttttcatctatgtagaaaagaggaggttaaatttttgttggtgcacaatgaccaggtttatctaagatattttttttattgataactttggtttcagaagcgtaatatcctgctgttaatatgatgcagacagccaacacatcagcaggaataccagctcagatgcagctgggtttgctttctcctctttatcttagaaggctttttgagcgcatgggtgcaacttatatcaagctaggtcaggtaaggacatgttcatactttgcggtttatgctatcatcaactacaaaatgtgtccatctcaaaagaaaaaataaactacatgtgtatgtgttccttaattaatagattgtcttgaatttcttaatcttctgtaccttttgaaagaaatgccagaattcttcattttactttgtatatgtagcaaacagaaacaaagaccactaatatatctttcagcaacccagacaatagtcagttgcttacttgtcactagacaggtagagtaacctatctttagagtggtcctttgggatgggcaaagggagaggagttaaaatagttattcagtttaatagtcatatattttatgattatttcaacctggatagtcaactgactgtggtggtgcagttcgtagcttctgcaccaactttgtttcctgcagagtatgtcgaggaattccagaactgttttgaccgtgcaccacctgttccatatagtgagattgagtcaatattgcgtgaggagttgcaacagccgttggatagtgtatatgaatacattgatccagttccaatagcttctgcgtcaatagcacaggtttctgttgagaccatcagaagttctggactatttgttgtctggagctaaagcactgatataactttattcttatccaggttcatggggcaaggttgaagagctctcagaaggatgtggttatcaaggtcctcaagcctggtattgaagacactttggtggctgacctgaattttatctatgttgttgcacgtattttggaatttctaaaccctgaactacagaggacatcactggtgagttatcgcctaatgagtctttcactggacaggatttttttcattcattgaacaatcactggtcctggtggttctcggagcgcaggaaaccaaaatttactgctttctttagtataatcagaagccagaaggtcaaaatatatttttgtttgattcctgtatgcagcaagcaatgcatgccatgaaattgctcccatgaccatgaggatatgtttttcttttggtagttgaggcaagatcattgaacttttcacagttgatttacatgtatttttcaattctagccactgtgctagagttggcacaattaggtgcagaaacttttaatatctatatccttaaaatttattagttggattgaaggcaccacaatattcctaagatcagaaaaaatatgagtttaaaagattaacagaaaattcagaaaattctcccaataatcaagagagaaagaaatgtcttgccacttgcgtgttgttttgatggacctagattgtaacctagtagattaactatagttgttatagttgtgtaacaaatacaactgcacctctaatcattgatataagagctttatagcaaatggaattattgttaaatgtaatcatgcaactgcatggatatcccactaaaaaattgaatatcgaataaggaatatttcatggtggagcacaatatatcttgagcttgtgacatgaggagttgactatatatattattcacgtactataactaaaaaggaaaaaaaacaattagttcacacaaccagaaacaaatgaatactttatactttgtagttcatatatgtggaagtagagacagcatatagcaatcatgaaattttctgtatacttggttatccaaattttgtggtatcacaagttatagaagaatataataagagatgtccttatgctcagaattttatattataggtaggaattgtcaaggatataaaggaatctatgcttgaagaagttgatttcaggaaagaggctatgaatattgaggcttttcagaggtacatcgatgcaatgggatttgacaggcaggccaaagccccttttgtgtatcgccactgtagcacaaagcgtgtcctaactatggaaagattgtacggtgttccactcactgaccttgattctataaggtctcttgttcctgatcctgagctgactttagtcactgcacttaatgtctggtatgctccatgcgtccttgtgattccatacatcatatatttgggtatttctgccattcattgccttattcaatcctcagaataggcatgttgacatatgtgcaaaatgtgcaggtttggaagcttgatttcatgtgaatccttccatgcagatgtgcatgcaggaaatttatggttgctccgagatggacgtgttggatttcttgattttggtatgtaacatattctccaatctccacggtggcacggttgctctatatctcattaggcaatttaggatgcaccttgtatttgctaaaaaaggaaatattctggccttttaattcttacattatctattagtcaaaacacaaagtggtcaagaaagtttatcactattggttaataccatttcacaggaattgttggccggatatcgccaaggacctgggctgcaatggaggtctttttggcttcatttgcaactgacgattataatgctatggcatcagccctttctgaaatgggtgctacagggaatgatataaatgttaatgaatttgcaaaggacttggaaaaaatattctcatcaatacaggtaatatttcccaaaatagtaggttatttgatgtcatgaaggcctggttatcccgtgaacatggtgacccaatttcgactgttgaagtgccaaaaatgatgccagggtgaaacctgggctgtgtttcacaccaaaattggaagtttggttaaaattggaacgatgtgacggaaaagttggaagtttgtgtgtgtaggaaagtattgatgtgatggaaaagttggaagtttgaagaaaaactttggaactaaacacggcgctggtctggcagtagtaaaatgctgaatgcaagcaaaagtggcttatggacaggaatttttgtggctactggctagtcaaatttggatatcgttctttagttagtgttttaccacttatctcgtggttaattttcaattgcattctcatttgtgcgcaggatttggatactgaagtcatagttgcaacagcaagaactcctgatgctacagcagtatcggctaatgttgtcgttgacgagagacagatgaatgcattgtttcttgatctggtgagctactttcttttctctctcggttagaacaaggtagagagaacttctaccttatacattcgtatcactgtatgttcttgttggtaaatgttgcctgccagcgtgtattgttttcacgaaagaagagagatgagggaaaaaaaacaatgctgacaattctgttgctctgcgtcttccaggtgagggtcagcgagtcgtatggattgaaatttcctcgcgaattcgctcttctgatgaagcagcttctgtattttgatcgctacacaagattgttggctcccagcatgaacatgctgcgagatgagagggttaacattagctcccgccaacaggccagaagagtagatcgtttccagtgaccgatgcttgtgatacactgacaagtagtacgtaacaagctcgtgtaagtgtaacctactaactgtatatattttcaccagatcaacataggaatgaaccgcagtgcagcggccaaggaaaatttggacgagtataactggacattttcatagtagcaagtcgctctgtaaaaggtgtacgttaagatggaagtaaaatgtagagaaaatagaactgccggggccgctgggctgactccacatcatttttctgaattctttctttactgctctcctcacaagccggcgctgcgtaaagaaggccagtttggaaaacatgattattttgaccgattatactctagtggattattaagatgattatagatgtaaattaaatattttgataaataagcttaataaatagcttagaataaataaattggttagaataaaatggagtgttttaaagaaaacgtatttttatagacgtagagcaaatggtttgggacaataatcctagaaacgcttcatatcgagcgtacggtagtgcatgcctcggacgccctcctcccccgtcttctctcccccatgcccctcctcatctctctcacgccgacagtttcttcgtgctcacaatctacaaccttggcgagttaccgcctaagcgcatcgtcccactatagctgtttgagaagggttctagctagctattatatttgctctcatacagtgcaatttagccgctatagcttcatttaacctgatatatatagctgtttgaaaagctaaccgctaaaacattgatcgccaaccagccattgagagctgggccggcaaacgagctgatcttgtgctcggcgagtgccgtgcagaggtcttgttcaggcaggctggagctgaactgacccagagcctcaagctcggggagaggatcgatgacctcgatcggtgatcactcgctcttcttgggggcgaaagacttcccggcgttcaggccaaactgcgactgcgtacatgtacttcgcgcagcatga

SEQ ID NO: 71885 - DNA, 34676 bp, Oryza sativa
aagcttgcatgcgctaacgaggagcacacatgagctgctttaactgatgtcaacagaaaagaccaaagagatgcaggttgactttggggggcatcaaccaaacatgatgatggctccacatgcttatctataacgatgccactttacagatgccctccatgactgcatgcacgaaagtcattgtcacttgtttttcatttgaaagtaagacttgttgataacatgaggcttctccaagatcgcactgcctgaaaaggaaattacataacgatgaaatgtcatgatcagaaaatacaaaatatcttgtgtagatgcatcctaatatctttcagtgttgttctgaaagattaacttgaagttttgctaacaccacattgaatatactcttgcctgccaacatagtttgtatatatgacagtactgaagcctgaacgtgccaatttggctatttcatccaaaatggtaggtaatgaactaatggaacctgaaaaactgaaaagacttcagtgatagaaatagttgatcagaaagtcagtataatgcactaaggagtctacatcttttcctagataataattcaactaggaaaacagtggaaccactaccttttctaggggatagggggttttttgcaaacagcgaatcaatgatacaagataactcttggtttgtcaaatggaacttcagcaccaggaagttcagcgcaaagtccccataaatcaaatttaggcaccaaatgattttgtaacaccatacgcttattcattattatattgtttttcagtaccttggaatgaggatatacatattacaaatcaattcacaagtcaacatcaatgaaaagacaaaatcaagtcagggaacaacaagatttcctttccaaaaaaatgctaagagattacacgatcctttttacattctcaaaacctataaaagactcaacatatgatttaaattaacatgtatgatcattcgtgtagaacattaagaaaaaggaaaaaaaaacatagctaatgatctaaccagtctcatccaaaaggccctgccctcatgtcagcaactggctttggcatcacaggacccatgcacgaaaagagcgatgctttctttggcttactaccaaataggaaagttcgaagaggtactccagctttcattgacagagatctgaagctatgttgtgttcggtttcttcttcctatagacagttcaatattctctctcagcttcaaaagagccctcccaacctccacttggaggctcctcacatggtccatcccagtttgtagctctttggtaaccttgctgttctcttgcttcatactgctcacctctccttggaactttgcagcctggaaaggagtgaaatgagcttcatcagtttggcccaatgctgtgatctttgatatctcctcttctatgctgcacagcaatgagaatctactctctagttccccttgtagcagcacattcttttccaaccatacctgcagatcagtgctcaagccacgcaacttcttttcaagcacagctgactcttgttttctagctgactgacaagaaggcacagcatctgagccttcctgcgctttggcatctgtaagtttatccatctcagcttttgctttatcaaatgatttctggaacttctgcatataatgatatgatgtactgaatctcaaccagaagtccaggttttcctccagtattctgctaatttctgctctgaatttatcttccaatgatgggtcatgtggttcttcatgttcacgtatcttcatgtattcttctgtctcagcaatatttttgttttcaagactaggagaggcatttgcttcagatgattcttcagactccacaaaacgctgaggtagagaattgttgagcttggtttgtaaagagctcaacattcgtctgagagagcgaatctcatcatcttttgttgcactggaactctttaactcattcatctctgacattgcctcgagatgatattctcgatttctcttctcaatttctaaaagctgtttctgcgtatctttgtagttacgaaggatggatgcataatcttttaagagaattttatccttatcctctagcccattcaaatctagttgttgccaccctaaagtttcatctggctcttccttatgtgccttgctagagtcatctaatgcatccaataatccttcatcttttgatttgcatgcaattccggaatcatcttgtgatgaatttactatttcatcagtggaatgtgcatccaacttctttacaaaatcattaagactgtcatctacttcagttagttgctggtgaatatttccattctcactgtgcacagactttccaatccgctgaattgtctgcagaacctcctcaacttgcttcaatctttcagacaacttgctagaatcctcaatcaaagctgccttctcgtcctctaagctatccaggcgcttctgtagttcgtctgcctcatttttcattctattgatttgagcattttgtgaagaagctgcaatttctaggctgatgaccttatccacaatttcatcaacctgtccggctagatgcaccgcggacgcctctgaggacgactcaaacttttgtttgaccttttgtgataattcctgcagctcgagcttgcagtctttcataattagatcactatcctctatagatgaaggtatagagctgaactctatgtcttggtgattaggtaggtccttctgatcatcaggatacccacactcgctcttgaaaatcgttatcttcttctttgcatctatgactctttgaatctccatggttgtctcttcatatgatctcttttgctcacaatgcaagctagccaatttatcctcgcaagaaataagggcttgtgcagccattaaagctcgagcttcattgtcttcaataactgcgctggtgctaaaagtctcctgcaagctccatacctcctcttgcatctctgccgcctgtctttcaatgctcaaatacttgttcagcgaagattcatatgagctcttgaagaattccttttcagtctgcaagacaaggattttcttctgtagcctctcaatctcttcttgtgccttgtctttactcatcttagagctgatctttttatgtgtttgcgtcctctttggagctgcgctggttcctctgttgatattaatccctgtgataccttttgggaaaccatcaccattgtcatcttgcagagagagctggacttgctccggaaatgcagttgctatggtgtggttggacttgtgaagctcccctgatacccggtcatatctatcagcaagcgcctggtaagatctatatgtctcctctacatggtttataagatcgggcctgctcttgaagtataggtctgccttccttgcaaatgtatcagcctctatatctatgagtttgatcatggccttcacccttatctccatctctgcagagataaccatacaaaccttttgaaacattgatgagaacccaaaaacaaacgctcttactagaaatctacaataattccttcagaatcatttcatgttaaagaagattatgctaagtagtagtaaataccaacaggacaccgctatcacctcatccgtcgtatccacaatagattggaacggcaatagaaaaatgtagctacgaattctgctgtgctcgtgcgttgttcggacttcggagagcaatggcgataccttggacgttgttgtcgagccatttggactgggtggtgcggatgtggctcgcccaccaccacgagtaggcgttgctcgccgcgcgccgcagcatcgcgggcagcctgcctactcctcctccgtcctcctaccccccacctctcctcctcctcctcctcctcctcctcctgttcttcctatgcgtcctagccttcctctacggctaatgctaccgctactggcggcgtggcgctggctagggtgagggcggggccgggaaggccccggggggccggtggtggtggggaaaggcatggcgagattaggggaggggaggggatccgtccgcgagcggtcgcgctgcggcgggtggctgcccgcggcgcgcggccgaaccgccctgcgctgcggccggccgcccgcgaggcgcggggacgccggtggactgcagtcacggcacaactttttttttttaatttctcttttttgagaggaaaagtcacggccgaaactagtgggcttgagggttcaagttcaacccatcagtgaagttcggaactgcgtggggccgggcctttgacaaggctgacggactctccgatgaacatacgtcggcccaggtgaccatccgatattatcttccttttctttttttttggcaattatcctttctttacaaaatggaagtataacttttgatctcgccgcaacctaagagcaagatcagtaatacagttaagtgccgacggtaaaacggaccatgtcagcctacagcaatatgttgcacactaatcatacacaacttccggtgctggttttcttttttttttaaagtaatttatacgtctacagtacatgaacttgataggtgggtgcgatctagtaaaaaacgtgaaaaataagcatataggtgcacaacttggctagtgcgttcagtaaaaaaaaaaacttggctaccgtgtgtattttggttgaaagatcaatattccacacaatacttttatgccatataaacaaagcagccactcatgtcatctcgataaggatctacattgttttttaatttgttagttataataataaaataatcagtcattttgaaactgaaagatatatgattatcaaaagtaagtgtatgcagataacataatttctaaacgattcgattaatcgacatatccattacctcaggttatgaacatggcaaagacacaaaattgaatccatgagccaatgatctactccctatgtttcaggttataagacgttttgactttggttgaagtcaaactgattcaagttgaccaaatttgtagaaaaagataataatattttcaactaaacacaaaattattatgaaaatatattcaattattgatttaatgaaactaatttggtattataaatattactatatttatgtataaagttagttaaatttgaagtaagtcaaaacgtcttataacgtaaaatggagggagtagctgttaagcttataatactaggattaataaaagatatgtgtaaatgtttttgactaaaatgcacatgattatcaagtttatgtaccagtctactcattttttaagttcttgcactaaatcgcacgcacctaccaatttcttgtatcgtgggtgtaatttactcttattttttcaatcttactttactagcacgatccctcacgagattggatgatattgggttggccccacaaaacgtgttatattatcaccaaaagcaatctgctatcaagtagcacgtgaaaaactacactggactcgggcggtaaaataagcgcccacttagttctctctcttccacatatgaattaaatgatgtgacatatattggagcctacccagtcagcttatagtactttactgcttgctctaaggccgagttgtctagtgaggttcccaagtcccaacatccactcactcagtttcctgcatacacgcttcctaaactgacagattacatgtttttggaaaaaaagaaatataaaaaagttgctttaaaagcacattatttttttaagtgtgtttagataatgatatttaattgatcatacgtcaatttatcgctttgtttttttttttgcatgaggggtttagttccaaaccccaaccaaagaacacattataagtgtgcatactgttaataaaaactaagtatgcacacaactataaaaaaaactagtatgctcacaattatattcatggacaccataatttaatcccgatgatttcatcaccacactagtattgcttaactgtaaaatcgtgttaccattgtccaactaaattttaaatagttatagtatagtttagaaaaagataatggcatctataaatactccgagaataatttattttcgtatttacaaaccttttattgtatcatataattcgatcatgctaatataacttgaaagtgcacctaaactcctagtgaattttggtactaacatgtttattgaggaaaaatggagatattagccccgagttgtattactggtgcaaggatacccctccataaacaaaagcaagcgacaaaagtgcttgaagatatttttgctttatattttttcttttgagtgagtgtgtgtgagagagagagagagagagagagagagagtcacttggcaccatatgaccatactcacaagggaaaacgaggcttggagcaaagtgatgatcactggagactgaggtttggagcaaagtgatcaccggagactctgataggtgtaaaccggatactcatgtaaacttattagttgtgtgcaacaaaaaaccatagaggagactctggcaccttttttctctagctgacagagtgagccaaccagggactctagtcttcctttcttggagcaatccaagtaatccaacaaactagagactcagatgtttaaatttgtgtgtaacggctaattttggatgggtgtgagcatttcactatcctccatgctccccaccccccttcctcacacgctctgaataagtggatgtcagatcctttagacctaatctcctagggtttccaccccttcttcttctaggttgttgagccaattttattgtgtgagagacaggggattggatctaaaaatatagtgaactagtattgaattgaacacctatgaatcaatgacctaccttcgacattgtgattcttactcttttaggttctcctcctagccagctaggcgtcacctgcgagtacccgattgttatgatagccctagaaggttttgtgaaggtttatcatcacctctggaacgaaagaagtatttgagtggatactaatcatggtgctcttggtaaatcaagcatcattggatgcagtagctcgtcgtccaagcttgaatcttggtggtcgcttggaaacgaagttttgtctcggtggtagcttagaaactaaaacttcttcatggttgatagcttggtgaggattgggtcaattgagatacaggttccttgaagtccctcgaaggggagtatggtcgctctgtcaattgttgttctgttgtggtatcttatcttgtgttttctatattcatctcgctatctttccttcccgctgtaaatcaaaatgttcatttttatattagtttattgtgttttatatattcacctggagtatatggtgtgaaataccggagttcaaatatagagtacacttcgagaaagagtgtaagcatatagattcatttggattggattattttatacaatgtatacataaatcaattcagttgttgcaaaaacactatagattcaattgttccaaacgggacatacagattttgactcttgtaaatgtcaaagaaacaactctaaaatctactagtagaaaagaaaggcactatcaaaacgttcatttttcagctttgccaacatttatatttcgttttttttgaacttttgataaatgcactatcggtgctatttagctcaaatttagtattcatttgagcttagaaaaaagaacataaaaagcagtacaatcattgaaggaatgttcatgtcatttcatctgaaaattttactggcatactccctccgtctaaaaaaaaagacaaaccctggtttccgtgtccaacgtttgaccgtccgtattatttgaaaaaactatgaaaaaaattaaaaagataagtcacgcataaagtattaatcatgttttatcatctaacaataatgaaaatattaattataaaaaaattttatataagacggacagtcaaatgttggcacggaaacccatgatttttttttttacggagggagtacatatggagtacacaaaacacagtcccgctaaaaccatcgcaataattcaaagcccccaccagtcagagagccaccacggcagacggcaccgtcccgctaatcttttcccaaacccattcgatttgggcgccgaaaatacgaaatttcagatcccgcccgccatctcatcgatccgcgcttttgtccacgtcaccaatccgtggcaactccctcgcaccccgatcccacccgtccattttctccctcatccaacggcccaaacccactccacatcgccccgccctgccctttaaatatcctttggccctttcgcctaccgcactcactgctcacaaccaccgaatccttccccaaaatccccaatcccccatctctttctcctccagcgagcgagcgcggcggccatgtcggggcgcggcaagggcggcaaggggctcggcaagggcggcgcgaagaggcatcgcaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgaggtccgccgctgcatccgcctggccgtggggacaagtcttggctcgcggtcaagaaatccgggaggatatctccaattgatctgggtctcagttagtagtagtagcagtagtttgtgttggcatcgttcttgtgcctggggcaagtttgctttcgtgttctgaacttgtgctgtgtaaatccgtatggtgttttagctattaacaaagttgggtcattcgctgcaaacctcatgcttctagttattgttgttcatatgagctagtataaaactgctagttttgtcttgtgcaaatctcacattaggaatttctattcgctccaactgtttattgctgtttgtttttggcgaatccttaagaatcctgcagcatttaggtggaatgtcaacctcaaggtcagattgttttcatatggttgatccctatcttagctttgcacttcttaattctccaatctccactactccacccttttctatggtagaggtgctcactgctccctttcgttcaatgattggcatgacggcgtgctcttctgctgaattgttgccaactgagcaatttgccgatttggttgggagttgggactgcaaattttgttgggagttggacttcgtatacgcaatgcttagctatgtactccagcagtatcgagctattgttgcatcgcacgcgtttctggatcgaaatcgttgtttctattgcatgaatacgtgattaggaagagatctgtcacccaaaatacttttagagaagggttaaatattttttgtagttctgatttgatattatataaagaaaacaactgtcaaacacttaaatttgcggctatatcaatactattccaaatatagaatgcatgcagttaaaccttgaaacttcaaatggtttattgatacataccatattaggatttgacatgagaaaatgttattggtaattggtaaataagatttgtctagaaaagcactttcatatgattatacttctcctaatttttataaatatatagtcccaaaaaatagccatgaaacatatatgtattggaatgataagtagaaaaaacagaggtggtaaataacatataaataaaatgcatgggcattcaacaatgtcaccaagatattccatccatagtaatttatctgatactaatcctagtactcatttcatagctaaggctgtgtttagttcctgaaattggagagaagtttggtgaaaattggtagtttggaaaaaaaagttaggagttttatgtgtgtaggaaagttttggatgtgatgtgatgtaaagttgaaagtttgatgtgaactaaacagaacctaaatggaagaagtgcagaaaaaatattcatgcgagttctgcatttgcatcccctaaggtcactcacaatgcatcaccaaattttgaggagtcaaaactgctacatagactaaaaacttcgtaagcaactaccttcaaggcattagcagtgcgccaccgaaaaatgccggacctcactagccacataggcgaggaacaatataagctacatgtctcatagtgcaggccactcgtggtgggtcccactagtattaccttttttggtaaaatttgctataggacatcaaaaaaaatttgtaattagctagaggatactgtaaaaacgtgtatttgctatagtgcatcgcaaaaaactggtaattggctgttggacacccgcagcactattttattatttttggaggaaaaggagagagaaacagctgtgtaaatacggttataccctttgaatttgtttctttttctttattcttttctttctcattctctctcttctctctattctttcttcttgcttctctctcgatcccctttctcaccacgcgagtgcacgcctgagcaggagacagctgacgtggggcggtgcgaggcgacggccgggcgcagcagcgcaggcgccggcggccagctgtgtgcggcggcgcggccaaggccacgatggcgtggcgctacggcgtggcggaagctggtggcttgccgttgtcggcgtggtcaccacccttgccccagatgagcgcgtggtctcacatgacgcgaaggaggatagctcggcggcgaggcgcaagccaccggtgctggcctccgggtccgccgggatgacgacacacgcgaggctgcatagcccggacgccgcggtgagctcgaccaccgagctgcgccggttgaacctgcccatgaggagccacgagaggacggacacgggcatggtcgccagtgacaggacgagcatcttccttcgtcccagatgagtgtcggcgagcgtcgtgagtagaaagcctccgacgaggttgtcagcgaagaacgacgacgccgggagggagacgagcgccgggcagccgccactcttgagcgcctactccgacacaaccgacgtcctggctgagtggtcccactcatgtcgcggcgctccgccacgagcgcgacggcgccactcatcgccaagccgagcatgcagatgagcgccggcgcgcgtggctgcatgtaaacccccctcccgtcggcgaacgtggccggcaccgtcgccgtggccgcggattgccgctccgccacccggcttgtctgggaagaaggagagggagtggggactttcatgtggggcccacgtgggagtcatttgagccaagggcaaacttgtctttaatcattgtttccctagttttcctccaaaaataataaaataatgctgcggatgtccagcagacaattaccattttttttcgatgccttgccgcaaatacacatttttacggtgtgctccaactaattacacgttttttaagatgtgctacagcaaatttgccaacttttttaccttttcatctctctctctagtttccccaccggtactttgcgtcacgagagaagcaggcgctgctcctctaccatttcatctctctctctctttactttcccaccgcgcgagcggagctgcggcggcagtgccgagctagcggagcggcggcggtgtcgaccggcggcgtcgagcggcgcgacggacgacggcggcggcctcgagcggcgctgtggacgacagcggcggccccaagcggcggatctctctcctctcgccccgggcggcgtcgaaggcggcgggcggggtggcccgagcggcgacggtgccgggcggccgggcgacccggccggcgccactcctcccccgaccagcactcttctcctccccggccgacgtctcttctctcccggcgctgcccaggcacggggaggcgggcgccggacgtggagtggagcgccgacgccggacttggagcggggtggccggcgtcggacgtggagcaggcggcggcgccggacgtggagtgtggcgccatcgccggacttggagcgaggcggccggcgccggacatggagcgggacgaggagatcggaggcgagcgcgcgcgcggagcaacgatggagaagccactcgctccaagcgcggttgcggcgctctctccctgccccatgcgacctcgatatcaccggagaacttgtgaccttctttggacgcgaggacctcaggtttgtgggcccaaacacggacgtggcgtagattctccccgctttgccgacgtggattgctcaggctgaatgccaactcattgcattatgaacgtggcaacccattcacagtgcacgtggtctcacaggtaccaactttatcactttactaactttttctttatcccctcctttcttcactcctttttccccaccccatagccccaagccgggccgagctcctccgctaccgacgggagaggcggcggggcttggcgctcgccggcgcaccaccctcctctccctcctcccacctcccatgaaacaacggcgaggtcggcacgcggaagcgggcggcggaggaatcggcggcgggggagctcggcggcgggggagctcgacgtcggccggcgagggcgccgtcgcttcaccacctctgcgggcgagctcctctcgtcgccgccggatgggatggcgaactcggcacggatctggctcggattcggcgcccctactcttcctctccggcgagctttttcactcactcactgtgtttctctcacaaaatttgctgaggttctcggagccaaaactagccatgcgaacctggtgaaaacgtgggccccatctccttctctcctccatgcacgcattggaccgacatggacagagattaccacacgccacctcaccgcatcgtgaatggcctaacgttgggcctgcataaccagtttttgggctagtcaggcccgtttacaaaccaagccacaaggttataagcccacacacacgtctctcttctctactcgtccccctccgccgcacccgccgacccctcctctctcgtccccggcccgacggaggtggaaaaaaaaaagaaaaagaaaaaaaaactcaaaccgccgcactcgcacatccggctcgccatagtccccctcttctccaacgaaatcttcgccgtgtcaacccgcgcctccgatttctccagcttttctttcccgggattgcgcgcgtgctccctcccgctcgatccggctccgcttgcccgtgctagccgcggactcggggggtggctctcacctgttgtgaggccgctagggtttcagctcgagctctggagccgtagggcgccgggatatggcggcccagggcggggaggcggctgccggatccgacgccaagcccactgcggtatgcttcctctgctcctgattcggcgtcagtccctagcttgtgagttgtgaggcctctgccgccgcatccttttggagttgtgattatttcctgcacttgcgcggtgtgattcgcctctgctttgggttaggatgcagtgggtggtatccataatctagttgattacttcagtgttttctgcttgggcgtgttgccttgagaaacttaggtttagtgcaacggttggatatctagttgtagccggtggaagatgtttagggatgttttttttttgctaatttacttgttcacgaatttaggaaaaccaaggactgaaatagtcgaagtaggttgatgccatatattacaatgttgttgtttactactacctccttccccaaatgtttgacgttggttagttccaacgtcaaacagaaaagaatggagggagtactactgttgctttgcttatagcataatggctgcgcactcttcctatctacgtacctagttgacaagccgtcatggttgttggtcaatttgctgtggtttagccgtttagtcccccggaggttaatacatgaggcgcttataatgttgtccgttgccagcgttttggatgtaactgaatagcttgtttcattctgaaattgataacgttgtttgtctgcactctacataaattgtatgcttcattctgtactctttaatgttcagtggatatggctgatatggagctgccacgaataaagttttaaatgttattaattagagcgtgcccacctatttacaaggcgttttctttccctttttgaaaccggcatgcctaatgtttcggatatagcagtaaacaggtttcggaaagctaggatcaaagatctactggtgaaaccatttagcacgtgaggacctgctttttaggagtctgttttgtgaagtaatgccctaagtgtgaggacctgtgatgccatctgcttattctgtaagacataaatttataaagatgggcataaatgtaactgtacttatgtaggtttgtgttaaatttgttgtgcatctttgcttgaacggcaggttaaagccagttgatgctgtagtttgtgtatattctaatattgcatttattagacagtttctgctgtcatttgtttgccacgtcatccttttagattttctctgccacatctgacatgtcattatgtactatattgtgagataaagcatgaaaggggaattctgccttgtatagataaaggtggttttgtacaaaacaagtaaggggaattgtacataaaggttttttttgtataaagactgtcttataaaacaagtcattactgtgtgaatattaccttggcattctttttgcatctcatgctgtttttttttctgtgggtcacgtggcacaatagtgtactcctaatgtttttctgcctgtttctacactttgctacatggggatcgatatttctttccatgattttccctgttttgccagagaagcgtcatattgtgttgtaagttttttttttcacatcatacattgttccaacctgaaattttgtttgttctaaacaaataatagggcacaggcatggagcagccaagtccatctccatatcaaccttcagcttctgatcatcatttgtggtcttcttcgactggtgctccctggaactattcaatgaataactctaaccaaaacacagtttattatgacccacaaagggatgtgtcagttccaggatctactgaaaatgtgacaagtggtgcaactcatgtggtccaatcagctatgggcattactggtgcaactgattcttatgctccttactcgaattctgttcaacccggttacaatgctccacagtatccaaactattactataactgtccacaaagtacaaatgaatcttctgttcaacaaggagtagatcaaagttcaggtgctgcttatcagcctcttacttcatttcagaattcaggatcttatgttggtcctacaagtaacacatattataatgctggtgctcatcagactgcaccgggatatgctaccagcaacaattattatcaaagcaattcctggactggcggaagttctggagataatcatgtacaatcatatcagagctatactccatcagatactaatgcagcccagagttctagttcactacccaacaattcttaccattatcatcagcagtataatcaatggccttattattatgatcagtccgcaccaagttctggtggtcctgcagttgctgtcagcagtgtttctgatgcaaacactgccagcgtcagttctggttatgtttatccgagcacccaaccacctccaccaggcactacatggagaagtgatgctggtgcaactgctgtccctcccccgcaggtattatttcttcattagtacttgggaacctgtgactctgagcacttcctatgtcctattcattgtatatttttttattcaggtttttcccacaagtagttttgcgttgccaaatttaacagttagcaattgacaggcaccaggaaccccagtgtttcaaaatcagcatgtcaaccaggcagcaggtcccccagggtatcaaaaccagtatgtcaaccaggctccaggcaccccaggattccaaaaccagtatgttaaccaggcaccagctgtcccaggatttcagaaccagtatgctaacctagcaccaacatatcaaccgggcactacatactatagtcagttaccactaagtaaccaagcagatcaacagaaggcttcacgttggcagggtccaatttcaaacgtttcttcagtcaatcatgtttctgaaagttctcaaccaacttttcagggttctgcgacatcagatgctctcagggtaaacaaaatccagatcccaacaaatcctcgaatagctccaactcttcctatggcaatgcccaaagtagagaagagaaatttagaagctgattcatcaaaaaagcctgcatatgttagtgtcgcagtgcaaaagaatgatgtgaaagcagctcaagatggtcacgaagctgtaacgcaggtgagtaacgattctatttacttgtttttgttttggtgattatcaacgatactattattatccttcagggacaaggaaccaactttgtggaaatttaaacatgcttactccttaacatttccatttttgaaattatatttgtacattcctggctctcaaataagtggcagtgcccagattcaaaatttgtcaaatctctaatgtacttaatgcctgtcgatttctcatgtggtcatgccaaatataacatgcacagctttacatctacctgttttgtttacacaatttcctgatctgtttagggatcaatccctgtttcgcttcgtacttatgttgggcggaatgtttcccgttgcaaggatgatgcccagaggtctgccgtgcagaacatcttgaaagaggttcagtaatctgttgtttttaattctttttaaacactatatcttggtttctgtctggctggattctagttatagacgcaaccttcagttcatgagacctttagtaactatgggaatgggtaaaatagttagggttgttccatactgaagttaacacactaacatcaacgacagcaataaataaatagataggtagatatatacaaggtacataaacaaagatccacaaagaaacaatggcacagaggccagacaagcaaatagaaaacagagtagatcacgtaggtgaattcctgaagcctcttggagatttgccagaaatttcttgttagtttttactgagaaaggttcatttctgctgtaagcattctcttccacatatgcttgtttggaggaatcttgtcaaagatgtatctgttctttagatttggcagaaacttcttgttagcttaacctgagaaggttcatttctgctgtaagcattgtcttccacctatgcttgtttggaggaatcttgtcaaagatgtatctattctttataaccatatatgccagcaaccagaagggaaaaaattctttatacacttctttacaagatgtatatgcacgccttgtggagtttaaccataaaagtagagagctcctatggatctctatcaactcccagcaagctagactgaattcacaggagacacacagatgatcataatcttcaatataattgatttgcgaagaatacatgcttcactctccactttggaattcttcattttaagcatgcgcgttgcgtttgttttaccgtggagaagtagccataggaatattctatacttaggcatgcattaatttttccacaaaaagtgacttcatatttaagctcttaagttgattttcattatgcgcccattggagcttgccatgaaatatatgttcttacaaacttcataaagagtctcctaagtcccaagtttttcccttccgataattcagataatcaccaaggcaactgctgatggtatccttcatactaagaactgggacattgagccactggttcctttgccagaaaacattacaagcacaaatttgacaaggtgtgctgctcttccctccatttcctccttccactagtgatgatgtagcttttcatgtggcagtaaccatcaaatcatatgcttgtattcttgtatagcacctttttggttagtagtattctttaggagtatttcctgcagcttgatttgaattatttggatattggaaagcaaattttgttgccattgatttataactatgtaaagatgctttgctttgttcactatgaaaaaaatctcacatttttctcttaatgcttgaacatacaagtactgtaaaaactgagaacaacagcactgtgctagatgcaatatatgccacttaagaagcatcatgggcaggatcaccaaatcataattcctcccccacctccccacatagaactattaagatcaagaaattattggaataacatctgttctttgttttgttgttcaacacatgataagggtaagtgggttacttgcttaggcaggtaaaaacattgtagagtctactaagaatgcatggtagtaggcacattgacatgtcagttcagtggatgcctcggagcaccagtgcatattgtgttggagggcctagcttcttcctgaagatgcttttctggaataagctggtggggacggacttcagctggccagtactataggggcttaagcctctctaacaaacctcaaaatctacccgttagagtcttatagaggatataggctcatgccatatggtggttttaagcttacagagttcatcaaaacaacaccataaccaaacaactaatcttggtcattgagataatcagataaacttgggatttatgaaaaataccaatataccattgccattgtagcactgaggcatcgtgaagttgcaaaatgccatgcaaatatgcttgggttataaatgccatagtcatcaaaatccatgctattcatgtccatttaggagaaaggtaatatcacatatgatggtactttccacactttatcgtatttgcaagttcatgattatcttaatgatatagagctaaatttctcaatcctttttttctttggcagctctgcaaaggatttgagccccttctccttctcaacttctaggaggagccctagtagacgtgcaaaaagcaggtgggaacctgttgtagaagaaaaggttgcaaataaggtggaattgatttccaaagaatcagcaaagaccaatacctacaatagttcagaaacaactaaaagagcggtaagatctcagtatgggttcatataacatgcatgcctttcatttatgagaaatacttagctaaatactttgcagggtagaagttgggatattgggaagtttctccaatcccgtcaggctcctttaagtcaatataatcagagacctagtaaaaagaagcggattggtggtaactcaagtctaactgaaaatggaaatgtttcaagtgacagtgataaggagcaggatctgacaaaatattatgctaatgcaatcacaatagcaaattcaccagaggagaagaaacgccgggagcatagatccaagcgttttgaacgtagtcagggtgctgcatcctcaaaatctaggagctctgttccagataaggatggaacatccaatacatatgctaggagatctatgccaatgcttcttagcagaagtaatggagatgatgttagcttcgctgtggaggatttggattgggatgcactgactgtcaagggaacatgtcaggaaattgagaaaagataccttcgtcttacatcagcacctgatcctgccacagtgagaatgctctgctaatattaccttgtaaactgcctagattggaaaaacatattgttgataggaaattgtctctagatgttgttttcttccttttgctactccttgctttagttttgtttcatcataccttttcaggtaaggccagaagatgttttagagaaagctcttcatatggttgaaacatctcagaagaattatctgtataaatgtgaccaactaaaatcaattcggcaagatcttactgttcagaggattcagaacgagctgactgtcatggtagcctttcttagcccactttgtgtgttatatactgcattatactcctgttcactatgttagtccattttcacgggaaatatcatttcacaatgtatccgagaaaaataatactccctccatcccaaaatataaggcacaaccatttttttctgtctcataatataaggcgtgcatgcatgcatacattaattatcttctcctggttcttttaatttggtttattttaattcatgtaccattaagtctctcaatcacattgcttgcatgtatggatatgattcaattaaggaggtgattaaattttttcttggtctttgtgttagtagtggttgtgccttatattttgggatggatggagtagttgctatttgcactccttttcccaaatttagtaatgtgatcatgtgaatacatagttgctgtgtgctattcaatgtggacgcacatgatcatttcttatcaatttttttcttaaactgctgcttcattggcctatttgcatggttggctaggacagatattacaggacggagtagtttctaacagtttggcgtgcctcgattattctgtttgttttaatgttttgattcatgaaggaaattatttagttaatattattttggcatgccatccttttttactctattatctatctttgatttttcatgtcaacgctgttccaacttcccgccatttgtttcatcttgcctgctttttttggtagcttccatattacttgttttattctctctttttttttcaggtttatgaaactcatgcgcgcttagcacttcaatctggagatttacctgaattcaatcaggtttgcttatcttgttctgaatgtctgtccttattcctgacataagaataataaacaagtgtcatgtgctattgtagtttcattacgcacgtctactaacagccttgttagaaattacccgctctcagcggtttgagccaagttaacgtacataatactctggtgaaataaagccccccatgtccttattagtttctagttgaaagtcttgacccccccccctccctctttttttttaacagaagcatatatgtagcacatggtctatactactaccaattgcaactgccgtagaaatgcagtaaattagccatgttaaagtgttggtactttgcaaattgtgtcttttctaaaactggatgctctattcttgaattattaagttttgtttgtctagttgcctcacagaagaaagaaacctacagcctaatttttttattgtttctgctgcaactctttgcagtgccaatcgcaactgaagagattatatgcagaaggaatcaaaggctgtcatttcgaattctctgcttacaacttgttgtgtgtcatgttacactctaataacaaaagagacttgctttcttcaatggcaaggttggttatttcacatgagttggttaatatgagtccattagggttgcataatatgagcacatatgagttggttatttcatagttacatgaaccttatttgatatacatccatatctaatagcttgccaaaggaagccaagcaagacagaactgtcaaacatgctcttgcagttcattccgctgtttcatctggaaactatgttctatttttcaaattatacaagaccgcacctgacttgaattcttgtcttatgggtaaatatgatctccctctctctgtaatttgaagtgttcatctaatttcattgagatggtgtttttgctttgcaacttgcatgattggtgctgtagatctctatgttgaacggatgcgctttgaggctataaaatgcatatctaaatcatatcgcccaactttacctgtaaaatatgctgcacaagttttgggattcatggcaattgacgaagtttgtgaagctaaaagagctgatggattggaagaatgtgaagaatggttaaaagcgcatggtgctgttctttcagtagataacaataacggagaattgcagatagacacaaaggtaaaacacgcagcaggtttttgcaatgtgtttgtgttgtattggcttttgaaacactgcactacctctattgttcgacaggtttcttctacttccctatacatgccggaacctgataatgctgtttcacatggtgatgcatcacttgctgtggatgattttttggcacgaacatcataggtgatgccatgctgagcatttttatcactcatgtggcactgaacttcgaaggtatttctcgattgcatgtagcaatgcctgtagaggaatgttctgttaaatgcagggtaggaccttgaaatggatcagctgaagggggaagcacggtcccttgtcgaagagaacagaatgcacatgagcaggtcgctttctattatactcaaaacgtgctctgggcctctgaatctcagatgctgtgggatcgttggcatgttgctagctctacagccctgcagcagttccattttgacaaacaaaattctggaggcagcattaaccgaaaaaaaaaaaccctcctcgaagtatacattggcgggcattacttttgtaccgtcccagccagacgacaagtgtacatgttgagatgtagtcgtaccttcaggcttcagtgtattgtacaatttttgtttacatcggtgaccctgatgttactcatttcattgatcaactgcaaatagttaatacaaatttggaagtactcatgttggtcgactactgttttattctctttttgttaggtaaaatgaaaaaacaaacctgagtaatgtcgcaactagacgattagccgtgttagaaactgtgcattatggcagattcgtcctgagtaataaactggcctttttgggacggagggagtagaacgtatacattatttccggtacttgttttcagtagtcaagttttatgtattttgatcaataatcaaagtaacaaatacatttaacgtctaaaagttatatcactatattcatatttcaatgctttagcaaaacattaattttatagtttgttgggaatatattcaagtttaccaagtgtcttactccctccttcccataatataagggattttgatttttttcttatactgtttgaccattcgttttattaaaagaatttggaattattatttatttcatttgtgacttactttattattcaaagtactttaagcacaatttttcgttttttatatttgcacaactttttttttgaataaaacgagtggtcaaacaatacaagcaaaaagtcaaaattcattatattacaggagggatggagggagtaatttttatttctgagatgaacggtgcctgagactgagtctcggttacccagtataattgtttctgtgaccgcagcggcagtgcacaagcctctcgagccaacgatcgcgacggcggagtgccaatcgatccgaatcacatccctttgcacccataagaaaatctcatcattctggcaaggctcgcatttgatcgacctacgtctaaggaatggccgtcaacgcacaaatcctattacccttcctcaccgttaatatcgtggcatggagcagtagcatagcagcaattcaaggcaacgaacaactgaacaagcgatgcgagtgtaaagcatgtacggccccgcgccgcgcgctaatgcgttacatgggtgcggcaaacgagccggcaatgatgtagccgggtgtgggcgacggattccgcagacgagcgcacgcaccgtcgtaccgaccgccccccggcatcccccctttcctcccccggcacggcacaggcaacgggctcagcctgggagcgcgggcgcggcgcagcgtttcacctggcccgcaaggttttgtcggtaagccgcgcgcgcgcgcgtggtcgctcgcgaccgaggcctcggctcggctgtggagcgcgcgaccgaggaggaggcggcgcaattaatggcgcagcgcgatgcccgatctgcggcgcggcgctggcagctggatgagatcaccgccaccgtgcgcccgcggcaacggaattaaacctgcgttgcgaccgggcgggccggcgccggctccacttgcagatttgcagccgcgatcgagctgcggttgccgtcgcgaggcgacgttggccgtgagtcgtgagcacgcatttatgggcctcctccccggtctgggttttcggaggttttgccgtttcggctagctattggcattctggcatactagtattaccgctgatagcagcctactatgctgccgctggttcgtcacgtacccctactccaccttcgatcgctgcggttacgagtggatttcacctttcgggtttctaagaaagaaagaggaagggatacgacgttgatacgcatgggtggtagcagtaaaatagcaagtgcagcggcctatggacttgccagaacggcagaactaccttggtgagtcacagtagtcagagtagcgagggtcgtattttactattttagtgcattctaagaggtggacttatagttttgagagcctcctaattctacactcgcccaacaaaacaaatgaacatgcccgctttaaaaaggctgcaatcaaactatattaaattcgatcaaatatgtttcatattggatctgtggtcaccgggtataaagagctctagagcacgtgttaaagggcgcaaggaaaaggatcactctggtttgtcgtacttagttagggaggttaaagatctactgattggaagggagtttaaactctgtaaggctaagcgtagtcaaaacagagttagtcattgtttagcagatagagctcggtgtgagcccggcctatccggtatttgggctaacaatagctgtaatttcattacatggttagtcttcgagaactccgtgattgagtaatatattctcttttcccaaaaaaaaaggctcattcacgaggatatgaacgtttatgttgtgttgtgtagtgatgtgagcgtgtgtgcgtcataccatgtaataaaaaaatagtcgaccaaatattaactcatattggatcggtggctaccaggaggggagctgcgacgaccatgtctatagtagtggttatttgttaatagaaaaaaaagaacaaaggttgaataaaacattgattacaagctccaaattgacttagtcgagaaaactgaaatgacctatattcataatatttgtactccttttatttcgaactacaaatcaaatattttaatttttatcatccttttcaataaactttatatagtttaacatcgtaagatttatatttttagattcaccgtaagaaatatttccataatatatagtttttatgttgttaagctatacagatttaaaacttcaatggtcaaatatacttatatttgaactagaataaacttagaatgataagtaattttaaatggagggagtatataaagttaggcacataatcagaatattgcatcgttgcaaataaaagtccagacataggatgatcacatatacatggcactgtagatggaccgcaattatgagtgccaccccttacatgaggtcaaatccgtatgcatgcaaatacgagcacgagaattgaagcactagtgaactgttatccatcaaccacaaccacgatttactgaacccacggttttacggttaccgtgaaaaccgtgcggttatcgtgaggtatatataattttaaaaactgataatgttaccgtatctaatagccacggtaaccacacaattttttaaacattgatcacagctctaccaccatgtgaaatttatttttacaagatatcacggtactaacacatacgcttacaatgtactcacactcacctttataaatggacacatgcacactttatccctattagcacctaaaaaaaactagcatgataatatattttaaagttgttgaagtcaccacgaatatctcattgtttgatgaatacatcacccaacattgaaaacaattagcagtaattaaatacctatgttaagtttaggactctaaagtgaagtcgcagtacaacacagtttaatggtcaaggttcatttcttttgttctctaaagtagtctagcttattttcaactatgcgcacgggagttgccagtcttttattttggccccatctgcactgaaaagttaatcttgatatgtcacctaagggcatcaccaatatactatgacaaattgatctatagatgggacccatataaatagattttactttttacatatagcaatctccacaatatatatatatatatatatatatatatatatatattgtggagattgctatatatatatatatagacaaacacacacaatatattattagaagaagagagaagagtagagatagataatataatttatttcatatgggtagtctatatgcatatggatatcttaatagatggctgaatagaatattgtattgcttatacactacttttacacatataccctaagatgagtcacgtcatacattaattcatcaccattggattgagaagtacaacaaatcataacagttccatccaattaaaaagagaggaagcagtaaaaaagaaaacttcctatgtcagaaaaagaatctaggattggatgcgatactccctccgtcctataatataagggattttgactttttatttacactttttgaccactcgtcttatttagaaaatttgtgcaaatataaaaaataaaaagttgtgtttaaagtactttggataataaagtaagtcacaaataaaataaataataatttcaaattttttaaataagacgaatggtcaaatagtgtaagcaaaaagtcaaaatcccttatattatgtgacggagggagtatgattcatagtcgttgattttttataggatgaagggagtacccagcatcaaaccataggcttcccagatgattccatacccttcccttcggtctgggggagagcagacaaaaacaaaaataggaactgctacatcattgcacacaaacagagttaggatgtgattgtcttttttgtattttagtcctaaagtaaattgtaatttagtagtacaaactaatcctgcaagtactgaaattttgtattggtacaaaatgtatgtctatatgattaatttatattttaccaaataacgaggcatatgctctgtgcaagttaggatgtgattgtctttttttattttagtcctaaagtaaattgtatcttacaaactaatcctgcaacaaagaggaatgtatgtctatatgattaatttatattttaacaaataatgaggcatatgctctgcgagttaggatgttattgtctttttttattctagtcctaaagtaaattgtaacttacaaactaaggttgtgtttagttcctgataaaagttgaaagtttagggaaagttgaaagtttggaaaaaaattgaaagtttatgtgtgtaggaaagttttggatgtgatgtgatgtgatggaaagttggaagttgggggtagttggaggtgaactaaacacggcctaagggcatgtacaatggttgtcaatagtggtctcttagcgttgctaattaggaatatttgttgacatggaggaaagagaaagaggagagacaaaacatcgttgttatgcatgacaacggcttaacaacgattcttagtcattataatatggaaatatggttgcatgaggataaaaatatggaaagaatattaacaaaaggaatattttttgagttaatgattagagcctttgtcgtctcaactattgtaaagacatggtctctaaataattttgcattgtttaagagatcatacccgtctctaccattgaacatgtcctaatcccacaacaaagaggatagttatggttgcgcaaatagggaaagcaaaaccatggtcaagatgaatagaaaatgacatttcacattacaagcgtattcaaaatactataaatgacacatttacgaatgtttggtagattatttatttttacaataataattaatcacaaattaagataaatatattatgatatagctatagttactgcaaaaatgcatgtttcacggatacttatttaagctaattaaacaacacataaacacatctaaatctaatagagaggaaggttataatcacgcgaatgggtgacttaataagctagtacgaacaatggtaaactctgcctttttcagaaggtaaccaaacagataggagtagtacgatgacttgtcttcacggtaaagatcaacttaatcaaactgaacttttgccaacttccattttacaacctcccagtactcttccattactcccctcaaaaaaaaaaagtactcttccattacattgctgttgcatatgccgtcacttgtcacgtctgccatgcacgaaacggatatactataaaaaaagcagactaacagagcatctagatactcctacgaggaaccgaacgaccgagttgtataatgcgaattgcgaaccgtgcacattgcctcccacggaaccccctcagaacccccaacttgcccaattccccctcgttttctcgtctcgtcacccacccaaacctaaaacgcacccgctcgacgtgccagccagctaacccaccctccccctcctcccttctcgttgacccgcgccttccctcccacggtcacacggtactcacctccacgggtccacgggtccacgcctcttccacctcgtcgttctcgttcaccgcccccgtcccgctacccccgcgtttttttcatatccattgccccgtgacacagccacgcccgtacgcagctacgtacgcacgcatcagccatcacaacccgccgcactcgtctcccgcgcgcgtcgtgctcgtagtctttaaaacttgagctcgaagcatcacaaagtcctaaccacacctaggactgggagagaagcgcgcgggcgcggcatcccatcggtcgcaaaacccacaccggctaccgtcgcgtggccctacttaaactccactttccctcctcctacctttgcgccatctgaaccacgccacgccgaatcgtccgtcgtcctagatagtgcttcgctagctgtgggtgtgcatgccatggcgcgcgcagtgcacgaccgcctcccgttcctagccacgcccccgccggcgccggcgaggggcaggaacccgccgctcgctgagatgctccgcctcgtcggcgctgccaccgtcgactccgacgccgccgccgccgccgcggatgaggaggccaacgcgctgtcgttgccactgccgcgcggtggtgttactcctcctccgcctggcgggcggaccatccagttcaggctggcgttcaccagcctcacctacagcgtccgcgcggcgcggcgggcgaggcccggcggcggcgatggcggcggcgggtttcgcctgcctctgcagaaccggtgcgaccgcgtcaccgcggcggcgcccgacgcgcactcgtcccgcgcgagggtgctgctggacggcatcaccggggaggcgagggagggcgagatcctggcggtgatgggggccagtggctccggcaagtccacgctcatcgacgcgctcgccaaccgcatctcccgcgacgcgctcaagggctccgtcacgctcaacggcgagccgctcaccggcaacgtcatcaagtccatctccgcctacgtcatgcaggacgatctgctgttccccatgctcaccgtcgccgagacgctctccttcgccgccgagttccgcctcccgcgcgcgctgcccgccgccaagaagcgcacgcgcgtgctggagctcatagaacagctcggcctccgcgcggcggcggacaccatcatcggcgacgagggccaccgtggagtctcgggaggcgagcgccggagggtctccatcggcaccgacatcatccatgaccccatcctcctgttcctcgacgagcccacgtcggggctcgactccacctcggcgttcatggtcgtgcaggtgctccgcaacatcgccgagagcggcagcattgtcatcacttccatccaccagccgagccagcgcatcctcggccttcttgaccgcctcatcctcctctccggtggacgcaccgtcttcagtggacctccctccgccatcccggcctacttcgccgagttcgggtacccggtgcccgacgacgagaaccgcgccgagttcgcgctcgacctgatccgcgagttcgagtcgttgccggcgggaaccggacagctcgtcagcttcaacaagacgtggcaggtcatgcacgcggcgaggcacaacccaaacgatgatccgtgggcgccaaccatgtcgctgaaggaggccatcagcgcgagcatctcgcgcgggaagctggtgtccggctcggacgtggccggcgaggcggcgtcgatgcacacctacgcgaacccgttctgggtggagatgaaggtgctgacgaagcggtcggcgatcaacacgcggcgcatgccggagctgttcctcatcaggctcggcgccgtggtgatcaccggcgcgatcctcgccaccgtgttctacaagctcgaccagtcgcccaagggcgcgcaggagcggctcggcttcttcgccttcgccatgtccaccatgttctacacctgcgccgacgcgctcccggtgttcctgcacgagcgctacatcttcctccgggagaccggctacggcgcgtaccgccgcacctcctacgtgctctccaacgccatcgtctccttcccgccgctcgtcgtgctctccctcgccttcgccttcaccacattcttcgccgtcggcctcgccggcggcgtgtccgggttcgccttctacaccctcgccatcctcgcctccttctgggccggcagcgggttcgtcacgttcctctccggcgtcataccgcacgtcatgatcggctacaccgtcgtcgtcgccatcctcgcctacttcctcctcttcagcggcttcttcatcaaccgggacaggataccggactactggatatggttccactacctctcactcgtcaagtacccgttcgagggcgtgctccagaacgagttcggccgcggcggcgagtgctacgtccgtggcacgcagatgttcgacaactcgccgctggccgtgctgccggacacggtgaagacgagggtgctggcgtccatcggcacggcgctcggcgtcaagatcggccccaacacctgcgtgatgaccgggcacaacgtgctccgggaggcggcggtgacgcagctcggcaagtgggagtgcctcctcgtcacggcggcgtggggcttcttcttccggctgctcttctacttcagcctcgtgctcggcagcaagaacaagaggaggtgatcgagccgtacggacgaggttgcacgcgcgcgcgcgcatttgcgcacgcgtttgaacgtccgggggcattaaacgcttggggagaaatagagagaaaatgatggcctagttaatttgaagctgtttaatttatgcaattgttaaggcggatatgatgtgatttcaatttggacccctttttgtttcctgtgatttgtagctaaataagtggcttatagtccactacacttttttttcttctttttctctttgtagtcgctgtgttaaagacttatatatgaaatgatgaagtgttttgatgatttcttgctttatatatagtcttgttgattggttctacttccatggcacatcatccgtaatgctctgtacgtgttaattgttccttgtgtcttggtgcaaaagggagaaacttcccctttttgttgacgttgaaacgaataaagcagaaattcctcgtcaaaactttatcaaccaaaaataaaggagtaaaatatgctgttcttgagcttgttacatttgttcctttgtgatctgatcttcttaatttagctcatgacttccaagcaactttcattgtctcggtgaaagtatgaaaaaactagtacgtcgtaccagtacatatcaaacttctgagtgtttagatatttatgtttctgtcaactgtcatatggtacattgacatagataaagttagataagaacagtgaaggggttggttatggttaggttaggtacatcacatccagagccaaagaggtcataccggtattggcgggtcttaataaatgactacatgatgagttaaaaaaactatactagcttacatgtgtgctctgatttgcttcttatgactattactcctttaaaaatcactgctttgcttgtgtaaagtaatcaacttgctagttctagaggagtttgacgacactattatattcgagaatttatcatagatgatggatgcactgatgtccatacatttcattgggtctttttcacagttcttaacggtgacatatatattacagcaaacctcaacgaaattttcaacttgacaagtttttctaggatacaaatttaaacatttgatgcagggtataaattactagtatgttcttgttgcactgcctttcttgtctgcaaaccaaaactaccctgctcctcatggcagccagcctctccgtaattgagttactggttagtggttatcacttaccatctccaactggtaatagcaccatgtacttgctgcttctcttccaggttaggacagaagaaaacagcaaagtggtcctggagcctggaccatggagttgaaaaaaatggatcatcctcgtcacgatatgcgagagggggccggttgttgggcaagcaagcaagcaagcggatttccaagggaagctaagcaagcaccagagcatatttccgggcatcacctgcaaggctgcaactggcagctgatggctatctgaaccgaggcgtttaggtcagatgatgatgagctgcaccgtaccaaacccggtgttcggagagagacagagatgccgatacggcaacacctgtattttggaaaaatcgcaggcttggcgtttggaaaatgctccgagttcgcagcatgcagcggtacgctgtactatattgtattcgtgcatacgatgggcgcctgggtcctcgttgtaggtcgccgatcgctcgccaaacgagcaccggaaaccgtcgcctgtcagcgtgacggctgcgtcagcagcgccggcacggttgccgcatgatgatagttaactcgtttattgtgagtcaacggtgcttgggacttggggttggggaagggggaggaatcaagtgctcagaatattcatcggttcagcttgagtagtagtactagtttcgagccactgactgtctattgctcgtggagatcaccaagagtcgagaggtttaggactttgggtgtgttcagttcacattaaaattgaaagtttggttgaaattgaaacgatgtgacggaaaagttagaagtttatgtgtgtaggaaagttttaatgtgatgaaaaaattgaaggtttgaagaaaaagtttggaactagccaaggccatgtagggtagcaattctacgatgatagtcatcatgatatcataagactctattgcttgtggaaatcaccgagtgtcaagagggttttggactttatagggtagcaattatacgatgatacttcttgataccataaaactgtctcatttgcttgtggaaatcactaagagtcaagagggttttggactttatagggtagcaattataggattcggatcagctgcagtctgcaacttaagcagtagtagtgcatgtcattggatggtccagattgcatgctgtatagtacatagtactgtagcacaatactgtagcacaaaatactgtagccattactactgtagcgttcgatctgaaccgttgatcgtaaaaatggatggctaaaattgtgtgcagttttatcttgcagttacaggtgtaagtgcacccgatctcaattcgcaattatacgatgatacttcatgataccataagactgtctctgttgcttgtggaaatcagcaagagtcgagagggttttggactttatagggtagcaattctacgacgatagtcatgataccataataggcggctcttcatcttgtgctttcactttcctgacgcaatttaaggggtagtcgtgtcgccatcgggtagttgcgcttggttcggccttattgggcttagaatgatagcttccaatgtcggaataagatcactttaacttccttaactagtgaccgaatttgatttgtgtccttcaatcgcaatatcaaatatctcgacccctcaactattagaaccagtgcaatttgactccctcggtatttttggaggatgatttcactgacgtggcgtctacatggcagtgttgacttagtatgtggtgttgacgtggcgcttaggtggcattagagttaaaaccataatatgggacccttttgtcatccacacacagaaaaattgtggacccactgacatatgggacccacatgtcatcctctcctcactccttcctcctcgctctctcccttctctctctgtctctttctctccccttagaatgcatcgccacctgccgccgaactgcgccgtgctgccgcccgccggtgccctctctttcacctcccgctgcatcgccgcttgccgccaagcgcacggcgaagggtaagaagtcgtgacggcgcggggcgctcatggcggtggaggacctgctggatgttgctgctcctgt

SEQ ID NO: 71886 - DNA, 1659 bp, Oryza sativa
cgagggttcacacacatgtaagcgtttggaattttggatagaaattccgggcgtgacaagttggtatcagagccactttgaccctaggttatgccaaatggttacccatagaagccctctgaaaaatattggaaaagtagaactgttctcctctctttctcttttaattaaaccaaactaatggcacatgtacttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttcctttcatttcttttgaaaccagttattcaaaattacaaaatttgtgacctcgtttccaaatgttttaatttatttcgcaaagcttggtttaccttatttatttccttttttttactttgattttctaactttattcaaaattaatccaaaaaacttgtgctattaattggataaaggtcttaactccctcctttcacttgtctttagatgccgtgttacaagcctgagtacctgtttggtgttgagggttttgtccaggagttgcgtacgatgtcctttgtcattggatttgggaatgcccctttttatgcccagattcgtcatgatcgtcatgaagaaaagtgccgagtcaaagtcactttgaacagtaatagtgaagatatcccctcagtgatgtttgaagctggaggaagaaactacatccatgcatgtcaggaagtggcaaggatcgccataggagagctccgtgatagctacagtgatcaattggccgacactgagtatcgctaccatcctcgccaacctcagggaagtgaccgtggcagttaccttgagactgaaggaattgagaatgatgttaccacgaagcatttggttgagatgttgtgggctatggatgaaagtcgtgcggagactgtgttagcagcttaagatcgtgaagatcggaatcgtggtaagatttgcaagctagaagacaaggtggatcatttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagcggatcctccggtcatcatcataagtgatgaagaagaagaatctaagcgcaacaattccaagtttgagtgggtagctatcaaagatgaggaagatgagccgaacgagccttcaatcgacctccgatgcttggaagaactagagtgacttgttaagccgttgtcttagatcgatgtgttagtttgcttgttttaagtttgcttgtgtgtgtggctcgcatgtgatttacatcagtggtgggatgtaagtgcgtgcgtttgtttgcttttgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcagcgggaatgg

SEQ ID NO: 71887 - DNA, 1145 bp, Oryza sativa
gtatgtatttaatcacaattaatttccgaataggtacaatacatcagaatcagtcaaaaaaaagttgttatatccctgttttgacatccaattttcacagctcaaacttcactgctgaagtaaactcaacggaactcgcacgcttatcaagactgaacaggaaaaggaaacttgaccttagaagaagcggatctacattgaataacagttcgacctgttcaaatccagcaaatcacattgaaaggtaaacatacagaaaatcaacaccattgttagaaaggaaatttttccttattcaacaataaacactgactgtgatatgaataaaatcaggtctagaaaagaaaaatatcagatcccatcaaccaacatggaaacgaataggtatgttaaccacattataaaaatgatatcgtcattcagtttatttttaaatcacttttttcttttatgaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacatgcacatgtcaacactgtggtgcacttttctggtatgaagaaagaactcgtggcaaaggaaaagggccaccttcttttagcttatgctgcaaacagggcaaggttgacttacctacactaaagaaaccacctacttacctttcaaatctgatgtgcaaagaaaaaggaaagagatcgaggaactacatggacaatatcagagtatataactccatgtttgcatttacctccatgggaggaaaagttgacagagagataaacaatgggtctggaccatatgttttccgcatgaatggccagaactaccaccgaataggtactctactgcctgaagaaggcgataaacctcgctgggcgcaactttacatctatgacactgagaacgaagtcaaaaacagaattgacgcatcaacatcatcccataatagagaatcaatagattcacacattgtcttaggcctaaagaacatgctggacagagaaaacgtactagcacagacattcagaatggcaagagatagattcaaagaaggtgactatcataatgtaagcc

SEQ ID NO: 71888 - DNA, 721 bp, Oryza sativa
tcggcctggatggtgctggtgagatcggagtgccagaggttgcggtagctctggcggagctgcatcttgtcgaggttggcctgcgacgacgccatcgcttcttcttctcctctccgccgccggcggcttgcacgaggggatggatcggccgtggactctgcgggagatgtggggggggggggggggggatcgcacttgcaccaagccactatccttctctctctctctttttggggcgcgggggaggaggggaaaagaggggaggaaaacgacggtgtttcggtggggtttcggccgttggatcgggtccgatttgtgcggcctcgttaactgatggccatggcccgccggtcaacgaggcggagtcgtccaaagtttttccccaattttcttttcttttttttcccttggttgtagagtgttttggacgtgatcgaccgaggtaatggacggcacgaacgacgacggcttgcacagacggcgggtgaccggccccggcgacaacgatgcgagtccatttggttcgtcgccactcgccaagccagcaaggtgcaggcgtgcagctagagcggatctgcggagacggggtggggtttacggaacacgacgagcgacccaacgatccaaaagtgacaaaacgtggaatgtaagactgggcctcatagtctatcagctgggctagatggtagtgggccttgatgggttccatgctgttggtatg

SEQ ID NO: 71889 - DNA, 597 bp, Oryza sativa
aggcggcatcgtcgtcgccgccgggcaggtcgaagtcgaagtcgaagtcggtgcccggagccgtccaccgcatggagaagaggtcggcggggtccatgtcgatgaagtacctggagcttccgccgacatcgtcgtcgacgaggcgcttgaacgacggcgcctgcgccgcgtgcttgagccaccggtaggagaagctgtcgccgaggtgctgcagcgagccgacctccatgagctcccagcgagtggcgtgcgcgcgcgagacagaagacgagacgaggaggctgtgtggtttggagtgcagtgcagcgtgctgagcaggcaagggactacacggcatggcacggcgcagatatagggggtcgtctcctctccttggccttggaccgttcggtgcaatgtccatgttgcccctgcagtgtctcttttctctcattgcaaaactctgttctttttctcttgaaatttttaatagaatgttgtttttttttcctgacgggctgctaattacttcctccgtttcacaatgtaagtcattcgagcatttcacacattcatattaatgttaatgaatctagatagatatatatgtctagattc

SEQ ID NO: 71890 - DNA, 1197 bp, Oryza sativa
ggagaaggaactagccgcgttgaagggagaagcaccgccgcagaaggccaggattcgtctcaccgcaaggaagagagctttgtttgtccctcgttatcaattggcgccaaagattcgtgtggtggagaaagaagttgccccagctcaagcagatcctccagtcatcatcataagtagtgatgaagaagaagaacccaagcgcaacaattccaagtttgagtgggtagctatcaaagatgaggaagatgagccgaacgagccttcgatcgacctcctatgctcggaagaactagagtgacttgttgggtcgttgtcttagatcgttgtgttagtttgcttgtttaagtttgcttgtgtgtgtgtgggtcctgcatgtgatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttccccggtttcttttcttatcctgtccatgccagatggtgaacactcgcagcaacgggaatggtcccaacctcaacaaccccaataacaataacaatggagagaatccaacccttgctcaagttcttgctcaacagactcagctaatgcacatgatgatgcaacaacttcagaaccagcagaaccaaggaaataaccatgcacctccccagaacaagttagcagaatttcttcgggtgaggccgcctattttctctagtaccaccaatcctgttgaagccggtgattggctgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgaattcaccgctgcttttcggaagacgcatataccatcgggagtggtgtctctcaagaagaaggagttcaggtcgcttacgcagggatctcgctctgtcacggagtatttacatgagttcaatcgtcttgcccgttatgctccggaagatgtgcgcaatgatgaagagcgtcaggagaagttcttggaaggacttaatgatgagctttcttacccactcatgactgg

SEQ ID NO: 71891 - DNA, 4216 bp, Oryza sativa
ccatctaccagtcaatacccagtaccaaaggtaccaggtaccagctggtactcaaagtactaggtgctagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgatttcccacccataaaaagacatctttaaatcttaactattcattctccctctttcatttaattctaacccttcattcatttcctaattccaatctcatcctccatttttcgttatccaaacacaccctatgtattgatacttttcgatgatgcacaattcctatctttttttttcgtttgcatagacatataatctcgtatgtattatgaattaatttattcggtgtattacgttattattattttttgaacatgctaaatgtttagacacgggcagataaacctgcaaaatggcataaatcttatggtgtacatcatgctatataccgcaatcatggaacaaagacaaaatgtctatattgtactccctccgtttcacaatgtaagtcattctagcacatttctcatatttatattgatgttgatgtatctagacatatatatctatttagattcatcaacatcaatatgaatgtggaaaatgataaaatgatttacattgtgaaacggatgaagtactggttgtcacactataccatcacaccaatcaagcgaagcttgcatcaacgatgatttaaattttacaaaaaaagagagagaataatttgtattcattagccatttcatctaaaagtttaagctgaccgagaaagtctggtaaatatccactcgtatttcaacaaattatttaaacaaagtctctatttgaaaaacatcaacattcaaaaaggggaaaaataattattgaagtctctacgcgctaggtcgctgtcttgttaatcgatcgaattgaataacgtatcaacaaatttcttcgactcaggcaagcaccaagcagatatcaacccaaatcgatcgcatgtcgtcacacacaatctcctttcaccatcttcacgtcattcaggacaggataccacaccgtgcgtatcacgcatttgatatgcgagtgcgctaatatacactcccagtccgatcgatttggcagaggaaatttcatactttcacatacgtgagtctgcctaattgctctccgaatgatctaattgaccaaacgacgagacgagtagtccccggagcgccgctcacgctacaggacgggaaggcggcagccggaagccgcaacgaagccggaaaccgttgagggccctttgaatcaaagatttatatagaaatttaataggatttaaatcctatagaaaattttcctatttgaccctttgattcaaaggattgaagctttctaaatcctacgaaattcctatggaatggcacattgcatatggattttggaagaaatataccaagagctctaacctcttgaaaaatttcctttgagtctatctctctcatccgatttctgtatttttcctgcgctccaataaaacgattatttccgtgtttttcctgtgttttgcaatcctctgttttacacttcaattcctattagaattctgtgtttttcctattccttcattttttcaaccctgcgattcaaatgggccctgaagctagcaacttccaagctccaaccgatagacaactctgtccatggtttcgctctcacgggcgactcttgctgcaccttgcatgcagaacttgtagaatcgcgctataggtttctccaatctccaatatacgaactcgcaaaatcatttcaaccttgtcgacttgtcttacgttgttcttgtgtacgtagagcaaagtacagagaagtacattgctcttcaagtcttcgtccagatggggggtgagagatagagagagcgcatcactttttagccttttgttgcgcggacaaggctaatgtttggaacgctgtctgtctttttcctggccatgccgggctcgtgagattcctggggaactgcccaatgtttcagacgaagaccgtggtgcacagcactggtgccgctggaagtaaaactgtactacgctcgggactctgaaagtctgaactctgaaacctgaccgtgaccggctagagacgaacgcgagtatacgcgacaagtatgcagactttgattcacgattcacgtgcccgggctcagcgggtgtccgcaaccatgcaaacggcggcgtttccggtgcggcaaagctttggcttcttggcgcgcggaacggcggcgtctcacgcgcgcggcacgcccgtgtgagtgggatgggccggtgggcgagcggtagaggggaggggagcacgcggcgggttgggtttcgctggcagcagcgcctcgccttcttgggctctcagcctctcaaccaaaatgggctcctgcgctagctgcagcctaccgcagcacagtgcgctcggttgggtggtgcctgccgccgacgacccccgcggttgcggcgtgcgccgtgcgcggatgcgcccatgccacgagctgtgaactcttaattttagctcaaagaattgggtctagattctatagtgaaattgtgaagcaaaacccagctccatctctcattttaaattatgctgaaactgtttgactgagcttcggctttaagagaggtgaaactaaagctgtgctaaacatgttcttaataaaacatataaaaaaacaggtccctttcgcatcgccctaacaccaccatagtgtctgtcaggcacgttgctaggccaacaaagttgcgagctatgaatctatgaagctgtctcacagtataacagagtatgaacactgagcagcgcaaaaccaactctttctattgccta

SEQ ID NO: 71892 - DNA, 3278 bp, Oryza sativa
cggcctaataagagcccaacttaattcttagtcgctaatccacctcttcggagcgagatactctgaagaattcttcgtcaaagattcaaacaactactacctttctgagtaatgatcaaagtttaaaaaattgatcatttcttgttcgagacgttaaatatttatgatcggagaaagtagctgatagttgtgcgcccgtccatatacattgtactacatgattttgaattaaaatcgtgtcctttccacatctatgtcaagatatgactgtagctagatgtacaggtccaaagtttacggccaatggtgtcggcatgcacgactcttttaaagcattataattaagtgactaatgacgaggctgctttttcagaaagctgctctgatctgcaagacgtatgacagcagcctggactatgtgattcaagcaaccagaaaactcgtgcatcagcgggctgtcgacgagccgagctcaagcgagcttgctcgatacaagctcaaaccggcctataaaatgttcgatgcttttaaataggcttggttcgagcttgatttttaagtaaaataatttatatttcaaggataatctttaaaaaactaataaatatatgataccaatacaagacatacaaaataacatatttgatctcataatttattaaataacaacaaaaaaaatcatatattactaggctcgttagaaactcgagctcggcttgacaaagctcgtgagggggaggctcgggctcggctcgtatggagctcgaatcaagcctaaaacgagtcgagctcgaacagctcgcgagtctcaagcttttttgacagcccacatcagccgtatcatatttataaatgcatcctttataacaaagtaatagtatgataattttatcaaaattgaggtaatgtataaaagtcatgaaaaaacatgcgttccgaaggagcccatgatgttagtagtactggatttttatattttggtcctttataaaacttaacaacaccagtgctgacaccctcacccctgtggcgtccaaaatgtagaggggtcggcaccaaagagactagcaccggtgacctattttttaaatattttttttgaaaattatcccaagaaaaatatttacatcataaccctttttgagtttttttacaaataggtactcggtctactctagcgttgagaataagggttcatttctagaataagttttttcataagtatatttataaaatgagatctaaaaagtcctaaaatatagaaaatcaaggttagtacgaagtacatagcttagtttccctttctcggtagacttatgtttcaattatactctctctgtcccaatataaatacaattaagatcggataagacatttcatagtagtataaattagtgtacttatattgggacggagggattataaaagacgtgcatactgatgcacatcatattgaggcaagcgatagcttcttaaactcattaaaatcctcctaaaaatgcacttgagtgtacataatatttatgagcatcatcataatttgaaaaacttatagatagagccataccatcacatcaccggtgcttcctcaccagaaataatatataatatagaactttaaaggcaagagctagagaagatgaagtgcatcacacaatctacatgcaaaggctgtatccctgaagaacgaaacctgcttagatacctgtttttttatgcatcatgattaagatatactagatgcctatgtcatgtggctaaatctgcattttgtcgaaaaaaagggaaaaacttgtgtgatattgggaacagcgaattttaggtatatagacaatagacttttgcatctatcaagcgttctagtaatccagttctttactacttcctagaaaagcaactacctcatctgcaattttggataaggtcataggctttttgatgatctactcctatgcttgcttctgccaccaataagctttttcctattttattttcttggaaggcaaaaagaagttaggttgacccactaggctcatgctatacgtaaatgaagtgcatttctcaaaccaaagattgacaatttgccctacaccttcatatgagtttcgaacgtatgagttttacaaaacttccatagaaattagatcaattatcataaatatcctctcaaaccaaagattgacaattttcctacacttctacccttgtgactcctttggaactatgaattttacagaacttggaatttctcaggctgtcaaatactagtattttcagtactgaaccacggccaatcttgtgtgatatttgtcttgtggcattatctgatggacaggtacactacagagaaacgtgtactgttttaatacaagcagtactatcaagtcttcagaattaggcaggtcagcaatatggcatgcatccatgagggcaggcaatagactgatagagggtgccccccttgtttctcctccaattcaatgaactttgggacaggagtacaggaccatgatccagaagatgaattattcaatggcaaaattaaaaggctactctgcatttcatctcctaccaccctcacctcaccacctcaccctcctgcctttgatgcttatctgaatctccttttgcagcctgaatataaaacactcctacctttgcaaagttgttaggttaacttgttaagtcactttatcaggattgtgcgtgttccttaactgtctgtcacttttgactcatcttcagacactcattttaatgccaactttcagtgaccacaaaaactgtctatcctaaataatggagcccacttatagaattatggataaacaattgttgtggatcatttgatttgataaggtatcatcaccactttctagtagtagtttagaccacagtttttttgcatgtgtctttgttcatttctacagaataccatatgccatgccaaaagtatcatgaaatgacacataaagggagaaaagaaatatcaccttagaaccccaaataatcagatatatgatgaccaaatcttctccacaagttatccatggatggagatggacccctttgtcctgctccagcaagacgagctggcagtagcaagtgagaatattagtatcaggtagcatgtggtgaccatcctttgctctacacaacacacacaaattgttgccggcaaaagaggtttcttaaattttctataaaggtggccgttcctgtgacgatcaaatcattttttgtgtgtcatttctgctttttttttctttacctcaaaa

SEQ ID NO: 71893 - DNA, 4304 bp, Oryza sativa
cgtcatctattaaaaaacagaggtagtagcatatttgttttctcactatattattcaaatatattaaaataacaatataattttaaattttgcaataactttataaaactaataatgtgtaatattcatattgtattttatatacgtgttagttattaattatttttaataccaaattttagttatttgtaaattataaatattactatatggactctatactcgtcttttaatatttctttttttttaattctgaattttttgtaaattatatttctatatagactctatactcttcttccaatattatttatttttatttctgaatttttattatttctaattgtatttctatgtggactctaaactcatctttcaatattctattacttcctaattgtatttctaacctggactctatactatacttctaatattccttatttttaattctgaatttcagttattttctaattatatttctatatgcactatatactcctcttctaatatttcttatttttaattctgaatttcagttatttcctagttatatttctatatgcactatatactcctcttctaatattccttatttttaattccgaatttcagttatttcctaattgtatttctatatggattctagtctcctcttctaatattccttattttttaattccgaatttcagctatttctaaattatatttctatatggtttctgccttttctttttctccgattaatgtgagaatttctatgccatgagagcgaatgtggaggctcctttttctattcctttaataatataactagctgggtggcccgcgcaattgcgcggctagcacccaaacaaaattatatatattttttatgattttactaaaaatttattaaatagctatctcattgtcttaagagtttgaaagaccaaaccttatcatccccatgtttctaattatatagttttctaaaagtcacaccagatactaccccttatgttatctccttctttatttgcttgctcgatctaccactatttctattcattctccttagaaacttcaaacattggatcttataggttttagagtttattttcacattgagtttcatttttataatttctagacgtcccgtcaaacgttgccattatactcctctatgacccgtctactgtctcttctctttattgtcattgagattttaaaattcgaacataattatcgtttgggttcattttttactttctagaagtcccgccaaaccgtcagtgactttgccattgttcttctctacggctcgcccgctgcctcccttctttattgtcattgagattttaaaatcgaatatgactatcattgttttttttactttttagaagttccgaaacttcaaaaattgaaccttgtagtttatagagtttattgtcttgttgggttttatttttttataatttttagaagtcttgtcaaactatgccactatgctcctctacggcccgtccgccgcctactctttattgtcattgggattctaaaaattgaacataactatcgttggaattcattttttattttctagaagtcccgtcaaccgtcggcagctctgcaactatactcctatacaccccgtccgctgctgctcctttttattatcattgagattttaaaaatcgaatatgattatcaatggggtttattttttttactttctagaagtcccagcaatcgccttgatcgtttgctttacggcctccctgtcgcccctccttttagtcgtcattaggattctatttggtgtttcattaacaatttttttatgtcatatcaaccgccaccactctactcctttatatgcatgttacttaatttatctcgtcatgtattttagatggtcttttatttcaatagtctttatttttatcacaaattttagttatttataaattgtattcctaattggaatcttatttttcttttttctaatttcagatttttttaaaaaaaattaattaatatcgtattatgttcttttaatatttttattttttattttcaatttcagttgtttcaatattgttttcctacttgaaatctcatttactttatctaattttggatattattttattttttattctgaattttaattaatttcgtatcgggttcttatatggattcttctttcaatattgcttatttttaattctgaatttcagctaattttaaattgtatttcaacttgagctcttcttttgttttttttttgctaatttcggattttatttttatttttattcccaattttatttaatctcgtattaggtttttatacggactcttcttttaatattccttatttttaattctgaattttaactattttaaaattgtattcctacttggactatcattttcttttctaattttggattttattttatttttatttcgaattttgattaatctcatattgggttcttatatgaaaacttttttcaatattccttatttttaattccgaatttcagctatttttaaattttatttctacttggactctcttttttttttctaattttagattttattttatttttatttcgaattttaattaatctcgtattgggttcttatatggaaacttccttcaatattgcttatttttaattccgaatttcagctatttttaaattgtttttctacctggactcttcttttcttcttttctttttttccgattaatgtggcaatttctagccccacagcgaacgtgatgcctcttttcaaagctgttttaataatataatagatagataatagatagatagatagatagatagatagatagatagatagatagatagatagatagatagatagatagatagatagatagatattatttcgatgtaagcatagaaacaaaggagtataatgatatataaatggtgcaaaaccgaaacagcaatagaacattgcaaaccagataaccaccgacccttacctaatccaggaaataattgtattacactcggcaataaaagtaactagccccaggcccccagcccataaaaaagtgacagcatgtcccatagaaccaaacgacgaaccctccagcttgagattatccgaccagattagctaaaacgtggatggtatccccaaccctcccgcttgagattatccgaccagatgagctaaaacgtcgatcgtatcaccatccttcagctcgagatcatccggagtttccgagccttgaacacaggccgttgtaaaggaaaatacaaccattttggtacatgcttgcaggctccctgcttaagcataaatccatcagaccctgcagctcgtctgtccttcgcagggtgtatgcgcgcttgactcccaccatggtcaccagattgatcgtcacgaacctgctccgttcggtcgccggagcaaggcggagctggtcgccgtcctccatcccgtaatccgccggcgtcttctcgatgtcgaccttcctgccacagtacgtgacgtcgaattcgccgcgctcatcgtcagtgggcaccatggcgaagtagagatcgatcaagtcctgcagtcgttcttgggtcctgagcatggtgcgggtgacgacgacgctgcgccgcattgttgttgttgcccctgatcgtaagggtgacgaaggcactcggcttgctgaacggagagaaggcgatctcgtcgccgtccttcatgttgcattcctccggcgtctgcttagggctgagctccctgcaatggtagatgaaagcaccctccctgggcgcggtcgacggcagcatggcgaagtagagatcgaacaggatgtccaggatgtgcaacctacgcatggtatgcgtgacccggcggccattgttgtccgtcacggtgagggtgacgggcgtggtccaggttccgtcggggaagaagctgacctcgtcgccgtcctccatgtcgtagtccgccggcgtacggtcgccggtcacacgacggccgtagtgcatgaagacaccctcggcggcgtccatgtcggccggcaccatgccgaggtagaagtccatcaggtcgtccagcgcgtccgtcgtgcgcatcgtgcgggtgatcctgacgccttcgctgtccttcaccctgagggtgatgagcgagctcgcctcgacctccggcgacgagctgtcgtccgcgtcgtcctctccggtggccttcgacgacatggctgatcgagatctcttcgacatggtgatggcggatcgggaagctgacatggagtattgggtggaagggttgagtttttg
